United States Patent 7,745,391 (HUMAN THROMBOSPONDIN POLYPEPTIDE) - sequence listing, part 242

SEQ ID NO: 668067 - DNA, 478 bp, Homo sapiens
attgactaaactgggcagggaattgaccgaaataaaaaggtccatataccaaaaaagtggctatactacatatgaccgcccaaactttactagctccataggttttcgggatattcacaagcacacattaaaacaattacagagcggacatacgtttatgattaacgcaaatgaaggcacatgaattacaatctatgcttttaagatagcctttataaaaacctccacttacaagaattcaaatgatggccccgctcacctattcacgaggaatgtaagtgagccgagataggccattcctttttttatccttaaaagcaaagcgtgaagcactggggaacgtaggtctgtgccaaacacataaatccctgtgacggtgggaatcattgggccctgaaaaacattgcttatcgggttctacccagcttaattgttgggaaatgcaggtatacccaaagctggactataatagcccgct

SEQ ID NO: 668068 - DNA, 1264 bp, Homo sapiens
  misc_feature (10)..(10): n is a, c, g, or t
  misc_feature (457)..(457): n is a, c, g, or t
  misc_feature (462)..(462): n is a, c, g, or t
  misc_feature (466)..(466): n is a, c, g, or t
  misc_feature (469)..(469): n is a, c, g, or t
  misc_feature (471)..(472): n is a, c, g, or t
  misc_feature (476)..(476): n is a, c, g, or t
  misc_feature (478)..(479): n is a, c, g, or t
  misc_feature (894)..(894): n is a, c, g, or t
  misc_feature (915)..(915): n is a, c, g, or t
  misc_feature (1204)..(1204): n is a, c, g, or t
  misc_feature (1217)..(1217): n is a, c, g, or t
  misc_feature (1241)..(1241): n is a, c, g, or t
ttgtgagagntcggaggaatgtttgggaaatgtggctgtacgtggtccaggatatcagtggaagaatgagtaggaagggaagaggatacggggagtaaggatgctgggttgagggaagcacttctggtaagactgaatttgggattttttataaagagggcatggagtaattgaatcctggaaggaggaagggagcttactgcttgggaggagaggagatcttgtagattatgagaactgtggacggtggtattccgagccatcagtcaagctgtcctccctactcatcccatagtccataacccctatccacgtctctctctcgtcgctaccaacaccaccctctacactgcaattgacctgaaggatgccttctttaccatttccctacaccctgattcccaaaacctatttgctttcacctggactgaccctgacaccctccagtcacaacaantcacntggnctntnntccntnngggcttcagggatagccctcatttctttggacaagctctagcccgaaacctcacttccttaaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgatgacttacttaggaattcaactttcccctggggcccaggctatgactccagccagggcagcattaatagaaaatctacccccaccctcctccaaaagcgaaatcctttccttcccagggctagcaggcttctttagaatatggatttccaactttgccctcctagctcatcccctctatgaagtggccaaaggncctcccaatgaacccctaaanccctcacataacatactccccagcttccacaaactccaaactgctcttgtcactgcgtcagctccgtccttacctgatatctcccaacctttcactctctatactgctgaaagctgaggaatagccctcggtgtcttaggacaacagaaaggaaatcctccttcctttgcccctgtagcttacctctctaaacaactagataacacagtcaaagggtggccagcctgctttaagcactagaagtggtagccagcttagctctagaaagcaggaaactaactttcagccngaataccaccggncacagttctcataatctacaaganctcctttctccaagcagtaagct

SEQ ID NO: 668069 - DNA, 970 bp, Homo sapiens
actatttctagatcgctgccccctctgctgacgcccccatgttcgtcatgggtgtgaaccatgagatagtatgacatcaggctcaagatcatcagcaatgcctcctgcgccaccaagtgtttagcacccctggccaaggttcatccatgacaactttggtatcgtggaaggactcatgagcacagttccatgccatcactgccacccataagactgtggttggcccctccgggaaagctgtggcgtgatggccgcggggctctccagaacatcatccctggctctactggcgcgtgccaaggctgtgggcaaggtcatccctgatctgaactggagtaacgactcactggtatggccttccgtagtctcacccactgcaccaatcgtgtcaatgagtgtgacctgactgccgtctagaaatagactgtcgaaatatgatgatcctcaacgaaggtggtgagatcaggcgtcagtacggccccctatcgacggcgtcctagggcatacactgagtcatccaggtggttcgtccctctgacttctaactagacgactatcgcatctctgtccatccttcgatgctgaggctggcgttgcccatcaaggacactttgtcaatcctcatttcctggtatgacaactatatttgggtacagcaacaggttggtgccctctatgaccaatgctcaagagtaagagcctgggaacaccagccagcagagcacaagaggagagagagagccctcactgctggggtcctcccaatttggttccgccatatgatttccttcgccccgtttccaggtgaccctgaaagggggggccgggaagaccgggcgtccacatgggccggccaaccgaaaaaccacggtatgagaggaaaaaacgccgcaaaaaaagcggggtggaaaaaagggcgcaccagcgggaccaaagatatagaaacgactaaaccagccgggcaaaaatt

SEQ ID NO: 668070 - DNA, 372 bp, Homo sapiens
  misc_feature (166)..(166): n is a, c, g, or t
atttgttaagagacagggtctcactatgttgcctgggctggagcacagtggcactgtaccgtacaggacaccctgtgatatggttcgtagtctccgggcggggagagaagaatgatattactcccaatatcgtgtggagtgtccacccccccttgtgatattgttncataatatccagtccccccttcaatattacacacggtatcatggggaagtgtacacacccttacacaccccccgcgatattgagggtactatcatcttgtcacttcctgggctcagtggctcacacctgtaaccccagtatcctgagaggtggaggcaagggaatcactcgaagtccaggagtttaggaccaaccagggcaacatg

SEQ ID NO: 668071 - DNA, 248 bp, Homo sapiens
  misc_feature (187)..(187): n is a, c, g, or t
  misc_feature (212)..(212): n is a, c, g, or t
  misc_feature (230)..(230): n is a, c, g, or t
gccacatgggaagaagaagaattgtctgggccacacataaaatatgctgatgatagctgatgagctaataaaagaaattgcaaaaaaatctcataatgttctaagaaaatttatgaatttgtattgcggttagctgtatcaaagctgtgctggggccgcagtgcgtgtagactgggtggagaatccncaaattttagagtggggtcatgacncttaattttcacattcanggagattaacatgagtgg

SEQ ID NO: 668072 - DNA, 486 bp, Homo sapiens
  misc_feature (383)..(383): n is a, c, g, or t
  misc_feature (474)..(474): n is a, c, g, or t
agcccaacagttcgagagcaacctgggcaacatggtgagaccctgtttctacaaacatttcaaaaattagttgagcatggtggcatgtgcctagtcccggctcctcgggaggctgaggaaagaggattgcttgagcccaggaattggaggctgcagtgagctatggtcatgccactgcactccatcctggggagcagagctggactctgtctcacaatgacgtctataatctcagcactttgggaggccaaggcgggtggatcgcctgaggtcaggtgttcaggaccaacctggccaacatggcaaaaccccgtttctactaacacattggccaggccgtggtggtcatgtctgtggtcccagctgcttggaggctggggcangagaatcgcttgaacccaggaagcatcggcttcaagtgagtcaagatcgagacacttgccttcaacctgggcaacagagcgactctggctnacacacacacac

SEQ ID NO: 668073 - DNA, 334 bp, Homo sapiens
tttgaatccccctaccaagccgccacgtaaaatccttggaaaaggtgtgtgctgcctttataagaggcgccaaaaaaaagaatctccaagtgaaagggcccgttcgaatgcccccccagacttttagaatccctccgaaaaaaaccccctgtggtgaaggttttaaaacgggggatcgtttccagatgagaattcccaagcgcctccttgccttgccccgtccttttgagattgttaagccgattccttccccccgtattgagcccggggttgggggggaagtcccccttgcagatgcttaagtccccttttttaataaattgatgccccgtta

SEQ ID NO: 668074 - DNA, 708 bp, Homo sapiens
gcctctcaagcttggggttgtgggtggggtaaccacgcgggttcaacatgcgtatcgaaaagtgtaattactgtctcggggcccatcttagtcctggacacggcatgatgtcgtccgtagcgatcagcaaggtgtgcagatattggcaatgtctagaatgtcaatagatacaatttaagactagaagcgcagatcctcgtcgaaagtacaggtgggaccaaaggcattctcggaaatgcatgctgggtagaagagctctacagtggatacttccattgcgagatttgaaaaacggtggaagtgaagctatcaaataccgatgggagagcatagctggaataacaatgtattgggattgcgatgaagacgatggttgaagagcttcaatcggaaggcgtcgcagagcatagagaatcttagtagatgcaacgaggatttggacagaagaagattaaacgaaggctataagaagagtccaagggatatcaagactgaaagtcacagcacagtaagatccatctatatccgagcccctccgttgcagtgcatgagggaaaacaggtcgagaagacgataaatgtgttacagcagattacataggagtgattgtggccctcggcaaagattgctcctttaaagaaatcttctggtaaccaatatactatatatttgtacatttggaaaattgccctttggattacttgtaac

SEQ ID NO: 668075 - DNA, 361 bp, Homo sapiens
ctgactggtagcctaagtaggagacttttcttcctttttttctctctccccattttttggggggagtttttcaattatgcggttctgctgctcatgactctaaagtaaagctcttttggatagtatatcctaactttactgctagacagtatggctcattaagattatttctcaataatcctagtttatcataatgattttgtgggaaatcatcaatctatttttattatatgttatgtgtttatattttggactgattttgggaaaaactgttcaatttgggtccttttaatcttattttaagcagcctagaatgtaatgaagctcttatcttatgaaagctgatacactttattaaaag

SEQ ID NO: 668076 - DNA, 162 bp, Homo sapiens
agaggacgcgtttgacgggtctggaaaacaactgagattagcttttctggtaacacttggtatatgagaatttacaggtcctaaatatgcacttcccctgtcattctcacaattatccctaaactgggagacacttagcacgctcacctaaacgatactgac

SEQ ID NO: 668077 - DNA, 246 bp, Homo sapiens
gtcgtgtctgtgacaggccgaggggtgctgtcacctgttgatgctgagtgaaatgtgctggtgacagtgaagaggggtgacatgacctgtggattctgagtgaagtgtctgtgtgacaggaagaggggtggtgtgaccgtgtggatactgagtgaagggctggtgacagtgaagaggtggtggctgatgaccttgtggtattctgagtgaatgtgtcggttgacagtgaacgaggtggtggctgtg

SEQ ID NO: 668078 - DNA, 280 bp, Homo sapiens
ggacggtgcccagcctcaccaagaaactagagaaaaatgaatttaaacaatggtacagtaccttttatcaaaaaaatagtaataataataaaagaggccaggcgcagtgactcatgcctgtaatcagtactttcggaggctgaggcgggtggatcacctgaggtcaggagttcaagaccagcatggccaacaagatgaaaccatgtctttactgaaaatacaaaaattagccaggcgtggtggcgcatgcttgcaggtccccagctacttagggggcctg

SEQ ID NO: 668079 - DNA, 907 bp, Homo sapiens
  misc_feature (264)..(264): n is a, c, g, or t
  misc_feature (275)..(275): n is a, c, g, or t
taaaaaggggagtctcactcggtggcccagttgggagtgcaggggggtgatctcggtctcaccaaaattctcggcctcccgaggttcaagggatttctcctcctcttcagccctcccgagtagcgtgggaataacgggcaagtgttgccaaatacgcccagcataaatttgtgggtattttatagtagagagggggtttcaccagtggtgggccaggcgtggctcttgaactcctgtgaccttcaaatgtgactccactccacnctgggccccancaagaggtgctgtggctcaccatgtgcagtggagtctcacgtggcaccgtgaaccttgggagtatagggttctcacttctcccccccattgtagaaccattttggagcattttttatgtgtggtagcagccttctgcgtgggggtataaaatactcctctgtgggtgactgtgaattagaaacgtgtgcgttgtgggaacggaggaccagcagtggtgcgacaacagtgtttgtcgacccttttaccagggatttaaacacggctggttgagatacactcctgtgttacccatttaattggagctccttctataacacccccatttgaatgaatacctgtccccattgggattgacgcagggggtctctggtggaaaacgacaacagagtactctgttgttatcattctgttcggcgaggaataatgctccccaactttgtgttgtgcgcccccacttcttgtggcgtgtgcgcggcgtgtggggcgccacattcttcggtgtcttccggggggacaacccctcttggcccctcccggggcgtccccaggtggaatacctcgctggttctaagcctcccccaaggtacgcgtgggggcacacgcgtggtcgtgggctcccaaccgctgggga

SEQ ID NO: 668080 - DNA, 226 bp, Homo sapiens
ctggatcgacgaagagttgtggctgggcttcaccaccgtgctgctcaggacagccccatgcctgctttgtcatatccccaccagaatatccctgcccagggaagtgagaggctctctttatggagccatgcagaactggtgcagagaaactaagacggatggaagagatggagtgatcttacggcaggggtagagagagctgagttgcggacgcagtccacttagg

SEQ ID NO: 668081 - DNA, 647 bp, Homo sapiens
taaacccctgttctgtgggtgggtgtgggggtgatcctaagttgaaatgatatacatttactgggggaaggcgctttgtgaagtaggccttatttctcttgtcctttcgtacatgtgaggaatttgaatgtaagataaggaaacctgacctggattacatccggtctgaactcagatcactgtaggacttataatcgttgaacaaacagaaccttaaatagcggctgcaccatacggaatagtcctgtatccaacatcgaggtccgtaaaaccctaataggttagatatattggactctaaaatataggatttgcgctggtaaatcccctaagaggtaacactttgtcccgtgaggtacaatgtttattggtgtctccaatgtgagagattataagataagttaccgctatgtgaaacgagggttagaaagatactatagacaagtgttaacgtggcatacgagaaaggatgaggagatatcatagacctcccgaagaggatacgaccccccaaaacgcgagagacatattatataaatagccgagagcttgtggggaagtttatagagaacccgtggtggagtattgataaaggataacatggaggagggcaatataactaaaatttaaaggctcccataggaggg

SEQ ID NO: 668082 - DNA, 442 bp, Homo sapiens
  misc_feature (8)..(8): n is a, c, g, or t
  misc_feature (86)..(86): n is a, c, g, or t
  misc_feature (232)..(232): n is a, c, g, or t
ggggaagnagtggtggtgaatcctatggattcacctcagtccttgcctcctcagaagaagaattccaccaggggcatgaggcagantgagggaccgaggcagagagccaggagtgaagattaaaatgttttggggcaggtgctgggcacggtagctcacgcctgtaatcccagcactttgggaggccgaggtggttggatcagttgaggtcaggagtttgagaccagcctgnccaacatggccaaaccctgtctctactaaaaatacaaaaattagccagacatagtggcacatgcctataatcccagctactggggaggctgaggtgggagaattgcttgaacccgggaggtggaggttgcagtcagccgagatcacaacactgcactccaacctgggcaacagagcaagactccatctcaaaacaaaaacaaaaccaacc

SEQ ID NO: 668083 - DNA, 493 bp, Homo sapiens
  misc_feature (458)..(458): n is a, c, g, or t
aaaaaaaggagtggggattaaaggggggcccccccaccccggggtaaatttggggggttttttttttgggcaaaaacggggttttcccttgggggctaaattggttttgaactcccggggtaaaaaaatttgccccctttaacttcccaaaggggtgggattacagatgggggcccccatgccccgcctttttttggcatattttaaaatgggctttaaatggggaaaaaacatgggctcagccaaacccttaaagacatttttgggagttgggggggtggccaagggtttttttatcccaaaattttataaaagggggtgggttttgggttttttttttttttggggaagaaattaccttgggccgaatttctgtggcgcgggggattctttttttttaaaggggccccccacgggggggggtctcaatttttgtttctttttgaggggggtaattntggggttggcgataaatgggaaaaagttgtttttg

SEQ ID NO: 668084 - DNA, 1357 bp, Homo sapiens
  misc_feature (350)..(350): n is a, c, g, or t
  misc_feature (1357)..(1357): n is a, c, g, or t
gagtatgttcgaactctgccacgtgcgcctatatcctcgcagatacgattgacacttacgtccactgccatgtccagtactggccgagccgagcgatctgagtgtgacttcaagatcacagaaggctgtctgtgtagggtgacaccggaggcagtattaattgtcaaccgagatgtaaatagcaccacatgccactaggagacagatctctggcagcagtgagtgctttgtcactaaatccttggattctatacactcataggacataacaagggcatatcattcttagtacttaggaccacactgtctgcatgataaggtgggtaggaaagcataggtgataaatcacntatgagagtgatcactctctgtggcagatatatggcctcaggaacgttttgggtccataagagacggttcgattttaaatacaccttggaacaagtatatagaaaatggagaaagcacttagacctagaaagactacgcaacccacgtgcaaacttttaaatgcaccttgggcccacgggttagtccatgggggatgcaatcgtctcggatagtggtaggatacgaacgttggtgggaagttatctcctttttgtgcataatatatctttgggggtggtaacacttagtttatttgggccgttatgggtaacttttgcattcacttatatggtgtatctttgggaaattatttgagagtaaaataacgtaggtttataacattcgcgacttcgattaatcatacagtatcattagcgtttctttgcgtcttagagacacaatcaattggctgggtcaatacacaaccccttttatttttcacattcctttattaacaatgtgtggaggagagaaggcaacaacgacaaattgtactcaatgtatacataacggaatgaattcaattaggggaccaaaaaacagctgtgtggtcgacttttagagggccaatttcgatttttagggtggggagacgggattccgaaaaaaacgtggagaccggttattatatataatgaagatgggttaaaggtgacaaaacataaaggccattaatttttcctccaactttcattataaaatttaacaccaagaaggctaccataccggttgggaagttcagccgacgggtacccataaacatggggcttcccaatatagtaaccacacactcaaaaacaacaggaaatcccgacggtactaaaattttcccccttttccttcttggcaacaagggtttataaaggcgctcctctgtgggcagcatattcttcgtcacagtcggcggatatatgttgggccacacagctgtgagagcgctctctggtgtctccatataacccacgan

SEQ ID NO: 668085 - DNA, 729 bp, Homo sapiens
cctgtgccccatggtcttttatcgtacctctgggcccccccgattgaatggttggcctttgaacgaagcttttggccccaaatagcgcgttctgttctcgcccatctttcacatgaaggagagaagggaaccacatgctgagagaacttgagatgagaagtctcgccagagacccaacgagggtggcccgaatctttcccttccaggagtatttccagaaaccacgactgtgatgaactgggagaagcgcggctgaaatgcccactggaagtgtgcacattaccacatttggaaaaaaaatgtgagaatcacggtcacctatactggaaactgcaccacaaactggccacactgacccacaaagtgacccccacatttgtgtgacttcacttgagacacccttacctgaatgagcccgcgtgagaagccctccaagaattgggtgaccaccgctgacccacttgcgcccagatgggagcggccccgaatctggccttggcggaatatcttctttgacccagcacacaccctgggagaccacggtgataatgaaagctaagacctcgggctatatttccccctagaccctggggtgacttccctggtcacccaggccgtgcatgcctgttggggtttcccttaccttttctataagttgtacccaaacatccccttaagttctttgaatttgtacccttcccttccaataaagaaaatttggtaccccca

SEQ ID NO: 668086 - DNA, 540 bp, Homo sapiens
gctggtgaccactagcgccatgggtaggggctagtgcagaactccctaggaggcaggcactcctgtgaggctttctctgggttcccctctgccaggagatccaggcagcatcaggagccagttcttggaagagcagttggctctgcataggggaactctgagccagttgatactaaactcttgtcccttggattcaagagtttcctttgaccaggcatggtagcgcacacttttaatcccagaatttgggaggcagaggcaaacagatctttgtgagctcagggccagcctggtttacatagtgaattcctggatagccagagctacatagtgagaccttgtctcaaaaacaaaacaaagaaaccaaaacaacaacaacaacaaaaagttgttcttgtacctctggctctgggatcctgggaaaattttggttgtttgttcttatatggttgaaggtttggcaaagaaacacacaacttttggttttagaatatagcaaatgtaaattctagaagactttccaaaataaatggtgtgtct

SEQ ID NO: 668087 - DNA, 220 bp, Homo sapiens
cgcggaggaaggcaccgcagtggtatcagtcttgccaagtaaacgggctgtttccaaacattgtgacttggctactgcactggggatacctggtttcattggcaatcttccagtatctctctcgcaaaaggaacgctgcactttttggttgtctctccgagtgaagatccccgtttttattccccagcactctcgtcggtgactgttcagtcatgaaatc

SEQ ID NO: 668088 - DNA, 128 bp, Homo sapiens
aggtgcctctcatgtcacgctctacctctgggactgtacatttttcccaacatcgttttcttgtgtctgggctgctttctcgtcgactttgagtgccgcatccggccctgcgatgttgccatctccat

SEQ ID NO: 668089 - DNA, 928 bp, Homo sapiens
ctggtcatgagaccatttcaatccctgcagaagcaccactcatgtccccttccatcggtcccctgccccatggacagtcactgctctcatttttttttgttccttttctctttggaggcagcatctcgctcggtcgcctcaggcgggagtgcagggggcatgatctgggtccacttgcagcctgtgcgccaccagtgccgggctaattttggtatttttggtaaagatggggttccttttttgtttttttttttttatgggggggagtctccccccgtgggtcccccagggggggggggcgccggtgggagtgcaactctccgcggcgctacagtgaggaacaccttcgtgcccccgcgggcgattaggggaatatacccctcgctgcacgttaaagacccccgaaaaaagagggggacataaagcggccagcggggcccacaggcggccccgagacgagtaatatcggcggggcctacacaaggggaagacagacagcgggggtgctccaccaagagctgcggtgcacgacgggtggctccattgaaacccgccggacacccaagagggtatcccctcgggccctgacagcaccccaaagggggcggggaacaacaggcgatgttgacacgaaagcgacagggccctgttacctcgtggaaacacagtttttccccccttgagtagccccggggcgtgataatcaggggggcagaacgatgcgggccggacaaacctaccgtccgagggtaagaaaatctgtccgagacaagccatcaaacagcgagaataggggatgcgccacccacccgaggagtatgagtacacgcgggaacagcgtgccagaaaaccaagggggcgtacagctgaccaggagatggcgcgccgcccaaggagggggagggggagtgcccgcgataagagctca

SEQ ID NO: 668090 - DNA, 857 bp, Homo sapiens
ctgtcctgcgaacaatatggtgctcctcgctgatcccaacttgttctgggcgccattacttttttgatggcgcaaagaccaaggttacccccactatctcttggaggtccgcacttttcgtgtgaagaagggcacaacaattttcgcgcgcgtgcccgaccagctcctatacggggggaactccactcccaaagttgttccacccggccccagttcccacgagaccattatgcggtcttctcttccccgggccctctttttgcgcgtaccccctgctcttgcctcgatggaacccctgcgggggaccatcttttacccacaatgctcctatgggtgccaatataccgtatgcaccgcatttttttgaacaggtagccttctcatacaacggcgcggtccggttacaacaatagtttagtcagggcaaggggtctttttaggatcaaaacatatacgggccccctcggcgttgaccctccctttacttcatgaggatcaacatgtgcccgcacgcattacctctctatccgatattcaggcgaaacctccagcccagcttttaatcctcgccctgcacaagaagcccccgctcgcttctttgttgactattgaaatcctgggtctccacgacctgcacgtccgccccatgccatgctgtgtagatgagatatacgtccctgaccccgatacagaacccacaggcctaggcgtgactgagtgaggaatgaataccctcttcttgtggcatggccaaacacaagcacaaacttttcgggagctccttagggttagccacacgcttggaaaacaggaagagccaaacgcgtttttagaaaaaaaacacccccccacaaagc

SEQ ID NO: 668091 - DNA, 254 bp, Homo sapiens
gcagcataagagactccagtctgggttctgactgttgacctggactggggatgggactgggacactagtacttcctttccgctgtagatttttttatggatcagctgtagactttaatgaaagtggcatggtgcccaccaaatagaaggctacatccggttggtaatgtgtctaaagtgcagaccagcccactgcacaaagctgtcccctctggtttggctcttgctctgtgttcaatgttgcttgttccgctg

SEQ ID NO: 668092 - DNA, 686 bp, Homo sapiens
aacaaactcgcaaatggaaaggactttgcaatgcagagtctaaggagggaaaatgaaaatatgacagatacaaagaactgaatgcattctgaaatcttaggggaatacaaatatctagtattgagacagcccaaagctaagagtctgcaaactcagataacagtaagaagctttttcaccaagaaataggaaacttagtgctctaggtacatagagcgtggcacgcaggcagggcctgtgtgttgttaatctgtcgacccgatatcttgctatagctgtaggattatggtacgtgattcagtttcctctctgtatgcaacatccatgaaaatatctatttacttactgcctcgggaatacacattccaacattgtatgatttagatcagacttcgaagatgtatttcatgctggagttttgttaacttcgtataactttctgattatgtggtagctggtggatcgtaggcatatttagcagttgggcgaaatgtctaaggcacaagattacctttgatacaaaatgccagtaggaagggaatcgaaggacgcagagtcgatgcctgcagttgcttgttgcggtgaccccagctctggagacagactgcataggtccgcatcctgactcttcaagttaccgtgtgactatgagcaaacttcttaactttactgtgcctcagtacctc

SEQ ID NO: 668093 - DNA, 128 bp, Homo sapiens
tcacggcactcgctattcatcggcacttcgctattcatcggcacctcgctattcatcggcacctcgctatcatcggaccatacaggactctttcgaggccctgtaattggaatgagtccactttaaat

SEQ ID NO: 668094 - DNA, 116 bp, Homo sapiens
catctagcggatcctattttgccacccacagccttcacttttgttgtattggtttttttttttgagagggagtcttgctctgtcgcccagtctggagtgcagtggcgcgatctcgg

SEQ ID NO: 668095 - DNA, 259 bp, Homo sapiens
ctagactccaacttcctactcctcattgtacattctaatcgcactggattccttatgcttaccgaacgaaaaattctaggctctatacgactactgcaaaggcccaacgttgttggcccctacgggctactaccacccttcgctgacgccatagaactcttcaccaaagagcccctcaaacccgccacatctaccatcaccctctacatcaccgcccctatcttagctctcaccatcgctcttctattatgataccgcg

SEQ ID NO: 668096 - DNA, 254 bp, Homo sapiens
  misc_feature (5)..(5): n is a, c, g, or t
gctancccactccaccctactaccagacaaccttagccaaaccatttaccaaattagtataggcgatagaaattgaaacctggcgcagaagatatagaagagtgcacttttgaaaagtgcactcttctatatctacattcatctgctttcatattgtccccaaatgcctttctttttacctcatccatttacttgttcctacgagtgcaaacagacttactgtagcaattaaagaatataactacctgctttgt

SEQ ID NO: 668097 - DNA, 104 bp, Homo sapiens
gcttgcagtagcgggcggcagagctggagtgaagggagctagttgtagcagtcaccattatgcttaaagcggtgattcttatttgaggccctcaaaaggggact

SEQ ID NO: 668098 - DNA, 444 bp, Homo sapiens
  misc_feature (444)..(444): n is a, c, g, or t
ccaggtcctactacacaatcaatgcttgagcactgtctacacttggacggctcaggctgggcgagaacccaaacttccaccgcagacccgcaatctgcagacctcagcggcagcgcaggtggcagacctgcctactgtgcctgtgagtcatggcagctcccatgaatggccaagtgtgtgtggtgactggtgcctgcagaggtattggacgtggcattgccttgcagctgtgcgcatgcgccacaggttacatcactggccgccatctggacaaccttcacggtgttgctcaagaggcaccatcccttcgtggccaatgcgtgcctgccgtgtgcgattcaagccaagaggagtgagggtgcagcctgtttgaacaagtggattctgaacagcaatgcgcctagatgagcatggccactgttatgcagggtacagacgtcctgn

SEQ ID NO: 668099 - DNA, 366 bp, Homo sapiens
ccttgtaagtgctgagcttcctctctgaaacctcctaccattgttttttttcccctgtagctaacaagaataagtataacagccggccaggcacagtggctcatgcctgtaatcccagcactttgggaggctgagacaggtggatcacctgaggtcaggagtttgagaccagcctggccaacatggtgaaaccgtgtctctactaaaagtacaaaaattagccaggtgtgatggcaggtgcctgtaatcccagctactcgggaggctgaagcagaagaattgcttgaacccgggaggcagaggttgcaatgagccgagatcacgccatcacactctagcctgggggacaagagtgagacttcatct

SEQ ID NO: 668100 - DNA, 140 bp, Homo sapiens
tagaggatctgtgaacttctcctcctccttaattcacttccttgttttcatgaagtaatcctcacatatcctgcagagatcgtccagtgacgctgcctgggaatctccacccgttatgtctccatgatgatggacccaca

SEQ ID NO: 668101 - DNA, 155 bp, Homo sapiens
caagattgcgcactgcactcagcctggcaacaagggagactccatcgcccccctcaacaacaaaaaagttcccatacactggcctgcccaaaacccactacaatttaagcaaacagtccaggccaagaggagcatttatgttcaataagaaccca

SEQ ID NO: 668102 - DNA, 327 bp, Homo sapiens
aacagaaaccagttttttaatggcgggaatgggccatttgaaataccagaaaaattttccaaaggggcaatgactgagtgggaatggggggggtcccattaaggccctccattttttaaaattcaaaggacccatttttcctgggaaattgggaaagcaggacatggttttccaaggttcacaggtaacccctccccccagagccctaaggggccgacggcccccttttactttatttggctgggggggaaaacaaattgactaagcggcccccgaatttttagttttaacagatgtttttttaaaacaggcggtaaattaacaaaa

SEQ ID NO: 668103 - DNA, 619 bp, Homo sapiens
gcacgagagttcatctaggcaatcctctaccggacaatcgaattccacaactaaaacagcagggctacgcctgactaagggcccaatttccataatctgtcttaaagaaataaccatagtataaaatctgtgaatcatatttttggattctctgaaatcttccacattcaagttctcgaatatcataaattccctccccagatccttaagcatttgaagccgatctttcaaacttcgacagccctcaaattgttgcaatagaagaacatactttccaaaggaagagttgatttcagtaagagcctcatatccagaatagtccagaaacatagctaaaaaaaaaaatctcgtcaattttttttttaactattcaataccttaccgagtaatcactttaaaacaaaaaataaataaatttatggactattttcagtgactgatatgccaaattcctttgccctgtatggccatattttcttaccatttctgtggtgacaaaggtgatgcaattactgacacaacaaggtaaaaaagagaggcgggtaacaaattacacacgtccatcatccgctaagcgctttaagcttatagagaggcaagtaacgtcattgatcctgga

SEQ ID NO: 668104 - DNA, 198 bp, Homo sapiens
cacacttctggtaaacacaaagtttttgctcgtacctcttttccctgcccacaggcccgttagatatctctgtggccagtgaaataatggctgtcagaatctcaccagttctctagaagacatgagagagagactgggcaaacatggtggtggcatccatgtaagaaaggagagctcgtcagatccgaagatctggtg

SEQ ID NO: 668105 - DNA, 236 bp, Homo sapiens
  misc_feature (17)..(17): n is a, c, g, or t
  misc_feature (174)..(174): n is a, c, g, or t
gcgtggtcgcggccgangtacctcagtcgtttgggttttcctgcctgcatctgttttgtgaaatggtcctgtttttgggtaggtgacacgtggactctagtgtgtaaatgttacttgaatctgtgcttcactctagtatgtggcatgtgtgtgcggactcttggatgcttcacncctactccactggagcccctgtccccaggaggacagcttccccactgataatcaggagacca

SEQ ID NO: 668106 - DNA, 863 bp, Homo sapiens
ttcttattaggaacacagggataaagaaacaaagaagaagacatacaatctcttcttcccgggttccacatacacagcacagtcagaattagcccatcttatggggttcaggccatcttcgttccagtcacccgatcgtggtcacgccattggtacccacacctcatttccgcgttaatccaatctcggagattttccccacccggaaagcagtaatggaacccctgttttgggggaagaacctttcagaccccctgctcaaacactcttgatgaggtatatagtggaatcacaaacggtacacaactttcagggggacccacccatgtcatttcacggctactttcaatatagtgtgtacaaccccacggttccaacaaaatccccccccccaatatgtgtggcgtacaccctcccccgcccattgtctatacatcccccctgttctgcaccccctgtggtacagtttcccgcaagcgttccaaatacttgttcacatgttagcacacctacttccacacaacatttttcacaaaaccccaagagattggcgacagctccgataaattgtatctgtaaaaagattatccccaataaagtgcgccactggagctcaacaaccccgtacactaacgcttgttaaccaacacccgggggctttaacaattttgtgaaatccacgtgttctgtaccacaatcccctcaacgagacttttctgccaaacatcatagctaaatatcacaataaataacccccctataattttagaacatcttcctataaatagtgggcatattttaataagctttgagggacccctccaataaggcccaattaaaaaaaaatgttctttaacaaaaca

SEQ ID NO: 668107 - DNA, 361 bp, Homo sapiens
taccaggtatgtcttctcagtcaggatgtcttctcagccaggatgcagcccatggagggtgagctgaagcaggcggggcatcaccgtcatccaggaagtgcaagaggttgggggatttccctttcctagccaagggaagccttcacagtactacctggaaaaatgggacactcccgcccaaatactgtgcttttcccaaggtcttagcaaccagcagacaaggtgattctctcccgtgcctggctcggcggctcccacgcccatggagccttgctcactgctagcacagcggtctgagatccatctgtgagacaggagcctgactgggggaggggcatccgccattgctgaggcttgagta

SEQ ID NO: 668108 - DNA, 334 bp, Homo sapiens
ccagctcctctggcaggttctaaaagcacactactgagcagcggtgccctgccggacactgctggcgggggctcagtgagcactactcacagatccacacctgaccctgtttggtcgagtcaggctgggcttggtctgcactgtagcacctctgttctttgagttcacatcatgaatgtggtgacttccagataccatctcaggcttaactagcacatctattctttctctatgatatcaaattgactactcattcaagtgctgtccatttgtcactatctatctgggaattcaactgatgccaccactttgaattctgctaggcaactgtcta

SEQ ID NO: 668109 - DNA, 158 bp, Homo sapiens
agcttctccaccgcagagcattgctggctgctgcctctccactccaggcatgagggaacactgtgtactgctatagtgtttctcagactgatctaatcacagaaccctttgtcacgcgccgtggcccacacctgtaatcccagcagtttgcgcgggcc

SEQ ID NO: 668110 - DNA, 208 bp, Homo sapiens
gttagggggcccttcaagattccagctggtattagccttctgcagactagtcagactaggatggctgtatcactaacagcagctgaaactctggcccttcagggtacacaggggacaagagaggtattattatgggcccaaaggagaggacactcttttgagtattacaccacggctacctggggaccactctaccactaaggggtct

SEQ ID NO: 668111 - DNA, 226 bp, Homo sapiens
gcgtggatatctccggtctgatactctacgcatacgctggactttaatctttgaataaacctaacctttaactagcggccgtaccatcgggatgctcctgcagtccaacatcgaggtcgtgaacggtaaagcccttgtggactctagaataggattgcgctgttatccctagggtaacttgttccgttggtcaagttattggatcaattgagtatagtagttcgct

SEQ ID NO: 668112 - DNA, 827 bp, Homo sapiens
  misc_feature (445)..(445): n is a, c, g, or t
  misc_feature (449)..(450): n is a, c, g, or t
  misc_feature (455)..(455): n is a, c, g, or t
  misc_feature (458)..(458): n is a, c, g, or t
  misc_feature (467)..(467): n is a, c, g, or t
  misc_feature (470)..(471): n is a, c, g, or t
  misc_feature (475)..(475): n is a, c, g, or t
  misc_feature (484)..(484): n is a, c, g, or t
  misc_feature (498)..(498): n is a, c, g, or t
  misc_feature (507)..(507): n is a, c, g, or t
  misc_feature (514)..(514): n is a, c, g, or t
  misc_feature (543)..(543): n is a, c, g, or t
  misc_feature (584)..(584): n is a, c, g, or t
  misc_feature (617)..(617): n is a, c, g, or t
  misc_feature (619)..(619): n is a, c, g, or t
  misc_feature (623)..(623): n is a, c, g, or t
  misc_feature (634)..(634): n is a, c, g, or t
agtcgtacgtcgtgcacacgtggtccggcgtggttcaggcgggtgtcttcggccgggcttgggaacataaaagtttgtttcaccacgtaagccggacctcgcactccggtcccggtctcgtcgccaagatggtgaagcccaagtacaaaggacggagcaccatcaacccgtccaaggccagcacaaacccagatcgagtgcagggagcaggaggccaaaacatgagggaccgggccaccatccggcgcctgaatatgtataggcaaaaggagcgcaggaacagtcgtggtaaaataattaaacccctgcaatatcaatcaacggtggcttctggcacagtggcaagagtagagccaaatattaaatggtttggaaacacacgtgtgattaagcagtcatcattacaaaaatttcaagaggaaatggatacagttatgaaggatcnatannaagtngtnatgaagcanagnnagtnaccgatgtntcttctccatgatngaatccggnctcatancttgaaggtgcacattcttgatactgaanagtctgaaatacatttggcctaagtcacagaggaaagacanattatttgcagtgatatgcagtctcttatcgananatgntgaaatgtcantgagagctatgaccaggggcaaggatcgtgatatggtaacttgaagacaactggtgtgacgaacatgccgctcacagacagagatctgataacaggggactagtcccaacggaatctggggcgagctcgtacagggtggatgcgatccaccagatgcctgtcgttccggttcttgatgccagagtatccccgg

SEQ ID NO: 668113 - DNA, 881 bp, Homo sapiens
  misc_feature (128)..(128): n is a, c, g, or t
  misc_feature (177)..(177): n is a, c, g, or t
  misc_feature (499)..(499): n is a, c, g, or t
  misc_feature (503)..(504): n is a, c, g, or t
  misc_feature (509)..(509): n is a, c, g, or t
  misc_feature (512)..(512): n is a, c, g, or t
  misc_feature (521)..(521): n is a, c, g, or t
  misc_feature (524)..(525): n is a, c, g, or t
  misc_feature (529)..(529): n is a, c, g, or t
  misc_feature (538)..(538): n is a, c, g, or t
  misc_feature (552)..(552): n is a, c, g, or t
  misc_feature (561)..(561): n is a, c, g, or t
  misc_feature (568)..(568): n is a, c, g, or t
  misc_feature (597)..(597): n is a, c, g, or t
  misc_feature (638)..(638): n is a, c, g, or t
  misc_feature (671)..(671): n is a, c, g, or t
  misc_feature (673)..(673): n is a, c, g, or t
  misc_feature (677)..(677): n is a, c, g, or t
  misc_feature (688)..(688): n is a, c, g, or t
gctcaaaaatattagctattcttctcaaatacaatcctatcgaagatcaaagattgggtcagctttgtcataccatgtagcttcaagtactaattattggagcaacatatggagaaagtagagatttntgtggttggtggcttcttacctaatttgggtgaactacttgttgcattntaagcaatgacttgttggttatactggttggttatcaaatagtgcactgtgtacttctgccttttgtagatcgagtgcagggagcaggaggccaaaacatgagggaccgggccaccatccggcgcctgaatatgtataggcaaaaggagcgcaggaacagtcgtggtaaaataattaaacccctgcaatatcaatcaacggtggcttctggcacagtggcaagagtagagccaaatattaaatggtttggaaacacacgtgtgattaagcagtcatcattacaaaaatttcaagaggaaatggatacagttatgaaggatcnatannaagtngtnatgaagcanagnnagtnaccgatgtntcttctccatgatngaatccggnctcatancttgaaggtgcacattcttgatactgaanagtctgaaatacatttggcctaagtcacagaggaaagacanattatttgcagtgatatgcagtctcttatcgananatgntgaaatgtcantgagagctatgaccaggggcaaggatcgtgatatggtaacttgaagacaactggtgtgacgaacatgccgctcacagacagagatctgataacaggggactagtcccaacggaatctggggcgagctcgtacagggtggatgcgatccaccagatgcctgtcgttccggttcttgatgccagagtatccccgg

SEQ ID NO: 668114 - DNA, 551 bp, Homo sapiens
  misc_feature (169)..(169): n is a, c, g, or t
  misc_feature (173)..(174): n is a, c, g, or t
  misc_feature (179)..(179): n is a, c, g, or t
  misc_feature (182)..(182): n is a, c, g, or t
  misc_feature (191)..(191): n is a, c, g, or t
  misc_feature (194)..(195): n is a, c, g, or t
  misc_feature (199)..(199): n is a, c, g, or t
  misc_feature (208)..(208): n is a, c, g, or t
  misc_feature (222)..(222): n is a, c, g, or t
  misc_feature (231)..(231): n is a, c, g, or t
  misc_feature (238)..(238): n is a, c, g, or t
  misc_feature (267)..(267): n is a, c, g, or t
  misc_feature (308)..(308): n is a, c, g, or t
  misc_feature (341)..(341): n is a, c, g, or t
  misc_feature (343)..(343): n is a, c, g, or t
  misc_feature (347)..(347): n is a, c, g, or t
  misc_feature (358)..(358): n is a, c, g, or t
ggccgtgattacgtggattagggcaatgtagttgtaaactttcagtatcaagaatgtgcacagtggcaagagtagagccaaatattaaatggtttggaaacacacgtgtgattaagcagtcatcattacaaaaatttcaagaggaaatggatacagttatgaaggatcnatannaagtngtnatgaagcanagnnagtnaccgatgtntcttctccatgatngaatccggnctcatancttgaaggtgcacattcttgatactgaanagtctgaaatacatttggcctaagtcacagaggaaagacanattatttgcagtgatatgcagtctcttatcgananatgntgaaatgtcantgagagctatgaccaggggcaaggatcgtgatatggtaacttgaagacaactggtgtgacgaacatgccgctcacagacagagatctgataacaggggactagtcccaacggaatctggggcgagctcgtacagggtggatgcgatccaccagatgcctgtcgttccggttcttgatgccagagtatccccgg

SEQ ID NO: 668115 - DNA, 378 bp, Homo sapiens
ttaggctcagtcaatccaggaatatctgcagagctccccactctggacctcaccatcattctggtcataattctacttcttttcactagcaggccctcaaaggtccatagcttttggtgaaaactgacacatccaatcacaaacacataagctataaccacaccgtaactttcaggaattttaaacaatttcttcacacacatgcacaaaaggctaccattgtttagcctgttctgatctggactaagcagagatgggttaaggcttcaagcacctatttccccataggtgagctacatggtaacctgcaggtgaagcaccaaggtgggaggtcaaagaagtgggcttattagttatccaaagccaaaagagaaatcc

SEQ ID NO: 668116 - DNA, 222 bp, Homo sapiens
  misc_feature (159)..(159): n is a, c, g, or t
gctgtgaccgaaggcgtggagggcgaggagtgcaggctgaatggcgaaggggttggacaagtcaacgtctctgtagtacagtccaccatctccagtggctatggcggtgcagcggtgtcggcagtggcttaggcctggtgtggaggaagcagctacccnctatggcatgtggtccttggcatttggacggtggcttcacgttccatgcgttgcgggtcgcag

SEQ ID NO: 668117 - DNA, 1100 bp, Homo sapiens
agtcgtacgtcgtgcacacgtggtccggcgtggttcaggcgggtgtcttcggccgggcttgggaacataaaagtttgtttcaccacgtaagccggacctcgcactccggtcccggtctcgtcgccaagatggtgaagcccaagtacaaaggacggagcaccatcaacccgtccaaggccagcacaaacccagatcgagtgcagggagcaggaggccaaaacatgagggaccgggccaccatccggcgcctgaatatgtataggcaaaaggagcgcaggaacagtcgtggtaaaataattaaacccctgcaatatcaatcaacggtggcttctggcacagtggcaagagtagagccaaatattaaatggtttggaaacacacgtgtgcatctcaagccagtccatccatcaccaaccaatttccaagcagcgcaacatggcataccagtctcatgaaggcatcccatcacacaagcttgctccatgcaagccaacaccaacgctcaccaactgtctccttctccactcactcgacatccggcccatcactaaccttgcaaacgctgccacactccctccaactccctgaccacctctccccgcacaaccttaccaattcttggaccccctacaccctccacaccacccacatactcaccccaacaccctccatcattcgcacacactgcatccttaccagctcctccttactcgcaacacactagctcgaacactgctccaacctgacccaaccctatcaccccagcgcccaccgcgacccgccgaacaccggcctaccctgccaccacacccctgcgccgctgaacgccccctcgccaccccccaccgcaccgagcaccccccccaccaccaacgggacccacatctccacccaacaaccttcttgcccccttacaaccctcacaccacacccgccctacctacccacctcccccctcaaccaacccgcaccacacctcccacaaccaccctccaacaccccatccaacacttcccacattgcgcctcacccccataccacccaatccaccccctccccccacccctaccccctaccataaacccacacaccaccccatc

SEQ ID NO: 668118 - DNA, 364 bp, Homo sapiens
gagcgggacgggtgctcccctcctttcctcccgccacaagcgctcgctgtggttctggcagcgaagtgccgagactgggctcggcaggcggaagtggttggagactgcgctgtattcctagaaagtcctcgaacttcgtcgcgggagagagaggggagtgcatccaattgtgcacggcggaccaagcgacaagtgcggtactggacaagacccaaaccatacttggattcgtgagcctcaggcactcaatacacataaacaagctggaacataagcacgactcactgtcacgcagtgacatggcaaaagaaaaccccaaggtcaacatctcccaagaacgcagtaatgtaacaacaatcagaac

SEQ ID NO: 668119 - DNA, 399 bp, Homo sapiens
agggttagtgcttgtccaggtctccagcctggaatggcagaatccgaatgagaaaccaggtctcttgattggcaggtcacgttcatgtcagcactgagctgaagcgtgaagccgactagagtagaaactgtgttttcagagtcacttgctgtaaccaggggtaaagaaaagctgcgatatgggcccttggcttgttctgtccaggatctggtcacaggcagtattcagtattctgcataactcttaaggaattgccattgggcaggtgggttttagtcatggatgacgtggcagggacggtgtctcctgtcatctgcctggtggccgtcagggtgagagctggggggtctgccatcagcggccgagggaatctcctgcctctggggaagcattggatca

SEQ ID NO: 668120 - DNA, 315 bp, Homo sapiens
caccaggccacctgggccagccccttgtcctctgccttctgctggcagaggagcagctggactggggcctttggcacagcagccggtgtctcctgcgcccgcctcccccatggccccatgcagccccaggggcttcctccctgcccatggagtagagcccgaaatcctgggcactatgccaggtttggacctcgatccccctaccccgagcccatgcaggcagggaacatgctgccttctttccatcctatgtgcctttgatacaggtgggcgtaccctactaatcctcggttgggctaggtggtcctgtccatg

SEQ ID NO: 668121 - DNA, 345 bp, Homo sapiens
acatttcatattcttttattctttcttgtttacattcataataaaagtcagtgttagcatccggcaatgtttttgtaattttttgaataaagtcacatttgtaagaggtctcctctacaaactgcaccatataacacaccaaaggttgaattaaaacacacacatgggcccaactgtttgacttcaatctttccactggtttggcatttaactttgcatttttaaaacctgaaaccttcctaagccaacctatttttggaatcaccaggccattttaaatttgggttacttccacttattttaaaatggtttcttccggtggattttaactttcctttggtccaa

SEQ ID NO: 668122 - DNA, 242 bp, Homo sapiens
tttgttgaatgaataagggccccccagtgaatttcctttgcctggacaaacaaatatggacaacccttgctttttttatttaacaggacccttttatcatttaacatttggggggtatgggaccccatccgataaccatcggatgtactattatttaacccccccgctattaaaaaacattcatgctgtttatattttttggttataataaacattgttgcaggggggatcattgaacccca

SEQ ID NO: 668123 - DNA, 474 bp, Homo sapiens
tagcccactgtgtcatctcttagggcctccaggactatatcaggatgcagaggcattaggacccacatggctcgcagggcctcatttcaaggccctaggagaacgctccacacagttattccccagccactcctgaagcctcacatccatttctcagggcataagaaatgtcactgaaaagttaaagatggatattagatgtcaaatcccttgaagagaaaaaacatttagattacttcacattactaggtatgaatgaccagcgtagtatacttccctggaagtaaatgtggacagatgagaaaaggcccaggaacaggaattctctggttgcataaaagagggtaaaaacccatgaaaagggaagggacactgccagactgcctggcctacaccatatgatggagcattcagttctcacctgaaggacccagtggtgtgtgtaggtatgtgtgtggatgcatgtgtgtttcc

SEQ ID NO: 668124 - DNA, 1365 bp, Homo sapiens
  misc_feature (174)..(174): n is a, c, g, or t
tgggacaggaagtaaaatttatgggggagtattaagaggggggcagcacattgtggaagccctcagtgaggtgcacctctgtgtgtgttattcactctacgtggagaaatccgtgccataggtggtgtttggggagtggtgtccatagcattttacaagaaaaagtgaaaagcngtccttcttaatattgggcaccccggaatatgtgttggctggtggcgctcaagctcaacatattatcccagagggcccctcggttccctggaggccggtgttggccccgggagccccgggagccccttcggcgagttcaaacccttgtggcttggtgtttcccgcgacaacccgcgggtagaaacggcaaggcctcttggggcgccatagtatgcgcaagaacgcagagaaagaggggaggggagaaactctggcgctcctgggggtcaccctggtgacagacaacagggttactacatacggagaagaccagcatgtggacatcttcttcttctccgacagtgcgctccagagggtctttgtgtgtgtgtcacacgtgtgtcttgcgctggggcgcttgtgtgaggctccctatatttgtggcgctgcgggactacaagagaaatgtcccgactgagtgatttgcgggtagcggagcttcagtgggagcatcatatcaacgagagacctcgagcgggaagtgtgttgacaccgggagaaatgagtgtgcgcgagtgacacccagcgctcttaacaagcgcgggaggacaaagcaggaaggcctcccgggggggggggggccccctcgggggggggggctctccaggggtcccacaattttgggcgagtccggtggaacacaaggtgtaacgccgcacagaacccgggtatcgcgggaaaggcggtgggaatgaacaccatagggtgagggcactatcgagggggagaaaaacatttgcgaagggagggcaacccgggggtaggtggcttacaaaatccaagagaccccaaaaagcagagtgtgcaaagggggggtccacccggccaagggggaggaaaagccccttacagggggcgagtgggtgcaacaacacaggcggcaacaccggggagaaaggggagagtgtgttgaaagaaccccccctgaggaaaacacgggcctgtacaaaaaaggggcgggtggtcccttacaaaaggggagcaaaaaaaagggcgggtacaccagacagggggggggagaagttggagcgcgcacacaaaaaaacagaggggaccacacgcggaagaacaaaaaacacgcacgacaggccggagagaagcccccacggcggaagtagagcccaccgggagacaaaaccgtaggtgaaacat

SEQ ID NO: 668125 - DNA, 252 bp, Homo sapiens
acgtcgagctcggcccgaatcctaattacgcagcagaatgaataagccaggtggaggacagattagtggaaattatggatgcgaaaaaaaaaagagaaaaaagattgaaaagaaatgaagagagtcacagagaactcttgacaacattaaatgcaccaacatatgtattataggtgagccagaaggagaagagagagagagacggagacagaaaaaatatttgaagagataatagccaaaaacttccctaac

SEQ ID NO: 668126 - DNA, 146 bp, Homo sapiens
ccggcaacaggacgacgtgctcaacgcccaacgcaccaaaatcgccaaccttgcggcctcggcctttgctggcgccacctcttacatagcgtccccctacgtgggtgcccctgtcggcgccggagtgcgcatgtatgtgaatgaca

SEQ ID NO: 668127 - DNA, 318 bp, Homo sapiens
  misc_feature (52)..(52): n is a, c, g, or t
  misc_feature (101)..(101): n is a, c, g, or t
ttgactttgtgtttcctgccctgaggaaaaaggggtcagattgcagggggcngagggccctttcggtcccctttcctcccacccggggcaaagggccagcntatttttccctccatccagggccacccccccagccattttggcccattatataaatatatatataaatataaatatataaatccaaaatgtgaagacatttttttggtttttattttgaaacaatttttaggcttgttccgggggtttttgtgcggcctgtactgtattgccctgttttaaaggggcctttttattacaaagaaaattcaaaatcca

SEQ ID NO: 668128 - DNA, 713 bp, Homo sapiens
gaagtggcgctgcttgggcccttgggcggattgtaagactgcgtggttttgcggctgggaagagcggcgagagggttcggcatttttcgtcgggatccccgcgaaggatgagtgcgtgccataatgatgtcgtctacccggcatggtggatgaagcgttcatgaccttgccctcgagactgacgaatcctggtgatcgtcaggcaatttgtggcagcgcaagccgagcaccttggggttccatgaaacgagtagcaacacacgaaagagttctttgaagcacctctatggggttgcccgtgacaagtacacagaaacaattaccttggtccgctccttgtcttaatcaacgcggagaatccaccaaatcaaaccacttcttccactttcacgcaacccgcggcgcaacgacacgacccacgaccacatctcaaactcgacaccgaaacctccggacggtcctcccaaatacatccaggccaacaggtcattggaccagtcaaaatttattccaggcacagctatatcccgggccgaccaatcttgtgcgcactttggccttcccacgtcggcacggtcaagaaaagcaccccattgacaatggcgcaccaacggtgccattcgttcggctgggcaacgatcgcactcgcatcgcaatcgcaccggcaattgcatcgcaatttccaccctatgcactcccttgccaagagtcca

SEQ ID NO: 668129 - DNA, 325 bp, Homo sapiens
caattagcgcagtgtgcatcaaaggtcagtcttcatctcgatcatacataggtggggccctatatttagctaccaacccccatatatgctccttaacttataccccattgtccctgtctcccagacccacaggcaggcagcctaattgctccttctgcaaccacgactgactggacctgggacaagaggcactgaggctggggaccagagaccagggagcctgaggaatgagctagtagacagggtggtggcggaaactcctacctccgaaacgcctccactgcaagtgtgctgtacctccagggacgctggacgggggccgcgc

SEQ ID NO: 668130 - DNA, 263 bp, Homo sapiens
ccgggtctcgcttcttccgggccgcttgtaataaaccctgatatgtaaactgtcaggaaaattaatagttcatttatttgttattttatttgtaagaaaatagtgatgacagccctttttcatactgatacctggttgtatattatttgatcctcagttttctcaaatgatatttcaaattgcattagaaattaaaatcatctatctgagtagttaaaatacaagtaaaggagagaaaataaacaatatttgaaaaaaaaaaa

SEQ ID NO: 668131 - DNA, 443 bp, Homo sapiens
  misc_feature (285)..(285): n is a, c, g, or t
  misc_feature (379)..(379): n is a, c, g, or t
tcgcctctcatttgttcttgtctcttctgagggcgccacggtgctgtgatgagtgtcagctgtgagagcgcgcagcgtgtgtgtctgtcgtgtctgtctcgtctcgtcccaacactctgtgtgttgtgtccctctcacacgcccacacagtctgtctatgaaggcgacacactggtgaacgaccccgcttgagagagcactcgtctcgtgtgtgtctctgctcggggcggcacaggctgtctctctctgtgccacccacacgcccacagggagacgctctcctcnaccacagctctgtcctccgcacagcccccgagcctctctccacggttagaaccctgggcccctggagacttaaggggattcttccccgaccccncgccccccccctgctccttccctaatagctttgaggttttcttggttggaagctgccactggcc

SEQ ID NO: 668132 - DNA, 516 bp, Homo sapiens
  misc_feature (23)..(23): n is a, c, g, or t
  misc_feature (32)..(33): n is a, c, g, or t
aatccccggccagaaccacaccnaactggtanntgtgagcatccaattatcggaatttcaagacaatcacacaattaacccccctcataattacactaatgagaaagatggagacaacataaaaggaaacagctggcaaggaggaaagttgtagatgcgtgaacgtcaaatttaaaatacactcacatgttacttattttcatatgttctctgtattttcaacattaaaattaactgtaaagaatagcaaaatgttagtaatttttgaagcttgtggtgggcacatgaaagttaattactttgtactctatttgggtatgtaagttcttcagaatacaaaataaaaaaaaaaaaaaaaaaaccagataatttttagtcactgatgggtaaatgaggctagcagtgtcttttaactataatttaaaatttcccttgatgagatggagtcaagggtttaacatacgggtatcctgatttaaattttcccagtgactatgttcctgatatctaagtcaa

SEQ ID NO: 668133 - DNA, 410 bp, Homo sapiens
  misc_feature (23)..(23): n is a, c, g, or t
  misc_feature (32)..(33): n is a, c, g, or t
aatccccggccagaaccacaccnaactggtanntgtgagcatccaattatcggaatttcaagacaatcacacaattaacccccctcataattacactaatgagaaagatggagacaacataaaaggaaacagctggcaaggaggaaagttgtagatgcgtgaacgtcaaatttaaaatacactcacatgttacttattttcatatgttctctgtattttcaacattaaaattaactgtaaagaatagcaaaatgttagtaatttttgaagcttgtggtgggcacatgaaagttaattactttgtactctatttgggtatgtaagttcttcagaatacaaaataaaaaaagtcacaggaaatttacaaacatctacattatcaatagaaagataagaggccagtggggcgc

SEQ ID NO: 668134 - DNA, 391 bp, Homo sapiens
tgtttaatacgaatgcactgtatgtgtataagcatatattactgtactgtttaatacgaatgcactgtatgtgtataaggatttattactctactgtttaatacgaatgcactgtatgtgtataaggatatattactctactgtttaatacgaatgcactgtatgtgtataaggatatattactctactgtttaatacgaatgcactgtatgtgtataaggatatattactctactgttaagtactgcaaatatctgggggattaatttaaaactggaagaataggactgacctgatccagtctgtctggttgtgatactgatggtacccactccagtaccaggtgaaggcgacctgacttcacatcattcagagtgtaccacgtcgacgc

SEQ ID NO: 668135 - DNA, 497 bp, Homo sapiens
  misc_feature (40)..(40): n is a, c, g, or t
  misc_feature (70)..(70): n is a, c, g, or t
  misc_feature (129)..(129): n is a, c, g, or t
  misc_feature (156)..(156): n is a, c, g, or t
  misc_feature (161)..(161): n is a, c, g, or t
  misc_feature (396)..(396): n is a, c, g, or t
  misc_feature (398)..(399): n is a, c, g, or t
  misc_feature (410)..(412): n is a, c, g, or t
  misc_feature (420)..(421): n is a, c, g, or t
  misc_feature (427)..(427): n is a, c, g, or t
  misc_feature (429)..(429): n is a, c, g, or t
  misc_feature (495)..(495): n is a, c, g, or t
aaaaaactggtgaaaagaattttttttgaatttgaaatantgggtttggtgatttgaggatatgttcgtngtggaaggtagtttgggctctggttggtcgtggcttgggaagcactgctggaggcaggncaaaaaaaagtggcagctcccaaaaangggcngaaaaagagatggaaggtgagtgcttcaagcaggcaaacccaggaataaaatagctttggaatttatttaaatgtataaattcaaggagcataggcctggaagaagcccaggccccaagaagttgtgactgtcccctgggcttcctagggcaacaggcattgaagaatgtaatggtggaagggagtggctgggggagagggcggtgaagagggtggctatagggagtttagggtnannacccacccccnnncctatatnnccacantncgcaggctcattggaggatcttccctccggccacctctcctgcacctccagaccactgtcccgatnat

SEQ ID NO: 668136 - DNA, 971 bp, Homo sapiens
  misc_feature (955)..(955): n is a, c, g, or t
gactctgatgagggctcagacttgataactgtcccgtggattgacccatccctataggacgctggtgagattgcagtcttggtgcatcccctccatacagccgcagctatgggatttacccaccgcagaatctttagtgtaaatgagatcatgattctggataggaggggggtgtaatgcataatctcattcctcgggtaatcgacgttccttcaccagaccgtccagccgtgtagcagcacaggtatctccacgtgcgaagttagccagatggtgtcttaatgaaggccagtgggagtgaaactcgatctctcagtactagaccaggtaccaggtgtgggtagtagggtccaagaaccttacctggacatcgcgaaggctaggctgggatggtcacattgtatccctcttccatagagtttcgaaaatctaagcggaagagcacctctgcagctctgacgtgtgcatgagtcagcccggcggaggggaacgacggggcagtcctctggagcaaatttgcgtcatccgaatgtggaccgggccagtgccagtagtagagctgttccagagttgacacaccataatggcaatgtgtccaagactgaacaaacttgaagctaacataatggaaacctgtaagaaggggccctactcctatgagggcaattaatggacgctattggagatcgatggcaggcgaaaagtactgcaggtcgattcgcataaacgagcggactatccgtgaggcctgttatgcagtgtaaacccccaacagtgcaatccataggaccagagggctgtttggttaccggaactcttgtaccaatagaccgtcaaaggacacatggggtcggcgaaaagaggcattgaaacaaccggtctcacccacggcactcaacagcgggtgggtatggtcaacaacaccggcagcgagttatttccactctccttgccntctagccacagacgat

SEQ ID NO: 668137 - DNA, 162 bp, Homo sapiens
ttatgtggaaagcgacgttaaatggatgggatcccgaatgatatgtgtcgatataatgaagaaaattatggtgttgtgtctatgtatgagtagcgagtttatcttcggttagtacaggtgacgttagaaagagataactcagaagaattttaaaacgggaag

SEQ ID NO: 668138 - DNA, 112 bp, Homo sapiens
ttattcagatcactgtcttgcctccaggctccgtgtgtgactcgtgcagccttcgagtagtgatgctgtaggttatgcggcttttgccctcggctcgtatctcgatctcttt

SEQ ID NO: 668139 - DNA, 204 bp, Homo sapiens
ccgcacgtgctccgtggtacttaaagccctgggggccccgctcggactccgggtctccctaggatatgccccagtagcatttgctgtgtagtctgggtgtaaaatttggccattcgccttttctcaacaattcttgaagggtccagtaattggggattgtggtctttctaacttctaataaactcactccggctgaaaaaaaaa

SEQ ID NO: 668140 - DNA, 730 bp, Homo sapiens
agcggagttcccatagtaactgacaccgcgctcccacttcccagacctggaggacagcaccggccctcgtattaggaacctggaagagagggcgcccaggtgggccactcgcaacttctcacgtatctgcgcgttctctttgctcccactggcgtgagcctgcgctttccgccttccttccatcacaaagccccgcttgagcaaccagtcgaccgattgagaccggacgggagacgccacccacgcgattcgcacacacgaccgcgaccatcatccgcgacgatagcattggaccgagagcgacggccgaaacgggaccacggccctatggatcagccagacagaccgagacgctgcgactgtcctggaaaccctagagcggcgggagcacccggggacgcactcgccggcacggacagcagcgggacgacagatgccgtcaaacacgccaacgaacccagaccactatatcgggcactgagaggtgcacgacggcacgctgacacaaatcgtcatcccgagacctgccaggccgcgagcaacgaccgcggccccaaggcactcagacacaagaagtcaagatgacaatggcgatccgcgaccagccagccggcaaccgcacgctgccaaacgcaggacgcagcgcaccacaaacgatgggacagaacagcggccggacagcgccggacgaaaaacgcgagcactgacacccaaacccacggacagacaa

SEQ ID NO: 668141 - DNA, 366 bp, Homo sapiens
ggggacaaatgtggactggggcatgaggccttccctggtccccactgaacccagcttagattccacattagggtgcatctgaaattatgccgactccagagttctcctcctttattgcccttgcgctcttgacacatctatacccctggatcatctgaatggagcagccaatttcagtcccacattgctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccaggga

SEQ ID NO: 668142 - DNA, 469 bp, Homo sapiens
  misc_feature (165)..(165): n is a, c, g, or t
tgagagccccaaggtacagacacgcttccggttatcgaaataaccatggtaagggaactcttatctcagtcatgcataaatatgcagtgatatggccgaagaccccagagcagatgcagagagcccttttgtgaatggattggattatttaataaccttcccctnctgtggaggaaggattgtaaaaaaaaatgcccttgagacagttttttagccttttaaatggtggttccttctagtgggctttggaagaggggagaagccttcccttctttgataatgttaaatttgtaaggttcaggggacatgtgaaaccctttttaagatttttctcaaagttttgaaaagctattagcccgggtcctggggtaataagacataacgtttttcccttaaaaaaatttaagggggggggtaaagttaaaaaactgttggccctttatgatttaataaaataatttttaaggga

SEQ ID NO: 668143 - DNA, 789 bp, Homo sapiens
  misc_feature (705)..(705): n is a, c, g, or t
ttgtcttcaagacatcaatgatgaagaacctcgttgttgtgaccatcggtatctcagtccctgcgcatcgctgaatttcacgtcagcctacagaggttgacttctacattcgataatggacatgatccacatcgcggtgcgcctaacgggtcgtccagcgtcgtttatggcggagtttctttcagtccgatcagagtccagcaacagttgtgacggacgcattaactctgaacccctgaatgaagactgggacagtagcaccttgatgcatagttcacacagcagttcaggaaccttgttttcgactgtattatacgcgcgcggacacgttgtttcttggcgtacctgtgtacaaccgttttatccctacgcattcatgccatcaggccttgtcagactcaagttataaccaacgtttaatggtgacccgagagcgtggttttcaatgttggactctcgagcttatagagggcagtcctttttggggacgtgcccccggaggatttaccgccatactgacctagagacaaatacatatatatccccccccggtgggtggctcctctatatcctctttcgcgggggaggggggtcaatacaagaccggtgtagtgagagatcccgtgtggcgcctttgtgtctcccatatggcggttatctttgcccgggtcactcgggcgggtgttcccgtctgtgtgtgtcccncctacaggtgttccgtgagcgctctcgtccggcgggggtgctcccccccctgctatattggggggagctggcccggaattctcc

SEQ ID NO: 668144 - DNA, 1808 bp, Homo sapiens
  misc_feature (259)..(259): n is a, c, g, or t
  misc_feature (389)..(389): n is a, c, g, or t
  misc_feature (1549)..(1549): n is a, c, g, or t
gccatatggcttttgtgtggtcgcccgccctgctgtcgtttggggggcgacccctcctcgtgggggggggagggatcactgccatgctcggcgtcgcgcccctatatagtgagggtggagggggcgctcgcttccccccccgcggtggtttgggccgcccaccttcttctggggagaacggcgcctttggttgtggtgtggaagacatgtttggttatagtgagggcgggacactctctcttctctcccggcggcgatnaggttgtctccgtctgcacgttgtcggttcgccgcgcggtgtgtgttgcctctccggcggggcggtgctctcacttggtccaccaacaaggtgcgtgttgttgtggtggccccaccagcgcggggtgccnctactataaggcggggcactatcgaatacgactcgattgccgcgcccacaaggacggtgttggtggttgggggcgtgggcgtgcccaccgcaaacggtttcggttgtgtgggtgcaccaaactctgctgggggaagggcgtgctttgtcctcctgctggggcctctctgtaaggcatggtgtctccgctcttgggtgtgcgaggatagtgtcctgacgacacgttgggcggccgctagtttgtgttcttccccgccgccgctgcaccagctggtgtggggtcccccgcacctagttgggggtgtctcctactcgggcgccaccggcgttggggccttctcacggggtgaacccctccccctcgtgggtagggaggtttggaccccgcccccggcactctcgctgcgcgccccccagaggattgttggcgcgcacagaatggtgttggggagagccccccacgaggttttttttctccccccactagagtggggcccccctttttggaaagaagtagagagatgtttgtgtagagacagactgcccaacagagggttgcccacaatttgtggggaccgcctgtgatctgcgcacccgagagtgtgtcccccccggtccccatctccactgggatggcgccccgaggagacgtgtcccaagcgtgacgcgcgcgcgcggcgcgcggcgcagagataggggtgtttacacgtgctcggggtgagcccccactgttgagatttctcgcccacccccctcggggtggactatttgttcgggagcattatgtgtgagagtgtgtggagagcgcgctttttaagtagaagccctcggagttctttctcttctgctcacgcggcgctttgggtgggcgctctctatagcccgtgttgtatatatctccccccccccgcccgtgtgtgtgtttttgtataagcggcaccgcgcgcgcgagtcataacacctcgagggggtcacgaggaggtgttttatggacctccgcgcgcggtgagcccacacacacgtgtgaggagaaaccgctctggtgtgttgtgtacggttagagaagatatccacaaatatgtattgcccacgcgacacatgtggtgggcacacacacgccgcgtatatatgtgtctccacgcccacatcaagaggagagcntgtgagcctcagcgagaatctcacttgtgacacccgggaggccagcaagagggtcccaggtggagactgtgagagatctcacaggtctcattgccacagtcccatccgtggagcccacctagagagcccaaactctccttttctccaaaaataaaaaagaaagaaggtggatctcccccccggcccgagaagattttccccgaaggttttgaactctaagaaattaattggtttggtaattaacaaaaaaaaaaataaa

SEQ ID NO: 668145 - DNA, 817 bp, Homo sapiens
ttgagagcaacctgtctgaccaaaatttattaggtgggaatttcctcgtcctaataagcctgggagcgctatgggagactggggcttatttcatccctacagtctcgaccatagaagacagctacacccaagggggccattttagaggcccaccctcaggggcacattctctttctcagggatgttccttgctgagaaaaagaattcggcgatatttctcccatttgcttttgaaagaagagaaatatggctctgttccgcctggctcaccggcggtcagagtttaaggttatctctcttattccctgaacattgctgttatcctgttcttttttcaaggtgcctagatttcatattgtttaaacacacatgctctacaatttctgcacttaacacaattatcacagggtcctgaggcgacatacgtcctcctcggcttacgagatgacaggattaagagattaaaacaggcataggaaatcacaagggtattgattggggaagtgataagtgtccatgaaatcttcacaatttatgtttagagattgcagtaaagacaggcataagaaattataaaagtcattaatttggggaactaataatgtgccatgaaatcttcacgatccacgtcttccgcatggttcagcagtccctcgttgggtcctgatttcgaaagaattgagtggtcaaataaaagattggtggaaggttagttcagaagaaaagggttggaacctttcattttattgtgagggggtatccacaggttttaaacagcataggaaatggttaagggggggcataatttggaaagggg

SEQ ID NO: 668146 - DNA, 850 bp, Homo sapiens
  misc_feature (39)..(39): n is a, c, g, or t
gctgcttcctgttactgaggccagggagttaaccagcanggacctcgccgtctgttgagcggctctgcctctgtggtgggcgtgctaagccctgtgtccccttaggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggtgcctgtccctgcggccctcagagcggccgtcgctggatcagattgcggcccatccctggatgctgggggctgacgggggcgccccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttttcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagcctgcctggtccatgggatcctctagat

SEQ ID NO: 668147 - DNA, 343 bp, Homo sapiens
gaaacctcaggctggggcagggtggcacttgggggggcaggccaagttcccctaaatgggggtctctatatgttcaggcccaggggcccccatttacaggaagtgggaagctttgccccccgagcttcagtcccccccaaaggaaaggaggtaacgaggagggcggactccaggccccggacaaaaatttggacttggctggcttgcaggggtcctaaaaaactcccctttggacagcgccaggaggccctgggttcccttcctaactttgcccccaactgtacatttggataaaccctagtagttccctgggcctgtttttttataaaaccaggcaactgga

SEQ ID NO: 668148 - DNA, 103 bp, Homo sapiens
gtttcttttgctttttaatcagttcttaataggatatagttttatgttttccaagttataactggagaacataaaactatatcctattaagaactgattaaaa

SEQ ID NO: 668149 - DNA, 1260 bp, Homo sapiens
  misc_feature (9)..(10): n is a, c, g, or t
  misc_feature (1195)..(1195): n is a, c, g, or t
  misc_feature (1218)..(1218): n is a, c, g, or t
  misc_feature (1223)..(1224): n is a, c, g, or t
gagcgtgannggggagagcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccaggtacgcgcggggccggcggggccggggccggggccagggcggggaccgggggcgccccgggccgcaccaaccccgcccgcgcctccctgcagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggtgagcgcgggcgcggggcagggaacgttccggggnccttgccggcgggttaacgcctncaggnncggcacatggaggggctgatgactgttgggcggccg

SEQ ID NO: 668150 - DNA, 209 bp, Homo sapiens
ctagaggatccccccttaacggtgctgacagaaatagttgcagtatggtcgtactttaaactctagtatcctattgcttctttcttacccccttacctaggtgaatactcccacagtggtctgtatactcaactattttctatttcaaagggaaaaagatatatatagtatatgttacttattaattagatcagtgtctagtaatatgt

SEQ ID NO: 668151 - DNA, 225 bp, Homo sapiens
tgggctaaaaatgagggtttctgttgaggcagcaggcccagaaaggtggggtaaggccaagctagtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacata

SEQ ID NO: 668152 - DNA, 2377 bp, Homo sapiens
  misc_feature (9)..(10): n is a, c, g, or t
gagcgtgannggggagagcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggtgcctgtccctgcggccctcagagcggccgtcgctggatcagattgcggcccatccctggatgctgggggctgacgggggcgccccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttttcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgcctctcccaagccccaggggacagtggggaggcaggggagggggtggctgtggtccagggaccccaggccctgattcctgtgcctggcgtctgtcctggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacata

SEQ ID NO: 668153 - DNA, 2741 bp, Homo sapiens
  misc_feature (9)..(10): n is a, c, g, or t
gagcgtgannggggagagcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggtgcctgtccctgcggccctcagagcggccgtcgctggatcagattgcggcccatccctggatgctgggggctgacgggggcgccccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttttcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgcctctcccaagccccaggggacagtggggaggcaggggagggggtggctgtggtccagggaccccaggccctgattcctgtgcctggcgtctgtcctggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacatagtggaaaaaatatcattatctttctctatttatctccttcaatccgcatcttttattaactctctctattcttatatctttctatctttttctcccctctcttctctgtatctcacaacaaaatttttgtgccccttctcgcccctactccttattattcttgtctatcttttttctcgcgccgcacatctcggtccctttgggtcaatcttccctcatagggggtgtgataaaatacgggcctcgctattaacaactttctccctcgggcccctctgtctttcctctacattacactcctctgcataatctcctttctttcctcctctgcgtaccatctaacacgccccctctccctcttttc

SEQ ID NO: 668154 - DNA, 883 bp, Homo sapiens
atggccgtcatggcgccccgaaccctcgtctgctactctcgtggggctctggccctgacccagacctgggcgggctctcactccatgaggtatttcttcacatccgtgtccggcccggccgcggggagccccgcttcatcgcagtgggctacgtggacgacacgcagttcgtgcggttcgacagcggacgccgcgagccatgaggatggagccgctgtggcgccgtgtggatatagcaggagggtccgggattattggcgacggtggagacacgtcaaagtgaaggcccactcacagattcaccgagtggacctggggaccctgcgcggttacgtactaaccatgagtccgagtgccgggttctcacaccgtccagaggatgtattggcttgcgaacgttgcggagtcggggacctggcgctttccttccggcgggggttaccaaaacatagtacggccctaacggaccgggcaaagggaatttacaattcggacccttgaaaagaagggaaccttgcggcttcttttggaacccggggaggtggaacaaatagggaggtccagaaccgaaccgaaaagcatcgacgtttgggcaagcgcagggccccaatgtgttgcccggagagacccaaatttgggaaagaaagcctatagccctgtgggaaagggggcacacgtgtttgcggtttgcaatgtgtggctactccctggaaatgaattaccctggtgagctaaacacggggaaaaacgttcgaagcaccgctgtgcaaatgggcgcaaccggggaaaggcgcccccctaaaaaataggcgcaattagtagatcttcaagccaaaggccgttggttcctcggttgacccaagttgaaagcccgaccccttga

SEQ ID NO: 668155 - DNA, 2095 bp, Homo sapiens
gtacaggcgctgcggcgtttgtcccgcgacgggaccgttccggcgtctttaaggtcgcccgggtccctccgcctgcaccatgcctcggggaagccgtagcgctggctccgcggccagccagcctgccgggccgtgcggttctggggctccggggaggccgtcgcccgcgatgctgctctccaagttcggctccctggcgcacctctgcgggcccggcggcgtggaccacctcccggtgaagatcctgcagccagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggtgcctgtccctgcggccctcagagcggccgtcgctggatcagattgcggcccatccctggatgctgggggctgacgggggcgccccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttttcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgcctctcccaagccccaggggacagtggggaggcaggggagggggtggctgtggtccagggaccccaggccctgattcctgtgcctggcgtctgtcctggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacata

SEQ ID NO: 668156 - DNA, 2469 bp, Homo sapiens
  misc_feature (9)..(10): n is a, c, g, or t
gagcgtgannggggagagcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccaggtacgcgcggggccggcggggccggggccggggccagggcggggaccgggggcgccccgggccgcaccaaccccgcccgcgcctccctgcagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggtgcctgtccctgcggccctcagagcggccgtcgctggatcagattgcggcccatccctggatgctgggggctgacgggggcgccccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttttcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgcctctcccaagccccaggggacagtggggaggcaggggagggggtggctgtggtccagggaccccaggccctgattcctgtgcctggcgtctgtcctggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacata

SEQ ID NO: 668157 - DNA, 521 bp, Homo sapiens
  misc_feature (23)..(23): n is a, c, g, or t
  misc_feature (34)..(34): n is a, c, g, or t
  misc_feature (48)..(48): n is a, c, g, or t
  misc_feature (82)..(82): n is a, c, g, or t
  misc_feature (86)..(86): n is a, c, g, or t
  misc_feature (139)..(139): n is a, c, g, or t
  misc_feature (183)..(183): n is a, c, g, or t
  misc_feature (201)..(201): n is a, c, g, or t
  misc_feature (214)..(214): n is a, c, g, or t
  misc_feature (234)..(234): n is a, c, g, or t
  misc_feature (269)..(269): n is a, c, g, or t
  misc_feature (301)..(301): n is a, c, g, or t
  misc_feature (355)..(355): n is a, c, g, or t
  misc_feature (434)..(434): n is a, c, g, or t
  misc_feature (492)..(492): n is a, c, g, or t
  misc_feature (514)..(514): n is a, c, g, or t
ggggggctttccctaccatcgtnaaaaaaaaccnttgggacggcaggnatggccaagcttcccggggaggatgccttgcccncggntaatgggaagcttgatgcttaggaaagatgagttgtaaaacccccaccaaggnttccagaccattttcttttcttgggagccagtggatttttccancagtgaagggacattctntacactcagatgnctctaccagtggccttttanccaagaagtagtacttgattggtcatttgaaaacnctgcaacagtgaacttttgcatctcaagaaancattgaaaaattctatgaattgttgtagccggtgaattgagtcgtattctgtcncataatattttgaagaaaacttggctgtcgaaacatttttctctctgactgctgcttgaatgttcttggaggctgtttnttatgtatgggttttttttaatgtgatcccttcatttgaatattaatggctttttccnttaaagaataaaatattttggncaatgcc

SEQ ID NO: 668158 - DNA, 2770 bp, Homo sapiens
  misc_feature (9)..(10): n is a, c, g, or t
gagcgtgannggggagagcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggtgcctgtccctgcggccctcagagcggccgtcgctggatcagattgcggcccatccctggatgctgggggctgacgggggcgccccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttttcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgcctctcccaagccccaggggacagtggggaggcaggggagggggtggctgtggtccagggaccccaggccctgattcctgtgcctggcgtctgtcctggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacataaaaaaaaaagaaaacaacaccaagaacaacaaacacgcgacaacgacgaagccaccaaaagcagggaaccgaaccgcgcaacacacgcgccaagacagccacgccgggacagcgacgacagcagacaaaaggggggcggggcagcacagagaagacgcaggaggggagacgaaagtaagggcgaggcgacgcggcgcacagcagaagggagggcaacagagagaggcggacaaccaggaaagaagagcagggcgcggagggagaaaggccagagacggggagacaacatgcgggagagagaaacgagagaaagagccccgcacgggggggggacataaggggcaaacacacacgaggagaaagcgcgagcagagagaagaccgagcaggatag

SEQ ID NO: 668159 - DNA, 183 bp, Homo sapiens
ctctctctccatggcttcacacctccaaccctgacctgtcacttcttctatttcagcctggtcttggagtccagaaatgagggcgtgagtgctggacagagattcaagttgcagctgcctcattttacaatgagaaatgaggaccaatgagggaatgactcactagtcacataggtggctgag

SEQ ID NO: 668160 - DNA, 137 bp, Homo sapiens
cctgaggatcccgaacgagacacaggtgaggagatgaaaactggagaccccaagagacctgcgctgagccagcatgcagccaatccagatagccgaggcactggcatcaccacccggcagcagcgcacacgggtctc

SEQ ID NO: 668161 - DNA, 2550 bp, Homo sapiens
  misc_feature (9)..(10): n is a, c, g, or t
gagcgtgannggggagagcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccaggtacgcgcggggccggcggggccggggccggggccagggcggggaccgggggcgccccgggccgcaccaaccccgcccgcgcctccctgcagccaaggcggacaaggagagcttcgagaaggcgtaccaggtgggcgccgtgctgggtagcggcggcttcggcacggtctacgcgggtagccgcatcgccgacgggctcccggtgagtcggaccgccgggcgggccgggtttctcgcgcgccttgcgcctcgcttggccggcctgacccccgcgtctccgcaggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggtgcctgtccctgcggccctcagagcggccgtcgctggatcagattgcggcccatccctggatgctgggggctgacgggggcgccccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttttcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgcctctcccaagccccaggggacagtggggaggcaggggagggggtggctgtggtccagggaccccaggccctgattcctgtgcctggcgtctgtcctggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacata

SEQ ID NO: 668162 - DNA, 2790 bp, Homo sapiens
  misc_feature (9)..(10): n is a, c, g, or t
gagcgtgannggggagagcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggtgcctgtccctgcggccctcagagcggccgtcgctggatcagattgcggcccatccctggatgctgggggctgacgggggcgccccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttttcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgcctctcccaagccccaggggacagtggggaggcaggggagggggtggctgtggtccagggaccccaggccctgattcctgtgcctggcgtctgtcctggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacataaaaaaaaaaaaaaaaaaaaaaaaaaaaaaaaaaaaggggagagaaagcgagaaaaaaaaaaaaaaaagaaagaggacaaaaaagaaaaaaaaaaaacgcaaaaaaaaaagagaaaaaaaaggggaggacgggggggggtattccggggggcctgataccacagcgcccgtgtctccgtgggagaaaagacggggcaccaccctttggagcgacctccgagtgtgcgtaatagagagaacaccacggaagaccggggggcgcggtgagcaaaaaaaaatgtggcgaaccaagctgagctcgccaacagaaagcaagttcagtgcaggcctctacagggggtaagaagacacaacactcttccgcagggggggagaaacgcgagactcaatagacgcagccacgaaaatacggcg

SEQ ID NO: 668163 - DNA, 420 bp, Homo sapiens
aaactgccgggaggaaggcttaggttgcttccgcttttggatactgtgaatagtgctgctatgaatgtggctgtacaaatatctccttgaggggctcctttcttttggatatacagcccgaattgaaactgctggatcatgtggtaattccatgtttacttttttgaagaatcattatattgctttccacagcagctgccccattccacattcctatcatcattgcacaagggttccaatttctccacatacctgttagcacttattgtcttgtgtagctcactgcggcctcaaagtcctgggctccagtgattctcttccttagcctctcaagtagatgggactacaggcatgcgccaccacacctgtctagtttttttttttttaactttttgaagacataggggcccaccatgctgg

SEQ ID NO: 668164 - DNA, 206 bp, Homo sapiens
acctgctcccggtggccctgaggacgttttgtccatggtgtttccgaaattaggaagcggtttggagcagtctgcaggtcttcgggtctaagtgtcgctgcggcacctcgcgtcaagaatcctgaggggagacctcaaggataaggcccaggagtaattgagtccaagaggatctagctgcaaacaaactaatcggggaaaatgcc

SEQ ID NO: 668165 - DNA, 141 bp, Homo sapiens
tggccatgtcgcgactggagccatcgcagcagtcatgcgcgctcctgatcgcttcgacttcgctgtcgcgcgcaaacgcctcacgcaacaaggcgatgacgcgctcgggttcgaagctggtgaggatatccttgcgcaggt

SEQ ID NO: 668166 - DNA, 421 bp, Homo sapiens
gtaaatattgagagatgtgctttaaatccaggtgtggcacacaatcggcttggggttagaaagcacaggactgccacatgtcactccttcagagccaaaactgtatgagagtctggagcaatgactctgcagtcttctggcttctaagagaaaacttggctacgatttcccagtctgaagagaaaaaacactcaccttcataatttcttactgagtcttctgttcggacgcctgccatattatattggctgctcacagactgagaaagcatcccttctaatctctccaacgtggcttgcccttccgctgttaaatgggatagtccttcttcataggtataaaatgtagggatgtccccttgtccttgttctaaacaaacagaacacttttaaattattttattcaacaattggaaaaaaaa

SEQ ID NO: 668167 - DNA, 500 bp, Homo sapiens
  misc_feature (250)..(250): n is a, c, g, or t
  misc_feature (264)..(264): n is a, c, g, or t
  misc_feature (351)..(351): n is a, c, g, or t
  misc_feature (393)..(394): n is a, c, g, or t
cagggatgactcactcatcatactaatgtgattcaacaaagaaaggcatgttttctcttccaaatatgctgtgtgttcaagtctgagatgctccaggattcacaaagttcccacagcaggtgctcccgttcactctgggggcacctgccacagcagctcccatttagcgcacgaagggataccacgctgggtggctacccgcaaaacgggggcggaagtagtgctgcagtcgaaagcccttgcagggccngatgaccacgtaangcggccatcccttttgatgatgaccccttcccagatcatttctatgccggtactttcttcagctttccctccgggtaccttctttcntggggctgctcggctcggcgccggcttccctccagtggctcnngtagcagctcggggcaggaggggcgaaagtgcacccctccgcgcgcccggggtccccgggccccgctcgtccgccgcgctcgtacccgctctcggccgccgacatc

SEQ ID NO: 668168 - DNA, 231 bp, Homo sapiens
  misc_feature (33)..(33): n is a, c, g, or t
  misc_feature (141)..(141): n is a, c, g, or t
  misc_feature (151)..(151): n is a, c, g, or t
  misc_feature (168)..(168): n is a, c, g, or t
tagaggacccaggcaggtcagaaagttttgagngtcaaatccaataaaagccaacatgacaatgaagagaagacattcaatgagcaggctgatgcacacagaccaggataccaggatggatgttgtgatttaaggttagangaagttctancttttaaagtgttatcnattaaagtagatagagaagattttaaagttgatagtagatatgtaatacataagaatacaaat

SEQ ID NO: 668169 - DNA, 256 bp, Homo sapiens
tgctgcgggcgactccaaggatcccgctgtgttgagttcttagacttctaatattgcaaagaaaagctgcgtttaaggatttaaactggcattttagagctcggagttcacatgggccacataagcgaattcccttccggagcgcacagaggtgacgtgtatgaattacgcttatggacttattagtttctaatgaaagataagcaggtaccactcaagggccttctaatattaaccttccctgcccggcagaaag

SEQ ID NO: 668170 - DNA, 207 bp, Homo sapiens
gggaaaaggtatgatgccgccaccacctatgggcatgatgccgccgccgccgccgcctcccagtgggcagcccccagcctctgcctctggtcctcttgccgcatggccataacagcagcaggagcctccgccaccccctccgaccagcagcagtatggcttccagtacccccttggcatggcagcaaactacgacgtctagcaccag

SEQ ID NO: 668171 - DNA, 962 bp, Homo sapiens
gctgtctgggctccctggtgccagcgctatgaggccactcctcgtcctgctgctcctgtggcctggcggctggctcgcccccactggacgacaacaagatccccatgcctctgccctggggcacccctgtgccttccatgtgcaccgcctgtgggccaccatggcagccatgtggcttgcctgggccgcagatggccttgcgacgggccgcgacgtgctgctgccctggtggctcctggtggatgatgaaatggctaagggcgggagtgcctgggactgcctggggacctcgaagtgggaccccgggcctgcgatggagatgggctgggaccctgcgtgggcccacactgtggtcctgccgggggagttgctcgagtgcctccgcgatcctgccttcagcatgccaaggccgctccgaagatgccggggtgcctccgccgtctgacgcacccttgcccttccgaccgcgtgctggtgaactgagcagggacattactgacgccgtcaccgtgcaagttcacctgccagggtgccttggggtcttactacttcgccgtccatgccaccgtctaccgggccagcctgccagtttgatctggtgaacaattggcgaactccattgcctctttcttccagttaatcggggggtggcccaagccagcctacgctctcgtgtggggggccattgttgagggctgtgcgcccttgacgaaccaaagttgtgcgatggcacgtggagtgtgggtgactacatttgcgatctatgccagcatcaagacaggacaagacttctccggatatctggtgtattcgaactgacacagtacccagcttatgttaatgccactgaagttaactcatgactcactctagagggggttaggtgccaccggtgacacgaggctgcccctggcatggcatctggggtgcgaccgcctcgcttttgactaatgccggcagca

SEQ ID NO: 668172 - DNA, 235 bp, Homo sapiens
gttcttctctccacatccctctctgtacttacagccccaaatggccccaaaagcagaggcccaaggaagggtgatgccaaggagccccaaggcagctccagcttccgaacctccccctgaggcttagcgcctaaggaggtcgagtttgaatgcttcaagataagattgagttaaaacctagacgatttaggagttaaggaggccttaatctgtgacccaaaccaaggttagatag

SEQ ID NO: 668173 - DNA, 403 bp, Homo sapiens
aaaatagtaatcttaatatgagaagaaacgtcatctctccagaagcacactacataatataattcagcagcttaagaagtacatgaagtgatgtcacaaatgacaacccacttattcctccctaacctttacttttagaaactacagagagggaagggggaggggaagacagtaaaaagtagcttaaatgcaacagaaaaattcctcatagcctcactttactctttttaaacaaatgcaaaacaaagacactcattcattgctcccgtagtggggatgcttactcatgcatatctctatccacgactatgccaaagcccaatagataggaggcgccataattttccataacaaaacaaaataaagcttacctttgtatgtggttcctgtctcttaccaggca

SEQ ID NO: 668174 - DNA, 103 bp, Homo sapiens
agcccccagccctccccacccaggttttgggcccagtgaaaaggccactggccaggcctccccgggaggggttttatgttcagcaataaaggttctatccgta

SEQ ID NO: 668175 - DNA, 280 bp, Homo sapiens
gtgccgagagggagcattgaggtgacggtgctgaagaaggccctggatgaagagacgcggtcccatgaggctcaggtccaggagatgaggcagaaacactgcacatggctggtggagtgagctcacaagagcatgcttggagcatgttcaatgatgggccaatggctgaaccgtatgacaatgaactaatgcatgactgcttgtgagaaatgatgaactgcatgactctgtgcctgtgggagcttgcgtggtctctggtgccatgtgccaatgcagtgag

SEQ ID NO: 668176 - DNA, 228 bp, Homo sapiens
aacctgggccctctttccgaaaggcacatgccagtgctataccagtcaagagtagggtgcatggcattgaataagaggaaacagccgtcacccaacatttgcttttgctctgaggaggggcagatgccaacatggaagcagtcaaaggttcctgaccttgtacatgaacagcaggctgttgcattgtaacttgtggctgtgcattaagatgttgcctttcggagaaga

SEQ ID NO: 668177 - DNA, 415 bp, Homo sapiens
ttctcatgagttattttctgccctctgccctctgccttctgcccttttgctgtgggtcagctggagagctgagcaaagggcccgactggtggcatggcagtgctctgagacaaaagagcctccatctggagcaaagctaagctggtctgcacatctgctgggtccagctgcttcctgagggtgtcacagccttggggtttctcctggctcttcactccctgataccctctgagccaacctggtgcggggggaacaaaggcacaggatcccgaccatcccaagagcatttagcttggttagggcccccaggataagctgctctcaatttgattcaggaagagcatgtgtgtgtggtttggtttggtttggttttttagagacagggtccgactctgtcgcccaggctggagtgcag

SEQ ID NO: 668178 - DNA, 206 bp, Homo sapiens
tccatcatccatgataccttcacgccaatggcgcctcaatattctttatctagactctatcctacacatcgggcgaggcctatattacgagatcattatctactactcacgaaacctgaaaacatacggcaattatcactcctgacttgacaaactatagacaaacagactatcatagagctatagatcctcccgatgaggaacaa

SEQ ID NO: 668179 - DNA, 761 bp, Homo sapiens
  misc_feature (98)..(98): n is a, c, g, or t
  misc_feature (105)..(105): n is a, c, g, or t
  misc_feature (107)..(107): n is a, c, g, or t
  misc_feature (109)..(110): n is a, c, g, or t
  misc_feature (112)..(112): n is a, c, g, or t
  misc_feature (116)..(116): n is a, c, g, or t
  misc_feature (127)..(127): n is a, c, g, or t
  misc_feature (139)..(139): n is a, c, g, or t
  misc_feature (174)..(174): n is a, c, g, or t
  misc_feature (217)..(217): n is a, c, g, or t
  misc_feature (236)..(236): n is a, c, g, or t
  misc_feature (241)..(241): n is a, c, g, or t
  misc_feature (297)..(297): n is a, c, g, or t
  misc_feature (303)..(303): n is a, c, g, or t
  misc_feature (314)..(314): n is a, c, g, or t
  misc_feature (343)..(343): n is a, c, g, or t
  misc_feature (368)..(369): n is a, c, g, or t
  misc_feature (436)..(436): n is a, c, g, or t
  misc_feature (451)..(451): n is a, c, g, or t
  misc_feature (454)..(454): n is a, c, g, or t
  misc_feature (470)..(470): n is a, c, g, or t
  misc_feature (536)..(536): n is a, c, g, or t
  misc_feature (550)..(550): n is a, c, g, or t
  misc_feature (611)..(611): n is a, c, g, or t
  misc_feature (664)..(664): n is a, c, g, or t
  misc_feature (673)..(673): n is a, c, g, or t
  misc_feature (682)..(682): n is a, c, g, or t
  misc_feature (702)..(702): n is a, c, g, or t
tggcgtgttcagaggcctgcagtccatggtcggactctctgggcatttctgtggagtccccctccctgcaggtgaccccacaggcctgaggattcctntacagantntnncncagnatcatataccngatcagctcttncaagaggactccctcccatgtgctgacttgacttncctccgggcccccctggacatccccatcccgaccctccccccnaggatgatgagatggcacngatangccggagaagaaagagtccctaagtgtggatttctccctgggaatgagaaagtccngtcccngcttgcctggntaagcccgaagtctggactctccaagagnaatgcacttctggtgattacatggnngtcccacaccctgatcccccagattgaagatggaaatgattttggggtagccatcccggagaaggtnctggagagggtgatnccntcaagacccaagtggnagctttcccagacaaccctttcccagtacttctcagaacgtggggatgctgtggcccaggcctccnaggagactcatgtnatggattaccgggccttggtgcatgagcgagatgaggcagcctatggggagctcagggccntggtgctggacctgagggccttttatctgagctttatcatatcatcagcagcnacctggagnaaattgtcnaccccaagggtgaagaaaanccatctatgtactgaacccgggactagaaggaaaataaatgatctatatgttgtgtgga

SEQ ID NO: 668180 - DNA, 115 bp, Homo sapiens
ggggttcaggggcccccccttagttgtttcctttttgggggccccccccccttttggggaatttcttcccccccccccttttccaagggttcttttaatttccttccccccggga

SEQ ID NO: 668181 - DNA, 445 bp, Homo sapiens
aggagggcgaatatggacttcgatttcatatactgtagagacttagacaagatatacgccatcgccatgagaaatggtctgagagtccttatattcaggcttgcttcattctccgtaaccacccttctctcagccactcctgctctactttccaaatcctactcaccagctcaaaacctgactcatctcccgtcaccccacccacagacccagccgatgactcctcttcctttgagcccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccggga

SEQ ID NO: 668182 - DNA, 278 bp, Homo sapiens
aatacttccaccaaaagtgtgtagagagagttctgtgtgtaccacattctcatccacacttgatattgtctcttgttttcatgtcatccaattttaatttgcctttccctgatgactactgaggctgaacatgttttcacgtattaatcggccattgggatgtcatgttttgcaagctgctctttaagtcctctgcccatttatctgttgggtgtctgcctttttcttcttgacttttacgagatgtttatatattctgggtatgcgccctttgctgg

SEQ ID NO: 668183 - DNA, 175 bp, Homo sapiens
aacatatgaatcatctattggatcataaaatatgatgcaaataccttagctgcacaagagacagagagaacagaattatggatgccaaggaagagtgaggagatgggaggaatggagtgaaaggatggttttcacttaatgcgactgtaatatactaggatgtgtacattatacc

SEQ ID NO: 668184 - DNA, 348 bp, Homo sapiens
acatcatcagtctctgcaatttctcagatacttgtagatttatggggctagcctgggggccattttaagtcacttctgaaacaactttgttaataaaaagaagaaagcgtttgggaataaaagaaacaattgagggcatttttttttaaagatcagaggggtagaagaaggtttcttatcctacatgtttgttccataaaagggatctatatttctttagtttcatctcaagaagacaacaccttaattaaactccagtgggccagtttaattaaaaaatgtcagtcagatcctcacaggagaacaagatatccatgaaacagacggtctgcttcctttgtgattact

SEQ ID NO: 668185 - DNA, 1596 bp, Homo sapiens
  misc_feature (250)..(250): n is a, c, g, or t
ctctcgtccgtagtgcggtcactgtcgttgtgttgtcagtacgccgcctccgtaaattctgcgcgtgccgccctctaattctggctgtggtcttcgctggtgatgtgtctcctcccgcgcctctgcttttttgcagagtagcggtgtcttcggcgccggcggttgctacatttgtgctcccccccgccgctttgttgcccggatgtgagtgagtggtttgtttagtaccgccccgtgttttaaagcaggnccgctttgtggggcgcgggggaccctcagggggcttttcccccgggccgccgctgttttctctggtgtgtgttcgctgggtggtgtgtcgcccgcgcccgtgtgtcccccgcttttggacctccccctcgattataagggggacaacggggtctggttactgtgccttttttttttgtgtggcgcccccggtgtgtggcgcgtgtgtgcgcgctgtccctctcccggtctttgggaggagaagccgcgacctttgtttccgttctctctctgggggggtttctgaatgtgcgccgcctgttccgtataatcgcgtctttcctcggagagtgtttcccacgacgcgcccacactggttggaggggagaccccccttggtggcctgggggcgccccctgtttctgtttcccgcttccccccggggaaacacactctggaaaggccgcgccccaacaagatggtattactctcgccacgcccgctttgcccgtttctcgcccccatatacctcgcgttaatagcccccctgtaaaaaagggggggagaatatagataaaataagataatcgcctcgaaggggccgttttgttcttcgccacaaagggcacacctgcaataaggtgtctcccctccggaagatgttgaaatatgttaaaactttttgggggaaagcgggggaaggggtcgcgcgggaaagtttaaaacccccctctctcttctcttcgccgagaacgcgcttttctcttgtggtgttcccacggagaacaactccccgcgggaaaaccccacgaacctctctacacaactttcgcgggcacactctataaattatcacccccctgagaatttgtgttgagcacacaaaagagttggtaaggcgtagataccacacatttcacactctgtcttatgagtgtttcacatagattttgtgggccacatgattctaacaatgtggtttataatttgagaccacggggcgcttcacgaacgcccagagccacaatttcggcgcctttgcacactttttgtttgaaacccgctcttctgggctttggagatcccacccacacccgccaagagaattcctataacctaacgctttgataacccaaacgaaaggaggaaacccctgggaaccccctcacaatggtcacaatttaaaataaccacagagatggtgcacataaatccctataaaggagaagaactatagtgagccctatatataattataggcctagaaccctaatccaaccccgtattacccgatccccaatttaaacctggtagaatctaaaaccttgagcctgccattataaaagtttgccctgggaaattagtatc

SEQ ID NO: 668186 - DNA, 312 bp, Homo sapiens
  misc_feature (46)..(46): n is a, c, g, or t
  misc_feature (171)..(171): n is a, c, g, or t
  misc_feature (207)..(207): n is a, c, g, or t
atcacttgaacccgggaggcagaggttgcagtgagccaagattgtntcactgcacttcagcctgggtgacagagtgagactccatctcacacacacacacaaaaaaaatttagccaggtgtggttgtgcactcgtatagtcttagttactcaggaggctgaggcaggaggntcacttgagcccaggaggtcaaggctgcagtgagtnatgattgcaccactccactccagtctgggtgtcagagcaagaccctgtctctaaaaacaaacaatcaagtgacagtccctaggagagttatttccaggcaaaact

SEQ ID NO: 668187 - DNA, 664 bp, Homo sapiens
tcggcacgaggctgagactcgaccataactagaagcagtgctgccaacctgcaggacgccattgctgatgctgagcagcgtggggagatggccctcaaggatgccaatgaacaatctggaatgggctggaggatgccctgcatcaaggccaagcaggacctggcccggctgctgaaggagtaccaggagctgatgaatgtcaagctggccctggacgtggagatctgccacctacctgcaagctgctggatgtggtgaggagtgcatggctgaatggcgaaggcgttggacaagtcaacatctctgtgtgtgcagtccacctgtctccatgtggctatggctgtgtgccacgtggtgtcggccgctggcttaggcctggcgtgtgaggaagcagctactcctatgtgcagtggtcttggcgttggacggtgtggcttcatgttccacgcagatggcagacgccattgcgcggtggcctcagctctgttggaggcggcagttccaaccatcaagtacaccagcagctcctcctccagcaaggaagagctataagcactaaagtgcgtctgctagctctacggtccaacagtcctcaaggccctctctggctgcaagagccctactcctcaggttgactttcctctccatgagctcaagtctccca

SEQ ID NO: 668188 - DNA, 772 bp, Homo sapiens
tgcctcatcggctccttgctcgccggagccgcctccgtcgcgcgcctcctccgccgccgcggactccgggcgagctttatcgccagagtacctgaagtctcgcgttgctttttgaatacccctgcgatcggatcaccggcgtgccccaccatgtcagacgcagccgtaaacaccagctccgaaatcaccaccaaggacttaaaggagaagacggaagttgtggaagaggcttagaagaagtggtagagacgccccgtgctaacgggaatgctactgaggaaaatggggagcaggaggctgacaatgaggtagacgaagaagaggaacggaaggtgtgggaggaagaggaggaggaagaagaaggtgatggtgaggaagaggcatggggatgaagatgaggaagctgagtcagctacgggctaagcggtgcaagctgtactgatgatgaggatgacgatgtgatagccaagaagcagaagaccgacgaggatgactagacagcgagaaacagataaggtctcgaaggtgaaatgctgggggggcattagttcgcttcgagtggtccgcgccaaaaacccgcgtgtctatgctagatgggcgctgtggcgtgaaggggcgtttgtgcagtacgcatgtattctgtgagcgaaggtggcgaaatgagaggggagccccctgtgggggggagaagcatctgggggcctagcctgcggaacccgggtagaagcgcaccaagggagccaaccccggttcagggggccagggggcaaag

SEQ ID NO: 668189 - DNA, 373 bp, Homo sapiens
ctgaggcttcgttcccacggcttcactgctgctgcggaacggggaacacatctcgactgcagcccctgcctgtggccacggcaccctcggagcgccagcgccctggccccaccctgggatgcatgcgagcctaccagtgcgcgctccccattgagcccctgccatggctcctggccctggctccagcgcctccacgtctctccagcatggacgaggagcagcctggagctcggctcttgctagaacctacctgtgtcggcagcctgcaggtaaggctggagctgtgccttgtggcgtcctgggccgttggattccggtcttgagctagggcattgaaccctgctgccaagcatgacacgggtggaaccttgac

SEQ ID NO: 668190 - DNA, 250 bp, Homo sapiens
taactgtctggagaaccacgtactgaaaatggggtggtgaatccacgtgttgaacgttaccctctcagagctccaagatatggcagctaggcaacagcagtgagattgaaaatcagcagcagatgttggtagccacggaacagcgttcacattcagctaatagcaacgaggagcgccgtcagccagcagtctatttctagaacaatgaaacagctgtcagcaagtggaaacgaacgagttggaggcccag

SEQ ID NO: 668191 - DNA, 639 bp, Homo sapiens
  misc_feature (248)..(248): n is a, c, g, or t
ccagcatggcacatgtatacatatgtaagtaacctgcacaatgtgcacatgtaccctaaagcttaaagtataataaaaaataaataaataaataaataagaaaaagaaagccaggcatggtgacatgtgcctgtggtcccagctattagggaggctgaggtgggaggatcccttgaacccaggaggttgagtctgtagtgagcagtgattacgccactgcactccagcctgggcaagaccctgtctcnaaaaaaaaaaagacttagaattggtgatccaggccgcctaatggcatcaaataatttgttatatctttaatttattgaaggatcaccacatgcttttaaatagcatggagaaatggaaagaatagggactttttactcaggtaatacccagcctgctacctaacaggttgtgttgtactaaataaaatggtacataagaagaaacactgtaaattatatagtgcgaatcaaatattgttaataaaccaatatctgtatatcctatgtcccggattaatctttaatttagatactccttctagttatctaatacacagcagagtgagaagcattaaactaagtatgcccagctttggagagcctttttttgcttatcattaatataagccca

SEQ ID NO: 668192 - DNA, 503 bp, Homo sapiens
  misc_feature (230)..(230): n is a, c, g, or t
  misc_feature (238)..(238): n is a, c, g, or t
  misc_feature (241)..(241): n is a, c, g, or t
  misc_feature (264)..(265): n is a, c, g, or t
  misc_feature (268)..(268): n is a, c, g, or t
  misc_feature (372)..(372): n is a, c, g, or t
  misc_feature (376)..(376): n is a, c, g, or t
  misc_feature (387)..(387): n is a, c, g, or t
  misc_feature (389)..(389): n is a, c, g, or t
tagaggagtcccccggcgcagagtgagtcctaagcagccaggtcaagcaatccgtatacaaccgtatcggcgagtatcggggtcatcctcgccgtagcaggagttgtatcctacactccaacgtcagtgagacccacaacaaagtagcccgtgtcgtaacggcgtaatccaagcctcaccccactactaggcctcctcctagcagcagcaggcaaatcagcccaattagntctccacnccngactcccctcagcatagaaggcnnacnccagtctcagccctactccactcaagcactatagttgtagcaggaatcttcttactcatccgcttcaccccctagcagaaaatagcccactaatccaaactctncacnctactcctagncncatacctattcccccgagcagtctcagccctactccactcaagcactatagttgtagcaggaatcttcttactcatccgcttccaccacgaccaccactgaggcgctcgttacg

SEQ ID NO: 668193 - DNA, 296 bp, Homo sapiens
  misc_feature (39)..(39): n is a, c, g, or t
  misc_feature (45)..(45): n is a, c, g, or t
  misc_feature (80)..(80): n is a, c, g, or t
  misc_feature (111)..(111): n is a, c, g, or t
  misc_feature (121)..(121): n is a, c, g, or t
  misc_feature (142)..(142): n is a, c, g, or t
ccatccctaactaagtacaaagtgatatccttgtgtggntttganttgtattacctgatggctagtgaggttgagcatcntttcatgtgcctgttggccatttctaaatcntcagacaggnacctgtttaaatcctttgccnattttaagttggattattggtctattttttttttttttttttttttaaagaagccaggtcttgctatgttgcccaggctagatgctaacttctgggctcaagcagtcctcctgcctcagcctctcaagtagctaggactgcagacacatgccac

SEQ ID NO: 668194 - DNA, 177 bp, Homo sapiens
  misc_feature (141)..(141): n is a, c, g, or t
cagaagcggagagcgtgctgctggtgcatgcgaggcaagaagatgagttctgaagcagaagatcgagcaggagctccgggtcaactgctacattgccgggccaatggcgagacggtgacgctgcccacaagccccagcatncccgtaggcatctcgctggggctgctgaagcgggag

SEQ ID NO: 668195 - DNA, 1875 bp, Homo sapiens
  misc_feature (248)..(248): n is a, c, g, or t
  misc_feature (656)..(656): n is a, c, g, or t
ccagcatggcacatgtatacatatgtaagtaacctgcacaatgtgcacatgtaccctaaagcttaaagtataataaaaaataaataaataaataaataagaaaaagaaagccaggcatggtgacatgtgcctgtggtcccagctattagggaggctgaggtgggaggatcccttgaacccaggaggttgagtctgtagtgagcagtgattacgccactgcactccagcctgggcaagaccctgtctcnaaaaaaaaaaagacttagaattggtgatccaggccgcctaatggcatcaaataatttgttatatctttaatttattgaaggatcaccacatgcttttaaatagcatggagaaatggaaagaatagggactttttactcaggtaatacccagcctgctacctaacaggttgtgttgtactaaataaaatggtacataagaagaaacactgtaaattatatagtgcgaatcaaatattgttaataaaccaatatctgtatatcctatgtcccggattaatctttaatttagatactccttctagttatctaatacacagcagagtgagaaaaatcattatggattaggttctttagtaagaaacctgagatggacttctcattagcattaactagttattgcccagcttnggagagccttcttttggcttatcatttattataagcccagaaataggtgactaatcagagataaatgtatgggttgtctgtatctagttttatgccttttttttgcctaagacgtagtcaaattaatattttaactaatacatcttagcagagtttagttaagcacaaagttaacagtgggtaggattgaatcttgaaagtaatcatgtctgtaatgtttttcatgcatgcaaaaagcacagacaaaaccactcatgccctattaataaacaaaatacagatcaaagttttcaaaagtaatcactctatttattctaaatgtctgtggctttaggaaaataccaccagctagtacttacctatttaaagatgtagaatttattatcctctaatattcttatcagttgtttccacaactttagtttactattggactttcaaaaatttaaagaattacaagtaaaattcattaaacacttgtgtgtgaatagtaatacacagtaattagtacagcatgttgcttcttcaacaaattgagttttcagggaaatcagcaagtaaatgaaatataaatttttggtaaaagtatcaaacattcatcttgcccatttttcctcttaaactttattatctaatcaaacatagttttccataagatgtaataaaatatagataaggttggaatatttgaggatccatttgtggaactgaatttaatgagacttcattggtgatacactcaatttttactgggtaattagctaataatgttggtcactgtctcacagttcaagtagctttaagatgatgtggcaaggaaaacacaaagcttttgggtaaccagcgttcttaaatgtatggtttttgaccaggtgaaccctttagaagtgatttctgttttaaaagtatgtacttaaaatacctttggctgtgatgaatgtagatcccagcagaataccaaaatcctattttttttgactgagtatttgtagatgcttaatgactgaaatgaatttggaggcactgatgaaagtgatttttttaaagttctcaggtactgttcaattatttaatgttaagtttagtatcaagatacagttgtttttaaaatgccaaaatgctgtttattatacagaatattttattacatttgcaatatctttgtatatagtgatttttttcttgataataaatggaaaaattctaaaacaaaaaaaaa

SEQ ID NO: 668196 - DNA, 203 bp, Homo sapiens
cttgaggatccccttcgtacagcgctcgtaacagcgctctaacacgctcgtaacgagcctccgtaacagcgcctctaacacgccatcgtaactgtcgtaacagcgctccgtaacagccctactccactcaagcactatagttgtagcaggaatcttcttactcatccgcttccaccacgaccaccactgaggcgctcgttacg

SEQ ID NO: 668197 - DNA, 1841 bp, Homo sapiens
  misc_feature (248)..(248): n is a, c, g, or t
  misc_feature (656)..(656): n is a, c, g, or t
ccagcatggcacatgtatacatatgtaagtaacctgcacaatgtgcacatgtaccctaaagcttaaagtataataaaaaataaataaataaataaataagaaaaagaaagccaggcatggtgacatgtgcctgtggtcccagctattagggaggctgaggtgggaggatcccttgaacccaggaggttgagtctgtagtgagcagtgattacgccactgcactccagcctgggcaagaccctgtctcnaaaaaaaaaaagacttagaattggtgatccaggccgcctaatggcatcaaataatttgttatatctttaatttattgaaggatcaccacatgcttttaaatagcatggagaaatggaaagaatagggactttttactcaggtaatacccagcctgctacctaacaggttgtgttgtactaaataaaatggtacataagaagaaacactgtaaattatatagtgcgaatcaaatattgttaataaaccaatatctgtatatcctatgtcccggattaatctttaatttagatactccttctagttatctaatacacagcagagtgagaaaaatcattatggattaggttctttagtaagaaacctgagatggacttctcattagcattaactagttattgcccagcttnggagagccttcttttggcttatcatttattataagcccagaaataggtgactaatcagagataaatgtatgggttgtctgtatctagttttatgccttttttttgcctaagacgtagtcaaattaatattttaactaatacatcttagcagagtttagttaagcacaaagttaacagtgggtaggattgaatcttgaaagtaatcatgtctgtaatgtttttcatgcatgcaaaaagcacagacaaaaccactcatgccctattaataaacaaaatacagatcaaagttttcaaaagtaatcactctatttattctaaatgtctgtggctttaggaaaataccaccagctagtacttacctatttaaagatgtagaatttattatcctctaatattcttatcagttgtttccacaactttagtttactattggactttcaaaaatttaaagaattacaagtaaaattcattaaacacttgtgtgtgaatagtaatacacagtaattagtacagcatgttgcttcttcaacaaattgagttttcagggaaatcagcaagtaaatgaaatataaatttttggtaaaagtatcaaacattcatcttgcccatttttcctcttaaactttattatctaatcaaacatagttttccataagatgtaataaaatatagataaggttggaatatttgaggatccatttgtggaactgaatttaatgagacttcattggtgatacactcaatttttactgggtaattagctaataatgttggtcactgtctcacagttcaagtagctttaagatgatgtggcaaggaaaacacaaagcttttgggtaaccagcgttcttaaatgtatggtttttgaccaggtgaaccctttagaagtgatttctgttttaaaagtatgtacttaaaatacctttggctgtgatgaatgtagatcccagcagaataccaaaatcctattttttttgactgagtatttgtagatgcttaatgactgaaatgaatttggaggcactgatgaaagtgatttttttaaagttctcaggtactgttcaattatttaatgttaagtttagtatcaagatacagttgtttttacaccccgcaaggctgttcatgattcagaatatttaatatccttcgcaacataaaaagcatatactcctttttttcctc

SEQ ID NO: 668198 - DNA, 535 bp, Homo sapiens
  misc_feature (470)..(470): n is a, c, g, or t
  misc_feature (482)..(482): n is a, c, g, or t
cgtcggccagctctcccttccccggcgccccctctctctagtctctacacccgcaagcgtgctccgcctccccgctcgctgggctctctcccctccccagctcgaccgcgcctccaagccgagtgcctccagctgtagctcgtcggccacgctctccgactgttgcgccttccctcccggccagcatccgggtctccatctcaggccgtgatgcacaccgccacgcgcgagctggagtagtagggaggttgcgccgtgatatccgaatccgccgccttcctgcctcacctgccgtcgggaggacgacggagaggagcgccagttcgtccaccgcgtgggccacgcagctgcctcagcccagctcagccgcgaagccgtcgttcgccatctctctgccctgctcgagtgaaggttctgcaggtctttggtgagcgtgggccggcgaggtttttaagatccctgatttctantgtctctctttntgtttccttcgtcgcaccgccctcgcgtggcgcgcgccttgccccaagagagc

SEQ ID NO: 668199 - DNA, 840 bp, Homo sapiens
ggaggtcacctttcaaggacccagaagtacggtttgtgctaggtaacgggtgcgatcatgtggttcgatattctccccggtatgtctccgctcatgggcgtgtgcttgttgatgccaggattgggtactgtgtacagttcacagtttcactaaggggggtcaaggataaaacgggttgctcattatatgggtatcacgttgagatgtctgaggtggaaagagataggtgcaggtctctgagagtagagtcgatagtatgtgtcaaagggttgaagaaagcattgatgaagaagcatattgctgattgatgatataaataggtgagtatggggatctacccgctgagtagaaaggttcaccaggtgttatgtatgtagaccatgccaaggggtggtatatcgttagtcgcctgtcatgttgaatattaatccttggctggaaaagctcaagctggggggttcggctgcaaggcctcacgggaacaccaattttcctggtggatcaacctacagagtgttggtggcagccagagtgcctcaattaaaggttccctaatcctcgggcttaatgacgaaggcacccaaggacaccgtccgtgtaaaaagtgctgcaggtggtggcatgaacgtgtgtagaaatcaacaccctggggagtacccaggcaggcgttcacgaaaggcccgccgcaaggagggggtccctgggagcgtcacgagaggtccgcagacacaagcgtgggtccacagtgggtggcacgcaccaataaataactacccagccccgggggaattagcaagttgtggggggcatttgcctggaatcccaatatcagaaaggccg

SEQ ID NO: 668200 - DNA, 1048 bp, Homo sapiens
gggaagttgggctcgtacactctggactacccgggttgtatttggaaacgcggagtgatgtttttacgagctgtgtgggggttaggaagtggatagcgcgagagggacagtgaccattctaccgaaggatgcaaccaatgatatatatctagtggagagtgtcacagatgaacaatgaacataagaatctagggattcaatcagatgcagagaatagtgtcattacagatatataggtgtacacagcaatacaggcactgagagaagtgatctggtcgcttttagcatgcttctgcatgaatgcctgggcaattcagcaggcaatgtcgttcaacttatgactgtggattggcgtctcttccccattgtctgactcgttgtatagcatttcgtattgttgcttacagataggttccccctttatcttcgggaggatacgttcctacatggtcccccatggtgagactaccgtgcaaactcgaatacagtatacagagtacgtttaatacagcatgttgtatgcatacttatatatggcgtatgatagatgtgtagattgtatagacttaagacactaggaagagattgagtacataatgtaatagaacaagtgataacatactatttagtgcaagttatgtgactgtggatggtcacttgtagcaaagggaatgtcattctcgtccagcagtcatctatgtgagaactgtggttgacctacacggtaacgcgaagaccatcagtaacgggccaacctttggactgacgcgggggcacctactggtatcttacggaatacccatccactatatcatctggacttctcataactacagacaacgaggactaataaacgggcggcatgcaaaaacagtatacgcaggatgcaccgcgaacattctgggggacctgtaccgcggaccctccacgcaaaaagaggcaactacggtccaatcgcccgcccacagagacaggggcaaacgccagcgtccacgcgacccaccacgagacaaacgcacgaaccatctcgggcccctgtcaagcagga

SEQ ID NO: 668201 - DNA, 402 bp, Homo sapiens
cggaaagcacactgcaacatgcatgaaccttgaaaacatgatcctgagtgaaagaaaccagacacaaaaggccacatagtgtaggattccacttacatgaaatgtccagaataggcaaatccatagatagaaagcagattagtggttgccaggggctagaggaaggggagaatggggagtaactgtcaatgggtaaaggatttccatttggggtgatgaaattttggaactagatagcgggaagactccacaacagtacactgcattctgaatgtacttaatgccactgaattgtacattttaaaatggttacaggatgggcttggtagctcgcctctaaaagtcccagttcttcggaggctgaggcaggagaatgcagtgtactgttgcagtgtgcttccg

SEQ ID NO: 668202 - DNA, 681 bp, Homo sapiens
  misc_feature (224)..(224): n is a, c, g, or t
  misc_feature (316)..(317): n is a, c, g, or t
  misc_feature (333)..(333): n is a, c, g, or t
  misc_feature (335)..(335): n is a, c, g, or t
  misc_feature (353)..(354): n is a, c, g, or t
  misc_feature (380)..(380): n is a, c, g, or t
  misc_feature (401)..(401): n is a, c, g, or t
  misc_feature (413)..(413): n is a, c, g, or t
  misc_feature (431)..(431): n is a, c, g, or t
  misc_feature (449)..(449): n is a, c, g, or t
  misc_feature (451)..(451): n is a, c, g, or t
  misc_feature (459)..(459): n is a, c, g, or t
  misc_feature (463)..(463): n is a, c, g, or t
  misc_feature (625)..(625): n is a, c, g, or t
gaccgagtcgttggcgctgcatggcggggtgtgctgaagaagaccactggccttgtgggattggctgtgtgcaatactcctcacgagaggctaagaatattgtacacaaagattcttgatgttcttgaggaaatccctaaaaatgcagcatatagaaggtatacagaacagattacaaatgagaagctggctatgggtaaaagcggaaccgagatgttaaaaanttagaagaccaatttcaaggcggtcaattagaagaggtgattcttcagtgctgaacatgaactaaatctgcaagaaaattgagggaatgaannctatgggagccattantngaagagcctctgccgatnnagtggaaatggcaatataattataangtgacttggtgtgtcatgggnaaactgatgtanataaatattctgtatatnaaggagcgtgtcttatantngacatttngtantcaagaaaagtgatatagaaaatatgtaggagactgttagatagattggtgagttatggtaatatggtcatgtgaatcaagtttgatgatgttgataaagtactcacacggagttgttgcaagagattgatcattgctgtgaacagagaggccatgggaagntttggaagaggcattaacagaaaaattcctacagaattttcaaatgcagagaccat

SEQ ID NO: 668203 - DNA, 820 bp, Homo sapiens
tgacttagaattaaggtagaagaataccattggttgatatttaaataggaagcgcatttgctaggataatctaacatcgtgttgataagttaagtgttcattgagatgttcgctcatatccgtgtttaagggaaagaaatataacactttttagcaggaactgtgtaggaatcacatggggtcgtgagttttcagagtcttaaagtttactttgttccaagtagtgccagagtagtatatctgctgactttctaactttaagtacatctaataacgcacgagcgagatatcataccgtatttcttttgattgagatgaatcaagggaaagaaagaagacagaagaggaggaattaaattttaaggtgaagatattctggtgtcgcacatgggaagctagaagcatgaatgaattcggtgatattgtccttttgaatgagtttaagcgttctactgcctggcttgcatgccagtatctctcacatcttacctgggaaaaatttgattaatagaatttccccatatttagaggaaatcatgggactagagaaagcttctagtcacttgttccattgaagtgctttgcatttgccgtacttgaatttcagttgtttcccatgactgtcattgtccaagttaaacactttgagaatagtgctcgtattgtttcttcttcttcatcttgttagggctatctatggttggattactggatctgtggcaccaagatctctgactgtcactgtcctaagcttagtgcagcatcaacatcctgggttcaagtgttcctcctggcttgggctctgagtaggtgggacata

SEQ ID NO: 668204 - DNA, 438 bp, Homo sapiens
  misc_feature (416)..(416): n is a, c, g, or t
  misc_feature (421)..(421): n is a, c, g, or t
cggggccgggtgtggtggctcgcgcctgtaatcccagcactttgggaggccgaggcgggtggatcacgaggttaggagatcaagaccatcctggctaacacggtgaaaccccgtctctactaaaaatacaaaaattagccgggcgtggtggcacatgcctgtaatcccagctactcgggaggctgaggcaggagaattgcttgaaccccggagacggaggttgcagtgagccaagattgcgccactgcagtccagtttgggcaacagagcaagactcctcttgaaaaagaaagcaaagttgttcaacatgtgttttgctgagggattgccttagatattgctacagtgtgtctgtcaggggagcccttcctcctgggatgattgcagtgatttagctctcttggcttacagttganatatntggctgctgttctttcc

SEQ ID NO: 668205 - DNA, 603 bp, Homo sapiens
cgaatccaatccaaggttcccaaatcgcccgcacatccacactccccaacactcgcgcctagactcgctcacacgcacccacccaacccagaggccacaccaccacctcaaccccacaaggaccccaccacaccgtatcttcacctcccaggaaagggctgagagctgggactaagcgcccacccaccatagggactaataaggtacaggttatacgagggcgcccgcgtgcgaagagcgccgggaggagagggagcggaagtagccgaaggtaaagggaccccgatccgcctgggcccgctatattcgtctctaaaatcgtcacccaaaatagcgggagtttccccccaacaactacacgaataactcgccgaggaccacgtacctccgtaagcggacgtccttccccggaggcccgacgcgtccgacgaccgcacggatagacctaagatccgccgacctaccccgtaaccccaactctactacgcttaatgtttccctagcgagagaggccgacgatttcacccgggtcctgctctactaaagggtctggaacggggccggatactctatcctttaccttgcgtttccgtgtttggggct

SEQ ID NO: 668206 - DNA, 865 bp, Homo sapiens
  misc_feature (43)..(43): n is a, c, g, or t
  misc_feature (88)..(88): n is a, c, g, or t
  misc_feature (196)..(196): n is a, c, g, or t
  misc_feature (311)..(311): n is a, c, g, or t
  misc_feature (382)..(382): n is a, c, g, or t
  misc_feature (397)..(397): n is a, c, g, or t
  misc_feature (406)..(406): n is a, c, g, or t
  misc_feature (414)..(414): n is a, c, g, or t
  misc_feature (434)..(434): n is a, c, g, or t
  misc_feature (451)..(451): n is a, c, g, or t
  misc_feature (460)..(462): n is a, c, g, or t
  misc_feature (677)..(677): n is a, c, g, or t
tttctcttttttggggagcttaactgcttgttgctccctgtcntctgcaccatagtaaatgccacaagggtagtcgaacacctctctngcccctagacctatctggggacaggctggctcagcctgtctccagggctgctgcggcccagccccgagcctgcctccctcttggcctctcatccattggctctgcagngcaggggtgaggcaggtttctgctcataagtgcttttggaagtcacctacctttttaacacagccgaactagtcccaacgcgtttgcaaatattcccctggtagcctacttcctnacccccgaatattggtaagatcgatcaatggcttcaggacatgggttctcttctcctgtgatcattcaagngctcactgcatgaanactggcttntctcagtntttcaacctcaccagggctntctcttggtccaccccncgccccctnnnagtgccgtatgacagcccccatcaaatgaccttggccaagtcacggtttctctgtggtcaaggttggttggctgattggtggaaaagtagggtggacccaaaggaggcccacgtgagcagtcagcaccagttctgcaccagcagcgcctccgtcctagtgggtgttcctgtttctcctggccctgggtgggctagggccctgattcgggaagatncctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 668207 - DNA, 151 bp, Homo sapiens
ttagagactgagtgtagctgtgtttctcaggctggttttgaactcctagtggtaatagaggcctcagcctctcaaagtactgggattataggcatgaaccaccacgcctggccagcgtaattattctgaggttcattcattttggcatgta

SEQ ID NO: 668208 - DNA, 131 bp, Homo sapiens
gagctgttctatgaggtatcccggttatacggagtatacttatctgtcgaccttgaaatgaagaaagagctcctgagtcagtctgactgatgtgcctagacaggtgtgacccacctcatgtgccatgcgtc

SEQ ID NO: 668209 - DNA, 264 bp, Homo sapiens
gtggtcgattcgttaaccactgaaccacgacgggaactccaaaacagtattctttagttgactcagtcaaacgatatttgtaatttgatatgctttaggggctaggtccacatctcctgaaaaacaaatactaagccatgttgtttttgcagatagaagaggcagatgattggctcaggcatggaaacccctgggagaaggcccgccccgagttcatgctgcctgtgcacttctatggaagagtggagaacgacgacgagacga

SEQ ID NO: 668210 - DNA, 975 bp, Homo sapiens
  misc_feature (975)..(975): n is a, c, g, or t
tgtttgctgtgctgcacgaaacgcgaggggtaccctccaggatctgggcctcggcacacgataattgcaggtatgtgtaattactgcacatgcgccacgaacagatcgagactatgggtggaaactcggccgtcttcgacttagtggccaggtcttcgagagacatacggtgcgtgaagtccgggaaatactacccctggactgtccaaaagtgttagtaccccagtttgctgcgtagcgacaaaagtggtactcggagattgtcccttccgtgaatccttggcatgagatttcactcaccactggtggttgttttacgtgaacccaccaggtctggtggacttgtagttgggcgacccgactcgcaactattgtaatagcattgtacggttcgaacgtccaataaaaaggcatggtcatacttcgtggcatccctttgacaacaattcgtcaggcggcttggaatctaaaacgcggggctgttgagggtggctcgtcattgacacggcgaggacactcgctccccactacgggagagtgttgccacaaagtttcttccggggttatgggcccccgcgcgagaaattctgatgcaggaaaatagtaattgttggcccattacacttacactggttaaattggaaggccatggacctggtgggtgtatcggcgtatcaccatacccctgtgatgaacattttttggtgtacacgacgccttcgcacacacggttaagcagaatgtggattgggaaacatactaaacgtaagcgagtgacagctccacgtcctcaaatagttaaagccttgtaaacatgtggcgtatacacgtgggtcttcacttcgacaagtcccgcgaggacccaacatgtgcgcgcgagttaccttacacacaaaaaatataccgagggctaaaacacccggaagttgctatggcaagttgcctggtgagacgggaggctatataccttagctn

SEQ ID NO: 668211 - DNA, 1231 bp, Homo sapiens
  misc_feature (1043)..(1043): n is a, c, g, or t
tcctgtatggcggccctcgcgttgcgtgtttgtgccaggttgtgtgtagtgcccatttgtctggtcggctgggggtttacgattcgttcgtgttttatccggggtgtccttgcttagcgtcgtgtcgctgttttgctcgctggtgggttgttgttgctgttgatttgggggaatgtcgtatatctctggcttggtggtgttctccggcttgtgtcgttgctgggagcgcagagcgaaaattggcacaatcatggggttacgttcgcaaggcagcatgttgcggggcaccacctatgtccttgatcctagggaggatcacggacatgggcttgcaagccctgttcgttcaatggagacgtgactcagcggacccaatgccccaagatgcgcctgccatgccacgtgccttgggccgatgctgcagtaccattcgggcttcgttgcatggagcatggtggatgaggtcaggtgttgcatggctcatgacagtgcatgttgtggatacgtctatccctgacccctgtgtgttaagcagcatgcgcggagaccgtaggtctctcggaccgtcggttttgcaagagtacttcgccctgtgtaggccgtacgtgtcctctacgctccccgaatagttgggtagatgagtcgattcaattcggcttgcaagggaactatagggttctacttgctcctagatgaatcatgttcaacgtgtctgcaactgttcatgagagtacctggcgtctgtactgcaggtgctcttctaaacctgcatccagaggctggtctgcatgtggatcacagcaacgcgtcggcatgtccctaggttaggtgaccgtatgacagcccccatcaaatgaccttggccaagtcacggtttctctgtggtcaaggttggttggctgattggtggaaaagtagggtggacccaaaggaggcccacgtgagcagtcagcaccagttctgcaccagcagcgcctccgtcctagtgggtgttcctgtttctcctggccctgggtgggctagggccctgattcgggaagatncctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgta

SEQ ID NO: 668212 - DNA, 944 bp, Homo sapiens
gcagaggactatgatgcgggcgccaactgcttgggccgcagtggcgggaggcagctgcgggagtgtgggcgttgaggggccggctagcttggggctctggccttgcgtcttccgaccgaatcaccgtcctgagcccggtgcggggctgccgctatcgcctggccgtgggtgccggagcggtcgggttgcgactcagcgttcttgtggtcgggctgctgggctggctgtctccgcgtggggcatcccccgaggcctgccctcgggccatgatctgactccgtgaagctgcgccgcgacagcgcggggacttcttctcccactactgagtacctgtgcgcgctgcagaactccgtgcctgctgccctgccagtgctgcgcctgtctccgggagggcgtgctggatttcaatgccgaccgcctccgcggggtggactgtggcgcctctgctgagacaccctcaagatcaactaaagacctgacccttggtctccatcaagagcttcttccaggccctggctgggggaacacaggttctgacagtgactacattttgcagaacgtcgtgtccctgcgatacgatacaaagatgtgaccttccaggttgtgtaaacgctcttaaaggctgttccaagtatatcaagtgtgctacagaacctggagctaaagtggactaattctgagacgagagggatttaagtatatagcaaaggggattgactaaagtcggattgtttggtgaacatgtagtcttgaaagttgtcaattggagatgcgaggtaagcaaagatctagaagtctaaagagcaacgcattagcgaagaaaaacaagaagtattgaatgagggaaaaaagtggaaatccggatgagagaggggaaaattcttattaggaaagacggtaaagtagagaacatagaacaatttggtcattcagagagaagagta

SEQ ID NO: 668213 - DNA, 976 bp, Homo sapiens
agcggtgtggttgttgacggtgagtggtttcgatctcctgtttcactgggtttggagaggaaactgtgcatacggtgatgagccgcggtgcttgcaggtcgttgccatgaccatcctcactaagggctaggaggcgctccaagcagtgaagatgccattcgcagatgctgtggatcagaccctgcacagcctgtcccccgttgtgccatgctgaagaaacttcaccactatcattgagtcactgagctatagtcctttgtctgtggcctaccagattttgtgagaaggctggtagcctcacagtcatggggatggccgcggtatctcctggagaagataacgatagtgggcctccagagactgggcagtaaccttgctgggtatattagctgagccatggcagacagttggtctcatgggggtctcacggcagggaaggaatgaagggtcttaaagatggcgtgaaggatgggaagcgcgtcgaggacttggtaaggagtagaagagtcgtccgaatcgtgaagatgtgacctcttaccttagaaagaaggaagagcaaaggaggaagtgctacggaaggctgctccgccaggatccagtgcatgaagagctgtgctgggggagcaggtgacgatgaaggagattggtcctgtgaacgcgagcaagtgatatgggtgaactaaccaccatagatccccgagaagcagccggcgggattcatggcctcctaccagggcctcagaggccgctcagagaggacagggccagatggccctagtcgtggcaatgggtcggggaaaacacccagaaagaatccgggcaccgcaaagggagcagtcatagatcagtgttcacacaagacaatggccggcaatgtcattcttggtagccacgcggcctccggtgagttccccgaaagaaaggggaataacttggcccaaggtggaggaaacagatacaccaaaagtggcaccct

SEQ ID NO: 668214 - DNA, 475 bp, Homo sapiens
  misc_feature (87)..(87): n is a, c, g, or t
gcggaactgatatggagactctactactggtgggatgtgaatggtgcatgacgtgggaaatagtttggcagtctcgacatatacagntatcatatgatccagtaattctactcctaggtatataatgagagaattgaaacatatgttcacacaaaaacttgtacgcgactgttcatagcaccattgttcataatagccaagaaccagaaataatccaaatgtcccaatgatgtgtgaataaacaaaatggggtctatccatacagtgggatattattcagccagaaaaaggaacgcattgctgttatatgctgcggcatggatgaaccctgagagatccgctgattgcgactcagcagagagagctgaggatgcaagaatcagagctagcgctgtggtgttgagtgctccttctcctagttgtagtattcatagtaatagtgagcaagcattgctattgaacgcaaaggtgccgt

SEQ ID NO: 668215 - DNA, 745 bp, Homo sapiens
agcggtaaatatagccaaggcctaagggatcaaggaaaccaagagcaggatccaaatatttccaatggagaagaggaagaagaaaaagagccaggtgaagttggtacccacaatgataaccaagaaagaaagacataattgcccagggagcatgctaacagcaagccgggaggaagacgattcccaatctgatgatattttggaagagtctggatcaagcaaattccagttaggccagatggcagggaggatggaatttgatgccgggttaaccagagaaccaggaagattactccaagtgcagcaaatggaagagggaaatgccattcgaacgttccataagcacattcaagaaactgaatggcagaggtcacgaagggtatagaagctgggctagaaagctgatcaggcaaaccaccacaagacgacagaagaaaagactgtttctgaaggctctgcgtcatgggaacctactgatgatggtgataccacggcccagaaatccatggagttgatgatgcatggcgatgatgatggcgatgatggcggcactgatggtcccaggcacagtgcaagtgatgactacttcatcccaagccaggcctttctggaggccgagagagctcaatccattggctatcaccttctaaaattgaggagccaagagaaaaagtacatgactgatgaaagtataggtaccactgagcctggagagcaccaagaggccaagaaagcagagaactca

SEQ ID NO: 668216 - DNA, 1724 bp, Homo sapiens
gactttgttccagatgtcgcgttcctcgtatctcttgctgcatcaatccggatgtctgtctcttgtaaggttacatcagtcatgctcgggtgcgagagaatgctacctgcagtgtctggactctcagggactgaaaggcataggctgaacgagtaggtgcttgaagaggcaaccgtataaaggaaccggggccacagtctggaatttgcacgcgagcagtcgcctgctcacaattcctagtgagcgcaagaagcagaagaaaggccatatttgttgcaggttgtaccttatggatagcacgcagatggagccgcgtggcattgcttgcgcatctatcatctgcgcgccatgcgtgcgacaaggtagagtggactagctcgtcgtgtagaatagaaaggcatcgccataggaggtacctccccgccagaaggcatacgtagtggcccacttggagatagccttcaacattcgctccagagagtcaaaagcatggtgagcctcaccaaatagcaggggaattgatgggaagcatgaatcgttgcgtactctctcgcgtttgaccatggttggcacaacggtgcctttgtgagtggaatcacacaccataggagaaaacggtagtggccacgtacgtgtttggattctgtccctcatagtaagcccgaaatgatactagcgcttgcgcgtaccgtgggcggggccgaagaccatgtaacacagccaaaggtctccaaagggggacggacgccaaaagaccccccaaggggggcggggttttccgaccgccactggatggggcccacttggattccaacggactctccaagagcgcgttttacacccaggaaggactctaagctagaaccgtaatcggccatgtagcacaattgggggggccacgaatgcgtacggaccaccgggccagcggacagcgaggggttacattgaacgggggcacatggtccaagaaccagccctacccatcccaaaggcccaggaacaaagtgaaccccacagagatgcggctgtgaaaccgcccagaaagcaacgagggaggcgccaaaccccgaggccctggagcggggtgacccaaccgaaccctgggggcccccctttgggattcttggctgccccaaggttgaaagggagcttaattttgaagcaggcaccaccaaaggttaaagcaatccttcgtattcaactccaacctgtgggtgacggcgcaaaggaacctatgggcgtggccttgtagtacccggagacaacacaaacatccgggcgcggaccttcccctactatcaaaacatctagggtctttccatggttgggcggccgctgaacgggctcccgcagaggagaattactcactcactcggggaacacagcgccatttcctcccaaaggggattccacacaaagaagcggacaaggttcacagaagtggtaccctgtaagccgccttgtatggggtgcacccaaaatgtcccccaccgagcagcgagatgaatgataacccagcacaatgaaaccacttggtcccacaaaggccacggtggtgaacacacacagtcgtgcgggccccacagcagtgagtagtaacacaaggacaaaggcgcgagacgaaataatacacgggcaaacaggtgcgtaaagcgcacattatacaacacgcaagagaagactaacactacaacactgatggacgccggacatggaacggacat

SEQ ID NO: 668217 - DNA, 929 bp, Homo sapiens
ggacacttctgttataaataaaacacagtgttgaaaatacttgtggagaaagattcttccaaagatatacctcatattataccagatttcttatgatgttccttagacagtttgatagtaaatttgcgagaaaaaactcgaagtggtttttataatggtacacctccacagcctccgttcgaagatgtacatttgacaaattggtttaaaagttgagaaggttattataaaaagaattcacgaggtatgatgtgtaagtggtagattcctgtagggtacagtcattcttttatacttactcattccgtatttctgtgactggtaaatgtacgagagggaactaatattcatgtctccataatagtgagtgtacaataggttaagtgtttcatgggaattgagggaaacgtccgttgtatagttatcgagaggtagcaatgaaggtttccttttcacttaattttgggtcagtagagaaaggaaggagccattttcaagaatatgtgcatacattggaaatgtgtaggaaagtaattaatcactttggcaaaggattgaaaggggcccaattttaaaagactattgacgttagatacgactagattaaatatattatatagatcgctatattatcttggaaggtgtgtgatgaaaattagccaaggaagaccgttaacagtaatactttataacagtataatgccatagtattcagtctactgacgaattataaaagacgtaagaaggcgatgtacagtgctagcagcgtgtagaaagggagtttttttaggggagggttaaaagaataactgtttatggcgtgtttaattgggatatgcaaaaggttaattcaggtgttgccttgtggaagggaggaggtatccggattcgagatgtccgtgaatagcggttttggtgatatgtttcag

SEQ ID NO: 668218 - DNA, 519 bp, Homo sapiens
  misc_feature (446)..(446): n is a, c, g, or t
  misc_feature (470)..(470): n is a, c, g, or t
  misc_feature (489)..(489): n is a, c, g, or t
  misc_feature (515)..(515): n is a, c, g, or t
ttagacagagtctcgctctgttgtccaggttggagtgcagtggcaaatctcagctcactgcaacttccacctccaggattcaagtgattgttgtgcctagacctcccaagtagctgggattacaggtgtccaccaccacgcccagctgatttttgtatttttaatagagacagggtttcgccatgttggccaggctagtctcgaactcctgacctcaaacgatccacccaccttggcctcccaaatgttgggattacaggtgtgagccaccacacctgggcctgccctaagcctcttaaatagatggggattacaggtgcctgttgccattacctgttaatcccatcccaaatccattaaatttgctgttttttgaatttaaaacagcaaaataggatgtcagcttaaggtgtagtttttttaaatcagtataacttttaattggnacatgaaatatttcatttgattgnattatatttttaaaacggngttaattttttgttttaaaattaggnattg

SEQ ID NO: 668219 - DNA, 208 bp, Homo sapiens
ctgttacctgatcccccagcgcggtatgatgctggcgcggattgtcggcacattacctacctgtacgacgactccatgggcgagaaattctgtgccgtggcctcaagagcgagaagctcaactacgacttccacagcgtcgaattccagtgtggaaagctacctgctgttaccatgggcgaggagttctcggggcgtatcgacgccaa

SEQ ID NO: 668220 - DNA, 295 bp, Homo sapiens
gatccctatactgttgcggtaacattactcttttttttatatcctatgaatatcacattagagtaatgttcaccgccaacactacaggcaaatgtctttgcagcttatgaggccaaaagggaaactaactgctgtccatggtcttctacgctttaccgtctgaagatgatctagtaatttcctaatagtactagatatactcagacccatttcgaaaaaatggtgtagaacggtctctgttttctagttcagtcttacctttttccctatttcgctctggacttcctttatgcta

SEQ ID NO: 668221 - DNA, 395 bp, Homo sapiens
tgctgatgcgtgtagcataccaacactgattacttccctcgtccgctgagaattttaaaagaccacaatgatcattcagaaagaatgcatcgatgctctctctcggttacgtttggttgcttttcttaatatctcaagttgtctaagagtattatcttaatggattgctgaatccatcagccttcttccgagacgcaagcccggttctcattggccatagccttttcccttttttaaaaggcgcatgtttctggtctgtaaatctttacttcagctctccaggaaacacaagttaaggataacgcagatatgtatgtactttaggaagtaaagggaacacttaggaaagtgttatattgcagggttccaaaaaaattattacactttgtttacaa

SEQ ID NO: 668222 - DNA, 465 bp, Homo sapiens
gtaatattaatgttcataaaagatagtgatgaaaaaacggtaatgctgaaataaaggcgcttatagaaaatatttcaggacaacataaggtattaatataggaaaaaaactgtacatattttcaagcacaacactgaaatatagcagcagtgtttacctgaattgtttgacaatagtggtaattatactaccttacataccgttctaatatgtaaatctcttaattacaattggaatatacaatctgacttaccattagaactatgcacagttgccgaagcatatgtctcaggtttgtagttgcacaaaaattaacgtttcagttggtccttgatttggagtactataactacctggcagcactaagttttagacacatccattgatagccaacaaaatccttgacagagtgacaaccatcaagagtaccatgcgtgaaaaagcagctgtaccctccaagtgcat

SEQ ID NO: 668223 - DNA, 172 bp, Homo sapiens
atgatctaccgctattgtgctgctgtggagtgctctataacatagaggattggcttgagatagagggtgacaggcttttaagaaataaggaataggctggcacagtggctcacacatgtaatcccagcactttgggaggccaaggcagggggattcacttgagcccaggagt

SEQ ID NO: 668224 - DNA, 365 bp, Homo sapiens
cacgagggtatggccgagcacgctaccccacgcgcggatcagtggcgtgaagccgcgccgctcgagccctgcgagaaagagcagctcttccgatgtcgggagctccacgccgctcgcgccggagaggacgccgaggacgcccgtttcgggtgtgatgccgaggcggccgaagaggcgggcgccggccgctgcggcatcgcccgcccgccgccgcgtgctgtcggatacgacgtttgcgatgcgcgcgtagggaagcgcgccgcggcggcgcgcatggttgcttgcttcgagaaccagaaatgcgcccacgcttccgggcaccaatccaccgccttgctcgcggcgctgccagacagagcgatacg

SEQ ID NO: 668225 - DNA, 803 bp, Homo sapiens
ggatgccgacaggaaagaaggtcaaggtgaaagcaaggtggctccggtcccagctgtcgtgagagaagcaggaggctaagaatgtggtgaatcccctgttggatgaaaaggcctaagaattttggcattggacaggacatccgagcccaagagagagacgctcacccgctgttgtgaaatggtcccggtactagtcaggcttgcagcggcagagagccatcctctagtaagcggctgaaagtgcctcctgcgattaaccagttcacccaggccctggaaccgacgaacaggtactcagctgcttaagctggcccacaagttacagaccagagacaaagcaagagaagaagcagagactgtaggacccgggccgagaagaaggctgctggcaacacggggacgtcccaaacgaagagagccacctggtccattcgaggcaggaggttaacaccgtcagcacctgggaggagaacaagaaagctcagcaggtggagattgcacacgacgtggatcccatcgagctggttgtcttcttagcactgacctgtgtctgtaacaatgggggtcccttactgcattatcaagggaaaggcaagactgggacgtctagtccagaggaagaactgcaccactgtcgccttcacgagcagagtgaactcggaagacaaaggcgctccggcgtaaagctggctggcagctatcaaggaccaactttacaatgacagatacgatgagatccggcgatcactggggatggcaatgtcctgggtcctaaggtctgtggctcgaaatcgccaaagatc

SEQ ID NO: 668226 - DNA, 359 bp, Homo sapiens
aggtgtcccagatataaacagtacatttcatcggctcaccacatctgcaaagaggcacaccaatccaattttatgatcagggtgcatatgcctcctccataattttttagatcagccagattcataaccattcccgacagggcatctctccatgtactgtcaccacaactttataattgtgcccatggccatttggattgtgcatttccaacagtttcaagttttttcatcactaaaattactgacatcggtggctcgcgtgaagagatcgcggacacttgtgcctgcaggcggccaccaccttccgtgctcatttcccggccgtaaacaggtcggcggcctctccgccgccgcccccc

SEQ ID NO: 668227 - DNA, 338 bp, Homo sapiens
  misc_feature (52)..(52): n is a, c, g, or t
  misc_feature (64)..(64): n is a, c, g, or t
  misc_feature (89)..(89): n is a, c, g, or t
  misc_feature (206)..(207): n is a, c, g, or t
  misc_feature (230)..(230): n is a, c, g, or t
  misc_feature (321)..(321): n is a, c, g, or t
tagaggatcccgctccaccgagtagggtgggggtgtgtagggaggggggttnggctatgtagcnctgagctcaaagtgatccgctgccnctgctgccaaagtgctgggattacaggcctgcaccactgcacccggctgctgtaaagtcttatttcacacagctgagacatgttttaggaagtttgctaaaagacccctggagaccnnctcattgtgacctccctgttatngtgtttaatttgattgaacttttctgccctcctgcttttcagcttctctaatagtctcccattaaaccaattctaagaaccaccccgtcgngtggagcgggtaccgag

SEQ ID NO: 668228 - DNA, 171 bp, Homo sapiens
gggtggctgttctagaggatcccggaggtgggacacggggagaggtgggaggatcacttgagctcaggagtttgagaccagcctagacaacatactacgaccctgtctatacaaaaaaaaacttctctaaattagccggatgtggtggtgcatgcccgtggtcccacctct

SEQ ID NO: 668229 - DNA, 483 bp, Homo sapiens
ctggtgtcattcggatttcgcatttctctgatgagtgatgctatcaagcacctttgctgttgctgttggacatatgtgtatgttccctggagaagtgtctgtgctgagccttggcccactttttaattaggcgtttggctttttattactgagatgtaagagttctttatatattctggattctagacccttatcagatacatggtttgcaaatattttctcccattctgagggttgtgttttcactttatcgataatgtccttagacatataataaatttgtattttaaaaagtgacttgatttggctgtgcaaggtggctcacgcttgtaatcccagcactttgggagactgaggtgggtggatcatctgaggaggctaagagttcgaggtcagcctggccagcatagcgaaaacttgtctctactaaaaatacaaaaattagtcaggcatggtggtgcacgtctgtaataccagcttctc

SEQ ID NO: 668230 - DNA, 94 bp, Homo sapiens
tggcagatctagaggatcccgatcatacaaagggtaatatcacagttttggtgtgttaattatatgagtttgttttgttatgagacttttctcc

SEQ ID NO: 668231 - DNA, 235 bp, Homo sapiens
tccagtacccgagcatgcttgcctgcctgccggtcgacgtgtatacaccactgcggtgcatgcctcccttggacaagttccgtcgacacagtgagcgcgcgtgctgacctccaaatatcgttaagctggagcctggtcgacgtgtattcaccactgcggtgcaatgcctccctgtacaagttccgtcgacacgtgagcaccgtgctgacctccaaatatcgttaagctggagcct

SEQ ID NO: 668232 - DNA, 298 bp, Homo sapiens
actactaagtgactgtaggagcacgtctgacttgggacaccattgtgtctcactgcgggagattgctcaggtccctcccatcccaagaattttaatctcattgaatgctaaattattggggtccttgtaggttgattgtgaaatagtcaactccaagtggtttggagtgccagaacactcacataaaagcatatactatctaggcgcacagtatccttagtaagcccatcatccccagcaaacagtctccatttagcattcttggtacaccatctcagggcaatcaatcaagcaccaa

SEQ ID NO: 668233 - DNA, 308 bp, Homo sapiens
tttttagggtgggggcaatgaagcaccagatgttgagagacggaaccaggaacattgccccagggttaaatgaggctaaggacattgggtgtattatgacagagccaaaaagaagaggggagtgggctgaacacagcgactcgtgcctgtaatcccagggatttgggagtgcgagaaggacggattacttgagcccaggagtttgagaccacactgcttaacgtggcgaaaccccgtctccacaaaaaacacaaaaattagccggtcgtgggggcccgtgcttgaaatcccagctactcagcatgctg

SEQ ID NO: 668234 - DNA, 139 bp, Homo sapiens
cgaaagcctaattacgcatatatacatggaatactactcagacataaatggaacaagataatgccattttcagcaacatcgattcaactagagattctcatactaagtgaaataattcagaaagacaaacacaactacc

SEQ ID NO: 668235 - DNA, 536 bp, Homo sapiens
cggtgttgtgcatttcttaaaataagacaataatcagcttaccaaattgaccaactcttcatgagatatttctctgtagcatgagatgtgtttggtagcattttgcctaccatagaacttctttcaaaattcgaatcaatcttctcaaaccctgccactgctttatcaaacaagtttatgtaatattctaaattctttgttgtcatttcaacaatgttcatagtaccttcaccaggagtatattctttcttcagaaaccactgtctttgctcatccataagaagcaactcctcattcaacaaagttttatcatgagattgcagcaattcagtcacatctttaggctccacttgtaattctagttctcttgctattttcaccatatctgcagttacttccttcccgtgaagtcttcaactcctcaaagttaccaatgagagttggaatcaacttctttcaaactcctgttaatgctgatattttgacctcctcccatgaatcacaaatgttcttaatggaatccagtatggtgaatc

SEQ ID NO: 668236 - DNA, 594 bp, Homo sapiens
attctagaggccgaggcaggcagatcatgaattcaggagatcaacaccaccctggctaacacggtgaaaccccatctctactaaaaatacaaaaacttagctgggcctggtggtgggcgcctgtagtcccagctactcaggaggctgaggcaggagaatggcgtgaaccctggaggcggagcttgcagtgagctgagattgcgccactgcactccagcctgggcgacacagtgagactccgtctcaaaaaagaaaaaaaaaaaaaaaaatccagggggtactcagggggtaactttataattcactaaaatgggcccagagctcgggttagttggagtgaaccctggaccaggttatgtttggcccattgtaagtagcaccccaaaaaagtgtttggggccatttccttcagtgcagaaaggttcttttcgtgccggtactaagtataattccctcccgtggccccaatttacccgtggtaggcacgtactttctggatttttattcccacagaatatccatttaatcctatattttctaaatttatccttctaagatctcggggggaccgggatatatatttacattttcagt

SEQ ID NO: 668237 - DNA, 381 bp, Homo sapiens
  misc_feature (160)..(160): n is a, c, g, or t
  misc_feature (275)..(275): n is a, c, g, or t
tactctgagatccgattaggcgaaatatataggctagtaccagaatatataggactcagaaccaacacaaattcaatgaacaaaggactcacagacatttcttcaagaagaacgcagatggcaaagacaacaaagatgctccacatcatttagtaatcanggaaatgcaaatcaaaaccacaatgagagaacacacccatgaggatggctataatttttaaaatgggcaaataagtgttggtgagggtgtggagaaattggaaccctcatacatncaatggtggaaggtaaaacggtacagctgctgagggaaagtttgacagttcctcaaaaagttaaatgtgcgatttcaaacatgacccagcaactccactcccaggc

SEQ ID NO: 668238 - DNA, 949 bp, Homo sapiens
  misc_feature (226)..(226): n is a, c, g, or t
cgcgcaattccaatccgttccagcctgcgacctgcggagaaaaaaaccattacttattttcttgccgccgcatacataccttgaggcgagcaaaaaaattaaattttaagccatgagggaaatcgtgcactagtccatggctggatctagatgtggcacatccatggatcgtgctgtccaagcttcatggcgtagaggttggatcgacgcctgcatgaaccatggncaatctgacccctacccgtgacagtcatatccacaagtgcgcgcacacgcctgacactgtcgagcttggcaccgacattcttctggtgttatctactagactgagagccagcatgatggactaagatagtgttccatcgtgactcattccgctggtgtggattctagaaaaccatgggaacgcacatggagcctcttgtttctgactcatagtccatatttgtgcgctcagaaactcttttagacaccctagaatcaaacttttggtattttcgtggttccagttctggtgggctaagtgtaactacaacgtgggtcctaaaagcgacctatcatacctagccaagagggggacaggcctgcaggcgtggcttgcacttcttgtccttgtggatgctgtgtacgggcacacggacggcaagacgtagactgctgcacattgccctgcaagtggcctttccagtcgtgtacctcacttcagctgtgggccgcgtgagggcacagcgctcttgtgaactgggacagctctcccttaatcaagccaaagaatcccgagaaagaaataccactgattcggcatcatggaactacctttccagttgtggttgcctttcacccctccacgtgttctgaccagccggtggttcgaaaccccttaaaatgtcaacccgttcttcccccatcaattgggcaaagaataccggtggcaccctttgctttgcaa

SEQ ID NO: 668239 - DNA, 189 bp, Homo sapiens
cgctgggacgtgaatggcaaactggttgatccagagtagccgaattgatgcaatgaaccaagctgttgagcgcgcttggtcatgtttttgcgcgtttcgcgcacgcataagacactttgcagaggtgtgccttgcgggaagtgccatacctgatgcgaaatcctccggttcccagtcactgtgatcctg

SEQ ID NO: 668240 - DNA, 895 bp, Homo sapiens
  misc_feature (330)..(330): n is a, c, g, or t
  misc_feature (482)..(482): n is a, c, g, or t
agcggaagaggttgcagtgagctgagatcgtgccattacactccagcctgggcgaaagggtgagactccatctcaaaaaaaaaaaaaaaatgattggctttggacgtctaaggtggcaggctgtcccctccaggcaaattgcccttcaaaccgacgatcatggtgcccacttacccggggctgggagagtgggtgtcaggtccctacaggagatagctttctttcccttactccctatctaacactttggctctgcaggcagcctgtgcccattctctaagccgggcttagaaggcactggggaatgtccttgtagagagagacctagantggtcatgcaagtgagaaagacttctgaggaaattgggaagacctaaggcagacgggaaggaagcacaaaagacaagcttggggtcagacccataaaccacctcccaaaggcggtcatttcatggcactggaattgggctttatcagaagcnaggaagtaaggggagtcatggcctgtgggcctgggaatctaagggggagacaatattaattgggatccgattaatgggaagattactaactggtggacaaaaggtttatcttgtgcacaatcaataaaaagtggcatttttaagtaaattaagagcataaacaatatggctagaggtgccatgtttagtctaccaaaaacaatacttttcaggcactttagaaatatccttttagaagcagcgagttgcatgggctaaattatcctcgatctttatgtatttggctcacagaaacctctacgggatccttattggggacctttgggtacgacattagttggaggtactacctatgttcttgaaacattattacaggggcatttcttttggaacaaaaaaaaaatcctccgcgg

SEQ ID NO: 668241 - DNA, 281 bp, Homo sapiens
ctgctggtccccccgactagcccgacagccccatcacctctaatcagcaggcagtgcagcatgcaggtgggccttggtgcgccccccgagcatggtgcctggtgcttcgtgctcttcttgaccctcctctcaatgttcccttgcgggtcgggttagtcgggtggtgtcttctcacagtcgcatggccggtttgcgcgcttgggcctggctgtcgtttactgatgctctgtgcagtggtgggtgcgcccccagcttctctctccctgtcgggctagtcgggg

SEQ ID NO: 668242 - DNA, 443 bp, Homo sapiens
  misc_feature (30)..(30): n is a, c, g, or t
  misc_feature (38)..(38): n is a, c, g, or t
aaaaaacctacttttcccccctttcactcncccactcnaacacttctaaaaacagatgtggaggggtatttcccccatacacccaaccaagcaattctgcagaggacatcaactgggtgtcccctaattcccattcagttcaactgtgacactatctaccctggatatagtgtcaggtcccacagattaaaggctcagtcccacaagactgcacctacttcagatgccaatctcaagccctaggttatggtctgtgcttctgacaaactggctataaatcagggtccccactctaccctctcctttggtttaatttgctagagcacctcacagaagtcagagaaatactttactcacatttactgtttattataaaggatattacaaaggatatagatgaatagccaaataaaaataataaaaattttttaaaaagacaaaaa

SEQ ID NO: 668243 - DNA, 83 bp, Homo sapiens
ttgctccatatggaacctgctcgtttatggaatttgctctgccaccagtaacagtcaataaacttcaaggaaaatgaaaaaaa

SEQ ID NO: 668244 - DNA, 1115 bp, Homo sapiens
agcggatctgagtcttctgaatcccacttagaactgtgttgagctctcacccatcacgatgagcaacaacattcctgggcacctggaaacttgtctctagtgagaactttgacgcattacatgaaagctctgggtgtggggttagccaccagaaacactgggaaatttggacaaacccactgtgatcatcagccaagaaaggcgcatattaataactatcacgaactgcaaagtacctattaaaaatacagagcatctccttcaagctaggcccaggcaattagcaagaaaccacaagcatgacaatcagcacaagcacccaagcagcatcgtaacccatgcagaagcaggcatccactgacatccaagtgcagagcatgggcatggcacaagcagcacaaccaataaagagaaagcatagtgaaatgggaaaatgagtagcaggaatgtaaaatgaagggcgatggtgtgacacacagaatctatgagaaggtctgaaaaatacataatactcattgaagatggattattaatcatataatgatggaaatcaatatgatatccatagaaaacagatgaatacaatgcaaaataattgaaaaagataatagtattaatattacagatatgcaaagggcataaattgagacataatctaaaagcacagtggtaataaaaagcattttcaaatgtgacatgcatgctcaatattcacatcacagacaatatagtataggacacaacaacagaacagagagacagatcatacacatatcaatacaaaaatacaagtaaacgattagactatgcaaacagaacaacgcaccacataacacaggataaaaacccactacgatacaggtacaacagcggaacgggacacaggaatgcaacacacagaaggctaaacgcaccaaagagcacacattgacagtgcgaagctacgacctacgaactgaacgagaaaacgaggcactagaacaatcaacggacacgacgagcaacagcgacggtcccagcacccacgagacacacaatacgcacgacacaacgacagaaaaacgaacataaaaagaaaagatctaggccacacaacaccagcagcgcagatccaa

SEQ ID NO: 668245 - DNA, 315 bp, Homo sapiens
tctgcaagaatcgcaactgcagctggcctgtgacttgcataaaacttcctactccagtaaggttattaacagcagcttgctgagcacataaggcctgtgcttgactggttgaaccttgctcagaaacctagccccctggctgttcgaggactacaagttgtgggctgctgaggttggtcagtcggtgtaaacggggagagctgctgttgctgctgctgaacagtgttaaaaaataagtgaaccaccttggaaagctcggagtagatttcagggccccttgagacttgcactatttccttaaaccaaatgggaaca

SEQ ID NO: 668246 - DNA, 505 bp, Homo sapiens
tatcgggctgacgttgccagatattttcgttcaccgcgattcaggcgcctgaccgacatagtgccaccgatggacggggataattgtagctggtttcgcctgctccatcgcaattgccccttgtggtcgcagcgattggcggctttgtgcatgcccatgcagggttacgccgccgtcgtgcatggccctgcatttcccgactgggcagattctcgatcgcttggcgtgtagtgggaggttgaagtggcgacactggttatgaccgggttgggcacggcgattggcgggcccgtcggcggttgtgttggggccatgcttggccagcagctcgatcgcgctatagttggaaatggcccccgccgcgacggcccgcgcttgctggaactggaactgcaaacgtcgagttatggcactgcaattccagcgatatttggtacgatgagggttgcttgcacgattatatgggcgagcgatttgatcgaaaggcggactgtcacgggggtag

SEQ ID NO: 668247 - DNA, 901 bp, Homo sapiens
  misc_feature (275)..(275): n is a, c, g, or t
  misc_feature (490)..(490): n is a, c, g, or t
  misc_feature (529)..(529): n is a, c, g, or t
  misc_feature (553)..(553): n is a, c, g, or t
  misc_feature (612)..(612): n is a, c, g, or t
  misc_feature (643)..(643): n is a, c, g, or t
  misc_feature (646)..(646): n is a, c, g, or t
  misc_feature (669)..(669): n is a, c, g, or t
  misc_feature (691)..(692): n is a, c, g, or t
  misc_feature (694)..(695): n is a, c, g, or t
  misc_feature (700)..(700): n is a, c, g, or t
  misc_feature (709)..(709): n is a, c, g, or t
ggaacagtatctgaatagtgtgattgaaagccacagcggagttcatattttaccaccataaaggctcccttgaaaccatatgcagtttctccactcggataatcgtccttagttcatcgaaacaagacacgagtgtagaaagggatctgaactggaaaattacactcaccagaggatcttcccttacctggtcctgcttgtgccgtcactgtcaagtctctaagagcattgtgtgcaaatggcagtggaacaaggtggagatatgtgctcctggnaaaagtccatagataggtgacaataggttgggacctctttaaagctgagacgagtgttgtcactagcactctgtggtgtgcaaaaagatacaggagctggctgtcttccatgatgaagacagaaatacaaagaccaaatctgacttactgagtcttagtggagaaaacacgtttgtgtgagcctgcaggatcggctccctctctgatcaacagtnctagtactcttctttgtcagtatatcaacctacagctcntgaatgcaaagccacaagagtgtntaatggggacagtgggcactctcctgcttgaaaacccacttgggcagaatggactcacncaccaaggtcttctgtatgaagcagccaagngtnttggccttcggagcaggaagctnaagctgtttctgaatgagaccnnanncaggnaattacagnagaatcccgtgaagactttcgaatatgaagcctgtgtacatgtctgcgatggaccagcagcagcgagaacttctagcatgtactttatcaatattgttcggtcagcccttccctgatgacacctatccccgacacatacatgcacatagacacacacatgaacacacctgcgagatatttccttctgctcga

SEQ ID NO: 668248 - DNA, 886 bp, Homo sapiens
  misc_feature (37)..(37): n is a, c, g, or t
  misc_feature (69)..(69): n is a, c, g, or t
  misc_feature (136)..(136): n is a, c, g, or t
  misc_feature (147)..(148): n is a, c, g, or t
  misc_feature (155)..(155): n is a, c, g, or t
  misc_feature (159)..(159): n is a, c, g, or t
  misc_feature (161)..(162): n is a, c, g, or t
  misc_feature (165)..(168): n is a, c, g, or t
  misc_feature (175)..(175): n is a, c, g, or t
  misc_feature (204)..(204): n is a, c, g, or t
  misc_feature (223)..(223): n is a, c, g, or t
  misc_feature (238)..(238): n is a, c, g, or t
  misc_feature (280)..(280): n is a, c, g, or t
  misc_feature (308)..(308): n is a, c, g, or t
  misc_feature (476)..(476): n is a, c, g, or t
  misc_feature (499)..(499): n is a, c, g, or t
  misc_feature (525)..(525): n is a, c, g, or t
  misc_feature (630)..(630): n is a, c, g, or t
  misc_feature (658)..(658): n is a, c, g, or t
  misc_feature (660)..(660): n is a, c, g, or t
  misc_feature (696)..(696): n is a, c, g, or t
  misc_feature (706)..(706): n is a, c, g, or t
  misc_feature (768)..(770): n is a, c, g, or t
  misc_feature (797)..(797): n is a, c, g, or t
  misc_feature (804)..(804): n is a, c, g, or t
  misc_feature (868)..(868): n is a, c, g, or t
tattgaaacttatcatttttgatgtacattttctatnctaaacacaacagttaaaatgcagtgagtgtnatgaaatgtaataagctcctataaagaaacgattggggactattatttttgtgatttaacaacaganaaaatccaggnngaatganttgngnnggnnnnaggggtngtttatccctgctcatgcttaagattgangatttcgtgaaataaagancattatttgagaganaaaaactgattttttttaaagaaatcatcactctcatttganaggtttgctttcttatttcctgtaagtncatttcgtttttctaattcaactgtaacctcaggaccactgtacagcacttagtaaacctgtctttgtacatgcaatctagttcttaccaactgccttctcaaatggaatagaactataacacacaaataaaaggaagatgtacaagcacagggacaaaacaggaggnaaataaagactagaatgtgaatntcattttcaacaagtatcagcaaggnaaatgagaccctggtttcataattaattaaatctgcagaatgccaattccatttggtgttaaacagtaacccaatataaaccactgattctggaataagattaanaaaaaaatacctgagtgaatataacaananggatagaccaaaaagaaaaaaaatctcacacacttnggtcactgcnagaagatccacaggttatagaaaaataaaggaacttaatatccaaacattcagggtaaagannntggattatcaccattaagtgtaatcantcaggtncttacagtacagaaagtaaatctaattttgctattgcgagatgaaacattttaaaacttaattncttactgatataatacag

SEQ ID NO: 668249 - DNA, 740 bp, Homo sapiens
ttggcggctgcaccccggtttatatcagttataccgaatgttgactggagtccagggccacagatgagcgagaccgagagtccgatcgagagcggacgctgagtaaaatgcggtgatagctgatttctttcatggcattactgagagcaaggcagaggggaagagccccctgttaaataccagtacgatagtctcgtgagaactgtgccgctctactgtttacacagcatgggggaactgtctccatgttccaatctccttccaccaggtccctctctcaacacgtggggattatggggattacaatttgaaatgagatttgggtggggaacagagccaaatcatatcattccaccctggcccctcccaaatcacatgtcctttttacatttcaaaaccaatcatgccttcacaacagtcctccagagtcttaactcattccagcattaacccaaaagtccaagttcaaagtctcatccaagaccaaggcaagtcccttctgcctgtgagcctgtaacattcaaaagcaagttagtgacttccaagatacaatgggacgtacagacattggtaacatgttcccattccaaatgggagaaattggccaaaacacaggtgctacagtgccccatgcaccaactgcacatccactgtgcaagtctgaaacccggcagggcactcctataaattttacacttttaatatttcgctataggagtcttcgcttcttgttgcccaaa

SEQ ID NO: 668250 - DNA, 246 bp, Homo sapiens
agtaggtgggacactgggcagagaacacctatgtgcgggtgggctgtgtgggcacaccagcatgtcatggcgagtagtctgtgggagtgagacggagtgtgagggtggagtagtccctgggctgctgtggtctgagtgtgcagtgttcatgagctgggtcatgtgagtttgtagtctctgtgttgacgggtggatggattgttgcttagcaccgctggtggtgtgcactgtgtgtggctctagggt

SEQ ID NO: 668251 - DNA, 179 bp, Homo sapiens
agatttggttagttcacaaagaacagagtccagaagcgagtgcatctgtgataagtgtgaagtgtttgtacatcactttaaatatattacgttaagtatattctaaggttgctgtgttggagcagtaatactgtatgttttacaaactggcaagaattcacgacaaaccttttaactat

SEQ ID NO: 668252 - DNA, 402 bp, Homo sapiens
gtcaggctgatactcttcacaaaacatccaagaaaccacccacacaatagccatggtccaatggttggggcacaacccctttatatttctacaggtgctacattccaaaaaatgttttttcttataaagcatggcaagaattctacacttagggaagaaaagaggttaaagaagggccttatttttcccgggggagagaaaagactgaaacctctttcagagaggtttacatttttaaaatgtatttattttatcaaccacaggctggcaagtcaaacatctcctcaaagacatttggcagacagagatattctggaaacacactggaggcagcttatttatctgccgctattacaagactagcccgaagggatgagtatcagatgctatctcccactgaaa

SEQ ID NO: 668253 - DNA, 151 bp, Homo sapiens
ggagtcgagaggcgcgatgccggcttgcaccctccttgcgactggtccactgggtgatctgtcttcttctctgtccctatgcgactggagaaggacaggttctctgtcaacctggatgtgagcacttctcccgagggaactccgggttagg

SEQ ID NO: 668254 - DNA, 691 bp, Homo sapiens
atcttggcctgcaggaacatggcaagggcgagtgaagcagtgtcacgcattttagaagaatggcataaagccaaggtagaacaatgaccctggacctcgctctgctccgtagcgtgcagcattttgctgaagcattcaaggccaagaatgtgcctcttcatgtgcttgtgtgcaacgcagcaacttttgctctaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcgatttacagatattaacgactccttgggaaaactggacttcagtcgcctctctccaacaaaaaacgactattgggcgatgctggcttataacaggtccaagctctgcaacatcctcttctccaacgagctgcaccgtcgcctctccccacgcggggtcacgtcgaacgcagtgcatcctggaaatatgatgtactccaacattcatcgcagctggtgggtgtacacactgctgtttaccttggcgaggcctttcaccaagtccatggtttcagactgcctggtagaaggaggtcacttctgattgtcagtgactttgagctgagtgctgaaataaaatgataaacaagtcaaaaa

SEQ ID NO: 668255 - DNA, 554 bp, Homo sapiens
tgtcgaccacgaagacggaatggggtaggagaggagagtctaagtggctcctgacaagtccaccattgtaagagaatcccatcccttgagacgtctccctctcgactcctccaaggccggtatcaacaaacattagaatcccgagacccgaaccgactttgtactgccataacgaaccaaagtccgaactgtgacggtccgcggataacgaactggagacaaatttactccctgaagttctgatctgtcgtaccgagaaaagtcaaataacgtacttcctcaatgtgatcaggttcaattttcgcctggggtttaccaatgtaatatgttcgacactccaaaaatttggacactgttccctctcttccctttaagatgagtaacgttcctttaggagtgaattcgaagtcactcggtgttcgtgaattttgggtacttggaagtcgactagcaggaatcggtcaggttagagatgctccttgaccgtatacaagaacgcaaccagtgggacatcgacttaatgaagaggtataaggcctacgagttaatgtcat

SEQ ID NO: 668256 - DNA, 130 bp, Homo sapiens
ttgttatagggatctcgtcttatctcgtacttttcagttccttttgtttacgactgtctctccctcctgtattctcccttttactcctttgacaatttcttcttgtcctatttcactactccttgtgttc

SEQ ID NO: 668257 - DNA, 154 bp, Homo sapiens
ggggggggtttggggggccggccctttttttttccccctggggggaatttatttggggggggagggggggggggggggattttccccccccccccctccccctttggtttttttaaaggggggcccccgggatttttttgcccggtttttttta

SEQ ID NO: 668258 - DNA, 215 bp, Homo sapiens
acgctcctcccatcttgtttcctttcattcctcttgacatgacaacaagagtatatgggaaaagaaaactgaaaggcaaattgaatacagacagagatatcaataaaagtggtccattgagtcttacggcgccggagagatacgctccatttacaatatttactgacagatatattgctgcctgtctatttttccatctcttgcctttcatcgat

SEQ ID NO: 668259 - DNA, 449 bp, Homo sapiens
aaaccaagaacccagccaatatccccagaaattgacaagatgatcctaaaatttatctagaaacacacgggacacagaacagccaagataattttgaaaaataagaacgaaggactcatacttcttgatttcaaaactgactacaaagctacagtaattaacactgtgtgagactggcataaggatatgcatatagattgataaaataaaactgagaagcccttgagaaataaaccttatatatatggtcaactgatttttgacaataatgacaagaaaattcaataggaaaagaagttatttcaacaaatggtactgggacaactggatacacacatgcaaaaggatgaagttggaaccttacctcataccatatgcaaaaattaatgctaaatgagtcatagacctatatataagaattagaactataaaacttatggaagaaaaaa

SEQ ID NO: 668260 - DNA, 208 bp, Homo sapiens
gtgtcgcgtgtacttcttattggggctgctttaggcctactatgggtgttaatttttactctctctacaaggttttcctagtgtcaaagagctgtctcttggactaacagttaaattacaaggggatttagagggttctgcgggcaatttaaagttgaactaagattctatcttggacaaccagctatcaccagcctcaacacaagct

SEQ ID NO: 668261 - DNA, 132 bp, Homo sapiens
  misc_feature (113)..(113): n is a, c, g, or t
tcccttacgactattgggctgggaacctgtctattcccattcaaagctcaccatgtgggaggactgcttgggcctgggaggttgaggctgcagtgagctgtgattacaccacnttcactcccagcctggagt

SEQ ID NO: 668262 - DNA, 223 bp, Homo sapiens
  misc_feature (33)..(33): n is a, c, g, or t
  misc_feature (52)..(52): n is a, c, g, or t
  misc_feature (179)..(179): n is a, c, g, or t
  misc_feature (190)..(191): n is a, c, g, or t
aattggcccccctagtttaccggaccggtcttncccgtccggaacgtctttnagggggagaaagctcgagtcatccctggggaagagaacaatttcaaaaccttcgctagtctccgtttggcccgttcccacccccggctcttcggcattcgggccaaaagaccccgggaaccccccgnacgggttgttnnaaaggaaaaataaaacccccctggggccttgg

SEQ ID NO: 668263 - DNA, 559 bp, Homo sapiens
gctctctgttctgcaagagctgcaaactccagtatggggtaaggaggctccacatcccgagcttgcgtagtggttctgtgtggcgctgagcgaatttggaagacctcaaatggctataactattacaatgctctcacgccaagttcctgccctcagagtggtcacattgctaagcaagaaccagtaccacagatgctagatcgctcaagaggtcccgatcagaacgcctggtcgcagaaagccagaggcttgtggattgatacttgaaaggaccacgagaataatctcaaagcgactgtgaccaagaagatctagaacagagactcgaggaagtccagttctggaagaaggagttagatgacaaacttgagcagcttgtgaatgtaactgatgatctactcatatataagatcagattggaaaaagccctggagacctggaaatgagcccttgtcgatcattcactgagacatgcctgggcatacagggagaagcgctattggcattgacctggtgcacgacacagtggagcatgagctgataaaggaggctgaggatc

SEQ ID NO: 668264 - DNA, 1199 bp, Homo sapiens
aaacattgggtggagactctcacttatgttaatgcaatcttgaaatgactgaaaggtagattgccagcacagctagagtttcccagcctgctcccccatccacacttggaacattgagggagcatgaccgctctctgacttcacatgttaatagaggatcagagcagagcttgggagctatattcggtcagcgatcatagagaacagaagcacaacagcttgctcagccatgagatggccaggtatccagtatttgttcaactctctattgggaattctcttttctcagccgtgttcactcagctatagtagccattatgtcatatatcgatttcgtattacaagtactcttcaagtatacttaagtactgaaggtactggctacttagtctaggtctagcctgcagggctgaaaactgccaactagatgaacttaattctacgctaaccataacaatatgcaatcccttgtcagaaacaatactgacttacctagcagatctacactcagagcccttgatgccataccaggcgttactcatcacacgcacgagtacaaccacacgaagggctcctcttagcgcgttctggaaaaacaataacacaggaccgatagttccacgggcacccacgaccctaattcacctcagtaaaggtaggtcacccaaaaaggccctgatggtaaccataaactgaccctgcaacgagcacaaaaataccaacacattaataaaacaagctacatcaaacgttaacaacccatccacataaactactccagccttattatccaaacaactatacacacattatatctcacatttatacaatatccacaaaccacacataaataaagcaaacaatatccaaaaaactagattatacaagcgccaatacactgtacacatacccatcataaaaccacacatgaaactgcctacttatcacaaaaatcatataccacacaaatacactacacacagagtcacactctatctattttcaaactccatcatctaaatatacaaataactaccatacacccacgtttacacacaagctaccataaaacatatgaacaaataaaaacaccacaaattgaagcaactacgaaatacacagaacactaaatgtatacccactaacatcaccatatctactctccaacaatagatcaaacataatgcgacactctatca

SEQ ID NO: 668265 - DNA, 4433 bp, Homo sapiens
caagacgtggcacgggtgggggcccaggacgcaggagcctgggctgggcaggcagctggctaagggcaggctgttggaataaaggaacacagatctcaggtgtgagctggtggtgttggcatctcaagcaggtctcacttggtgtgtcagggggcacctaggggtgtggggggccagcccacactgggtgaagggttgggcacagggctgactgtgggaggggacaactgcccttcagaacccaaggccaggcccacatggggtgtgctggaccgagcctcccaagctggagccagctccataggccctggagacttgcagtcccgttctgcttgctacacccggaccacccgggggcacggcgctttctaggcaggcctgcccccggcgaccggggctctgtggtcccaggcagatcctgagccctggatagcatagacctggaggaaaacctgcctctgagccccaggtggctgtgtgaccttggggagacagcatcctcctctgactggggctgctggagcactgacccaagtgttagggttgacctagccccaggcatcttccccagggatggccgcttcctcgcaccctgctgctggccttccatcctcatccttctttctgggggtctgcccgcccgtcatcactggcttcttcctcttggctggcttggtttcaggggatagggcagggctggctgccactcttttaatttattttatttatttgagacagagtctcgctgtgtcgcccaggctggcatgcagtggcacagtcttggctcactgcaacctccgtctcctgggttcaagcgattttcctatctcaacctcctgagtagctgggactacaggcacctgtcaccacatctggctaatttttttgtatttttagtagagacggggttttgccacgttggccaggctggtctcgaactcctgacctctggtgatccacctgcctcgacctcccagagtgctgggattacaggcgtgagccaaccacttgggctgggctctgtactgtcctgaatgacgggctggcactgtcctgctccaggtgcatatggccgggcaggagggcagaggctcagggctggtgtgacctcttcttccagacccagtcccccttctctgcctcttccctctccaatcccagagacttggcccctgtacctcatcccaggcctgcccagggggacctaggggtcagaggcggatggcctggctcctggcccctagtcttgtgtctgctggggcttcctgctcgtagcaagggcctgtgggttccagctctgcagcccaagcctgggggattgcatgcctcactcatgggcttacagggcccaacccctgacgcctgcctggcccctggtgccagctggacctgtgtccctggctgaagccgggctggcgcccacccagtcagcctgcactggcgttggcagtgctgaggcagcatccgggcgtcctggtctgcccttgtccctacctgccttgtagaggcggctcagcgaagcccaggcttctggcccctgggacccctgggttggggcagagcagaggctgccctggccccaggctgctcctgcccagtgcctctgtgggaccaccctctgtggtgggctgggggggcctggaagtgaggccccgccctctccccgaagctgtgtgcggcactggccaggtggactggggccatggctggcttccttccaaggtttctggagcgggagccgcccaaaacctggacctggcctacccaaagtgcctgcactccttctgcactcctgggatgggtcccagaaccttctggaatgatctgtggctggtatgtgagcagccaggtctgctgccgggtgactgggcagcgcccttggatcctggtggggcctcagcctgcagcctgctctccccttttagggcggtaagtcggggaggctggcagggaagtggagaccgcaggacttgggggtgggtgggagggggtggcgagggggtgtgtttgctcctcctctcctgcctgctcccacccctggcccttaccttcttgggaactgtggtgattgccttctgtcaggtgtgttgaagcggccgtacccatggtggaggcctttgctcttcttgtggcgtgctggggtgggcaggtgggctgcagccccagcaccagcctgctccagctcccacaccgcccacagacctccctgtcctcatattctctgaccgcaggcctgcctgcctctgctctgctccgccccagaggggctgggttggacctggtgttcaaggccattcctatctgccccccagcccactgctggagccccaggcccctgcagcctgctccacactctgggttcccgggggaagcaggggtagagtggggcaggattcaggtgtagagggcctgtccccagcaggggtccccttgccccgggcccagggtcactggtacagatagcccatgtgcgaacctgggaggccttccgtgtgtgggcagagcagctgctgtgtcctggccattctccagccgcctgtctgtgggcactgtgggcaggtacctttgtgcagggccatggggcaggcagggcggggtctcctggccctgcctgacccttcacttgggaatgtcaagtgtggctcagctctgccttctctgccacctgggtcactaggcagactcctcactgccttagggggtccctgaagttacaggggatgggttttccctcccccagagcctggcttgctccttcgtttggggcctccccgtccgcctgcagtccccggatacagcccgcattcagtgagggctgtggggcagaggtctaggcttgagaggcacctggacctgtccctgaccttgttggactggcagtggggctggtgtgggggacagcggatgtcctcagagccggggggcagctcttgcctggcaggcagggcctggccgtgcactggttgggggctgccctgcactgcagaaaggacaggtgggctgtggcgtccgcaccacaccagggtgccctgctcatcgctctggccagagaacctgggcgcaggcaggggagggctgcaagggcggggcgtgagctaggcgttgggccgggtgtcggcgctgggtccagctgtccatccgactgtctgtccatggggtcccgtgtgaggttctaggccagctgccgtttgccttccagctgctgcggactctggagcgtgagaaccagcgcctggaggctgtcctggcgtggcggcgctctgagctggtcttctggcggtggatggtgaggaagcccgcgcatccctctcccggcatcccttcccacagcagcccccaggtggggcattcgggatcttcctgttttccagacaggaagaggggcttttagggaggccacagacctagtgtaggctctttctaggacttccactcgccttctggggaggctcactgctgcccccgccctcagctccatggccttctagagtgtggcctttgtgcctccctggacgtcacagttgctgagatggtggcatccagcccgctgtgggacctgggggactaccactgccctctttgccctctgtccctctgtccccttggcttggtgcacgctgtctcacttgggtctctgtaggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgcc

SEQ ID NO: 668266 - DNA, 710 bp, Homo sapiens
  misc_feature (295)..(295): n is a, c, g, or t
gatcaaaattaattaacatgacttaatctacaaatgacaaaattataatccaggtcttctggttgaaatccagtgctttcccacaatgcagataatttagcacctaacgttagccttttaaataaaaggacaaagagttcttggaatgctagcgtcttaaagatagtccaaaggaattttcaggtgtgctagcttgtccccttcatttcatttttttcccctcaactcttattcactgcatgaatgttaagaaatagcacagcagtaggggtaaagattttcatgtactgttctntgttatatcaagtattattttgtataattctttcaaattcttgtggataagcacataatcaagattcaatttggtattctgtgtattttatcaagttgaggaaattaacccaaaagatttaagttcctctgtgtttgtagaagaagctagtaatgacagtagtaccataagccagtctagtgctttctaccaaacagactgcctaagagaactatggttatgctgcattccctcgtagtagaagagtagcccagaaacacatggacaggccagatccttattctctgtaggcacattcttttatctatttatttattttacagtatctgagtgatcaatgtgtatattctggtctccatcaggattatcttggagtctgttcagagccagtgatcaaagacaatgtagtggaggg

SEQ ID NO: 668267 - DNA, 1695 bp, Homo sapiens
gaggttccagccggagcggtaactgggcgcaggtcccagccgccgcactaaacccggcccgtgcggtgattggacgcaggccccgggccgcggcggaggcgggcgatccgaaagaggctggtgctggctgcatggggaggcggcggcagcgggtggaccccgcggctggggcccgggccggggccctgcctgaggccatcgccgcgttgagtcggtcgctgccctcgggacccagccccgagatcttccgccgcgccaagttcgaccgtccggaggcgacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagatccacctgtacacacgcggctgccacagcgaccagagccttagccatctgtctgtcactgaagcagagatgctcagggacccagagggaggccagcagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgcc

SEQ ID NO: 668268 - DNA, 311 bp, Homo sapiens
aggactcctacgtaggtgatgaagcccagagcaagagaggcatcctgaccctgaagtatcccatcgagcatggtatcatcaccaactgggacgacatggagaagatctggcaccacaccttctacaatgagctccgtgtggctcccgaggacaccccaccctgctcacagaggcccgatgaccccaaggcaaccggagagatgacttagatcatgcatacagaccttaatgtcctgcatgtaagtgccatcaggagtgtatcctgtatgttttggggaaccaggatgctccggatcagggatggatagtcc

SEQ ID NO: 668269 - DNA, 171 bp, Homo sapiens
  misc_feature (36)..(36): n is a, c, g, or t
gtcgcctctacgacggactccccgtcacactgaccncactctgcccaaccgcgggcttaaccactcaacgaccctggacgcacccgacggacttcaacgctgacacactctgggactgtgggtgggggtacccgacgctcgacacttcgtacactcactggtcactacgcg

SEQ ID NO: 668270 - DNA, 2418 bp, Homo sapiens
gaggttccagccggagcggtaactgggcgcaggtcccagccgccgcactaaacccggcccgtgcggtgattggacgcaggccccgggccgcggcggaggcgggcgatccgaaagaggctggtgctggctgcatggggaggcggcggcagcgggtggaccccgcggctggggcccgggccggggccctgcctgaggccatcgccgcgttgagtcggtcgctgccctcgggacccagccccgagatcttccgccgcgccaagttcgaccgtccggaggcgacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagatccacctgtacacacgcggctgccacagcgaccagagccttagccatctgtctgtcactgaagcagagatgctcagggacccagagggaggccagcagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgccgctggccctccccctgccaccctgtcgggtttccctgtttgggggtgggagcgtggaggagcccctggcagtggtggccagtgtagggctggccaggtgctggaggacatgcataccccagcactggtgagtggcaggaccacggggaggtggcacaggcctccctggagcgggattatctcggcccgcccccttcatttgggctcccgctgtgggcctggcctgggctgtgagcacagctgcccccgctccggccatggctgtgcctggtgggtgcgccggatgggagcccggggctctgctccttcccgggaggtggtgctccgggtggggaggcacagatggacagaggggctttgttccagaggctgctcagaaagctcagtcatccctgacaagagcatctgtgtccgggggacgtgcctcagctggcggaggagggtggctcatggacccccccgcccgcacaagagacagcaggtgggctgaggctcaagcctgctgcttgcgggtcccctttttggggctgcgatttgactgagtggggccatgggtgtgggcactcaggctgggcagcccgggcagcgttcctggcatgctctggggttctgctggtccactggccccatgggtggggccgcagggactatcgtaggcggggcgcgcgacgggagcctagactctaggggtgcaggctccccgcggtcccctcggtgtgtaggc

SEQ ID NO: 668271 - DNA, 163 bp, Homo sapiens
tacatacaagatgtcttcagcttccccccatgactgtatggaggcttcctgccttacagtgccatcatctgtggagctgtactacatctttgccacagtatgggtgtcgggagcagtacactttgtacggcatcctcttcttttcatcaacaccaggaatttt

SEQ ID NO: 668272 - DNA, 1684 bp, Homo sapiens
gctgaacaaggcgcagagctgctccgccatctcccccacgcctcctgccaagttctgtggcgccgcggttccccacctcctgctcccatccccctggctcccgccgccctgtagctcggcagccctgccaggagcccggaagtgggtccgcacgagacagaatagactacactcaaactccagggaaccgttcattgggcttggacacgaaggcgggaccctgccgacgcagtgattggatgcatgtccggccagcgcggtgattggacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagatccacctgtacacacgcggctgccacagcgaccagagccttagccatctgtctgtcactgaagcagagatgctcagggacccagagggaggccagcagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgcc

SEQ ID NO: 668273 - DNA, 746 bp, Homo sapiens
  misc_feature (27)..(27): n is a, c, g, or t
  misc_feature (96)..(96): n is a, c, g, or t
  misc_feature (199)..(199): n is a, c, g, or t
  misc_feature (251)..(251): n is a, c, g, or t
  misc_feature (257)..(257): n is a, c, g, or t
  misc_feature (299)..(299): n is a, c, g, or t
ggcttaagtcctcggagtaaccatagncactcgagattacccagtaggcgcgtcgcacgaatttctcagtgtagaagcaagtgaacgctacgtacntatctagcatttagaaacacgtatcacgtagatgcactcgatggctacgcaacgaacgtgacagtacgttgctgagctgcgtgtgctcgacacatcgcacagncagtcccagatcgagcacgagtcgcacccacatctttacgtcttggcacacnctgagnaggagattcgatcaccgcaataccgcgtacaaaatcaatggnacgtgcaatatagatctaacacgctgcttgcgcgagcgacgaatgtatgatggatagagggatcattggttcgccgattgtgagcgaacttacgtatagcacaggtgacaatctccatatgagcgcatatttgaagaagaaggatgaatctcacgacggcagcagcaagtatctgcagtccatagaagagcagtgagaaacgtggacgggctctacgattgcattgctctgtgcctgctgtagcaccagctgccccagctactggtggaacggagacaaatatctggggcctgcagttcttatgcaggcctatcgctggatgattgagctccagagatgacttcacagaggagcgcctggccaagctgcaggacccattctctctataccagtgccacaccatcatgaactgcacaaggacctgtcctaagggtctgaatccaggta

SEQ ID NO: 668274 - DNA, 1676 bp, Homo sapiens
acggagggcgtgcggggagggagaggaggggcttgctggggggggggccccgaggcggggccgggagggccgcctggaagaggaggtcgggggcgaaggaggccgagaagaaagccctgccaggagcccggaagtgggtccgcacgagacagaatagactacactcaaactccagggaaccgttcattgggcttggacacgaaggcgggaccctgccgacgcagtgattggatgcatgtccggccagcgcggtgattggacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagatccacctgtacacacgcggctgccacagcgaccagagccttagccatctgtctgtcactgaagcagagatgctcagggacccagagggaggccagcagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgcc

SEQ ID NO: 668275 - DNA, 514 bp, Homo sapiens
  misc_feature (5)..(5): n is a, c, g, or t
  misc_feature (294)..(294): n is a, c, g, or t
  misc_feature (420)..(420): n is a, c, g, or t
tggcnttacttctgcatctgtgtgatgtcaatacaacaacctggcttacctggagccattcacaattcgtggagtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggaggcgagccccaccccgccccggcccctcctggactcgcctgctcgcttccccttncccagcccgtggccaacccagcagtccttccctcagctgcctaggaggaagggacccagctgggtctgggccacaagggaggagactgcaccccactgcctctgggccctggctgtgggcagaggncaccgtgtgtgtcccgagtaaccgtgccgttgtcgtgtgatgccataagcgtctgtgcgtggagtccccaataaacctgtggtcctgcctggca

SEQ ID NO: 668276 - DNA, 1743 bp, Homo sapiens
gctgaacaaggcgcagagctgctccgccatctcccccacgcctcctgccaagttctgtggcgccgcggttccccacctcctgctcccatccccctggctcccgccgccctgtagctcggcaggtgcagtaggcgctccgaggaggaggccccttagcttcaagaaacccgcgtgggcggagccctgccaggagcccggaagtgggtccgcacgagacagaatagactacactcaaactccagggaaccgttcattgggcttggacacgaaggcgggaccctgccgacgcagtgattggatgcatgtccggccagcgcggtgattggacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagatccacctgtacacacgcggctgccacagcgaccagagccttagccatctgtctgtcactgaagcagagatgctcagggacccagagggaggccagcagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgcc

SEQ ID NO: 668277 - DNA, 1598 bp, Homo sapiens
taccatcgggttataaggtagagaggacatggcgtggcgctggcgtgcagcgagggtggaccccgcggctggggcccgggccggggccctgcctgaggccatcgccgcgttgagtcggtcgctgccctcgggacccagccccgagatcttccgccgcgccaagttcgaccgtccggaggcgacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagatccacctgtacacacgcggctgccacagcgaccagagccttagccatctgtctgtcactgaagcagagatgctcagggacccagagggaggccagcagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgcc

SEQ ID NO: 668278 - DNA, 1795 bp, Homo sapiens
gaggttccagccggagcggtaactgggcgcaggtcccagccgccgcactaaacccggcccgtgcggtgattggacgcaggccccgggccgcggcggaggcgggcgatccgaaagaggctggtgctggctgcatggggaggcggcggcagcgggtggaccccgcggctggggcccgggccggggccctgcctgaggccatcgccgcgttgagtcggtcgctgccctcgggacccagccccgagatcttccgccgcgccaagttcgaccgtccggaggcggtgacgctctcgcggagggcaggcgggccgggtggggtcccgggccctcgcagggagttgggccggctccgctgacctgcccgctttttattttccgcagacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagatccacctgtacacacgcggctgccacagcgaccagagccttagccatctgtctgtcactgaagcagagatgctcagggacccagagggaggccagcagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgcc

SEQ ID NO: 668279 - DNA, 166 bp, Homo sapiens
tgctgtgattatggtcctgcattgtctatatgtaggctgctcatgtcacgtatctgtcattgctgtgaggtgagctgttacaagtgatgttgtctgctattgcttagtcgagtgggtggctgcagtcaagtgtcttgcattgcttggtggggtgggctggctataa

SEQ ID NO: 668280 - DNA, 101 bp, Homo sapiens
gtactttttttattttttaataggaaagtgatgtgcttcagagaggggttcctccttaatgttgaggttttttaaaaataaaaatcctgtttttaagctca

SEQ ID NO: 668281 - DNA, 1684 bp, Homo sapiens
gctgaacaaggcgcagagctgctccgccatctcccccacgcctcctgccaagttctgtggcgccgcggttccccacctcctgctcccatccccctggctcccgccgccctgtagctcggcagccctgccaggagcccggaagtgggtccgcacgagacagaatagactacactcaaactccagggaaccgttcattgggcttggacacgaaggcgggaccctgccgacgcagtgattggatgcatgtccggccagcgcggtgattgagcgcggtgattgggtacaggtctcgggagcgcggtgattggacctccgcgctctggcagctcctcttccgtgtgctctcgccactccctgcgggcaacgccttggcatcgctcgccctggggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagatccacctgtacacacgcggctgccacagcgaccagagccttagccatctgtctgtcactgaagcagagatgctcagggacccagagggaggccagcagctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgcc

SEQ ID NO: 668282 - DNA, 1901 bp, Homo sapiens
gaggttccagccggagcggtaactgggcgcaggtcccagccgccgcactaaacccggcccgtgcggtgattggacgcaggccccgggccgcggcggaggcgggcgatccgaaagaggctggtgctggctgcatggggaggcggcggcagcgggtggaccccgcggctggggcccgggccggggccctgcctgaggccatcgccgcgttgagtcggtcgctgccctcgggacccagccccgagatcttccgccgcgccaagttcgaccgtccggaggcgacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaagatccacctgtacacacgcggctgccacagcgaccagagccttagccatctgtctgtcactgaagcagagatgctcagggacccagagggaggccagcagtttctggagcgggagccgcccaaaacctggacctggcctacccaaagtgcctgcactccttctgcactcctgggatgggtcccagaaccttctggaatgatctgtggctggtatgtgagcagccaggtctgctgccgggtgactgggcagcgcccttggatcctggtggggcctcagcctgcagcctgctctccccttttagggcgctgctgcggactctggagcgtgagaaccagcgcctggaggctgtcctggcgtggcggcgctctgagctggtcttctggcggtggatggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgcc

SEQ ID NO: 668283 - DNA, 123 bp, Homo sapiens
ggcgttccttgattcttacgaacgctgggtctatggctcatgtgataaagtagtcatgtgtaggtttatctagataggaattcgagcttctcagatatggcaaagcaagaaaatgagcggccg

SEQ ID NO: 668284 - DNA, 430 bp, Homo sapiens
cggactgattttcttcaaagcttctcttagtctcctttttttttttaagacagagcttcattcttgtggcccaggctggagtgcaatggcgtgatctcggctcaccgaaacctcctcctcccggattcaagtgattctcctgcctcagcctcccgagtagctggcactacaggagcgcgccaccacacccagctaatttttttgtatttttagtagggatgggatttcaccatgttggccaggatggtctggatctcttgaccttgtgatctgcccgcctcccaaagtgctgggattataggcgtcagccaccacgcccagcctgtttttcacgttcagtacagctttcaataattcacatgggatattcactactttattataagtataggcttggtgttagatgattgtaatcaactataggtaggct

SEQ ID NO: 668285 - DNA, 110 bp, Homo sapiens
cagggtctgatcttatttgtttgttacccaaacaatcttatttttggccggattcagacttagaagtagaagctcgcagagaggacagtctgcgtctattcgcaatttgt

SEQ ID NO: 668286 - DNA, 429 bp, Homo sapiens
atctggccccatgtggatcttggtggccctggcacttttctactctgagcccagccttctctgtgtgtaaaacacggattgtggtgcctacctctcgcgcttgccctgcagatgcgccggctgagccacaccacagcggctgggcaggttcagccccctctctcacctctgccgctcctccagcaccacgactcggttgggaacagaggaaggcgaggagcgccatccgcttcctgctctctgcagcatccggcatttcgccacatgctccctgatgccacggttctcaaagtgtggtccctgtccctggcctgggacgcatcagcttcctgtggggactctagacatgcaagttctccggccccacactagactgcctgactcagacactcggcgcgctggcgctctagcgatctgtgcgttaacacc

SEQ ID NO: 668287 - DNA, 241 bp, Homo sapiens
  misc_feature (183)..(183): n is a, c, g, or t
aggatcctttcccaccagcaagacaatagctttacctctaggcataggctgtgtgctgctgccagaccctctggccaggatgagggggtggtctgactcaacatgttacttgaacaagccaacttggtctttttctggactgaagcctgcaggagttaaaagggcagggcatctcctgtgcantggtgaagggagagccagctccccccgacgggtggggcaatttttggttgaaggggcc

SEQ ID NO: 668288 - DNA, 136 bp, Homo sapiens
acgcaggcggggttgtgctcaaatacatcgcgcgggccaaagcccggggtctcggcgtcatcttcatcacccacaacgtccaccacgcctaccccgtcgccgaccgcttcaccatcctgaagcgcgggacgagcta

SEQ ID NO: 668289 - DNA, 760 bp, Homo sapiens
agcggttcacggtgcccatcacggatgtgacggagaacgccctcaaggacctggacgacgtcatgaagaccaccaaaatcattatcggctgcttcgtggccatcacgttcatggccgtcggtgatgctcgtggccttctatcaatgctgcgctagagcagctgccagctccactagcaccacgggcccacgcgcaccgtggagatcatcaacgtggaggacgagctgcccgccgcctcggccgtgtccgtggccgccgcggccaccgcggccagtgggggtggtgtgggcggggacacgccacctggccctgcccgccctggagcgagaccactctctatcgacgctaccactacgtggctgccgccttcgatggcgcactacagtcgagcaacccctagctggcgggggctgcgggggcgaatggcccgcccctggtcctcaagtccatccagcgaaaccatctgcgtcttcaagagcggctccaaggagaacgtgcaacgagacgcagatctgatggcggcggggccgggcgggcgaggggcgtggagccccggcatcaggtcccaaaccggacgcagtacatgaccgggaacccctcccttcaccaaattcagagtgcagcgaactggagtaccgcgcatggcaagagtaggaggaagcgcatcttacataacatggtcatgcggatcgggtaaccgctaagcaagcgtatagacgcgaggatcaggagagagagcgacagggaatctgcgtgacac

SEQ ID NO: 668290 - DNA, 660 bp, Homo sapiens
agcggggcgggtcacgaggtcggaggatccagaccatcctggctaacacggtgaaaccgcgtctctactggaggtgcaagaaattggccgggtgtggtggcgcacacctgtagtcccagctactcgagaggctgaggcagtggaatagcttgggcccgggaggcggaggttgcagtgagcggagatagcgccactgcactccagcctgggtgacagagcgagactcaatctcaagaaaaaaaaaagttcttccagctagaacatttatttttggacgtacatctccacaaaatgggagctatactggttagccagtatcctaatagtatagtgcagttggcataatggattaccaagctgtgaaactggaaatgtcatatgcactttcgtgttgtatcaggcagatactaaacattgtcccctgtgagtcagcttacaatttttcctgtgcttttgaaaatctcacgcagttgtatactggagaaaaattagacgacggtagaagatattggtacttattagcgtatcatcagaactcagcacagtcggccttataagaaaccaaataattttgtgatgattaactcttggagatggtcacttctgggctcttcctggatttcccagccgtaacagtgggtgtaacgcacaaccttcacc

SEQ ID NO: 668291 - DNA, 339 bp, Homo sapiens
agtgatgtgcgcagtacacgaaggacggagctgtatcgcagtggcgtgtgtgctgaagattggggagacaccccacatcagaccgcgcgcatcatggaataatgccaatgttctggcccgttatgccagtatctgccagcagaatggcattgttgcccatcgtggagcctgagatcctccctgatggggaccatgagttgaagcgctgccagtatgtgaccgagaaggtgctggctgctgtctacaaggctctgagtgaccaccacatctacctggaaggcaccttgctgaagcccaacatggtcaccccaggccatgcttgcactcagaacgttttct

SEQ ID NO: 668292 - DNA, 306 bp, Homo sapiens
ccgactagacgtacacagacatggcttcatacgcacaacacattacacagacaactcaatgtcaacactgagtgaagaatatcaacaccaaatagtcaatatccatgacacattatagagaagctatagcacgacacatgcttcagatttgataaagtttctttatagatacaaacatagacatcccctattaatatcatataaaacactgacgcacaccggagcagacgccgaaatcatgatgatggttagagaaaaacaatctcacagctatcctaacaaaaccttgtgtactaccgctaggta

SEQ ID NO: 668293 - DNA, 433 bp, Homo sapiens
  misc_feature (244)..(244): n is a, c, g, or t
  misc_feature (426)..(426): n is a, c, g, or t
cagacatggtcctgcccttgtggagcttgcagtctactggtagctggtaagatgacaaaagttctgtagagtgaaagaatgagtgattgacatgctagaatactttccaggcagcagcaggtatttaagaaagtgtggttgaggccgggtgtagtggcttatgcctgtaatcccggcactttgggaggccaaggtgggtggatcacttgagctcaggagttcgagaccagcttgtgcaatgtgnagaaaccctgtctctaccaaaaatacaaaaattcattgggtgtggtggcacatacctatagtaccagctacttgggaggctgaggcaggaggatggcttgagcccaggagtcagaggttgcagggttgcagtgagctgagatggcaccactgcactccagcttgggcaacagagtcagaccntgtctcc

SEQ ID NO: 668294 - DNA, 295 bp, Homo sapiens
gtcagctctaactgttaaagaagggtctacaaacatgattctaggcacatattgcccatcaggtgataaattcttatcagtggtttcatgcataaggtttagcatgatgaacttattctgagccatttcttgtatttcttcattttgggcaaatactttctttagtgcttgagagtattgacaatcctccaggtgatgaataaccattattggcttcttttttgagcataaaagagaccttcttcataagtttgtacccaagtgatgtcatctccccatcctgacttggccagtg

SEQ ID NO: 668295 - DNA, 365 bp, Homo sapiens
gaagaaaccgaataggccaaagttttcctggcatcagatctactgcccatttcctcccttcagaaagaacttggtaagaaattagaccaggtgcggtggctcacgccggtaatcccagccctttgggaggccaaggcgggtggatcacgaggtcaagagatcgagaccatcctggccaacatggtgaaaccccatctctactacagatacaaaaattagctgggcatggtggtgtgtgcctatagtccaagctactcgggaggctgaggcaggagaatcgcttaaacctggaaggcggaggttgcagtgagtcaagatcgcccccctgcactccagcctgggcaacagagtgagactctgtctca

SEQ ID NO: 668296 - DNA, 1365 bp, Homo sapiens
ggacaactcgaggttccgggccctgatgctccctggagcagagttgcatgagacttcgtctgtggggacagcagtggtgccagcgctgagcacctggctgacaagcggtactccgtagcacaaatgtggacttgcccttctttcctagagagttatgttgtgagacagtctagctgtctactccgcgcagggaccccaaccatcacgcgtgtgggcgaatgacaacccatggtagttcgttcggggaacggcaatgtgtcacacggagttgggacctactctgctattcgaggtcgattaacgtacaccacaagactccacatgtgttggattcatgaccttgggggaactcccgccgttctcacgactgtaatcaaggacttactgggagattactgcatgcgacgtcttgcgcctactgaggagagaggttgcgctcataatacccaacgttgaggcaacttgggaagctccctggtgttgatcttgcaaagaatacggtggaagtacttatccgtgttgccggtagaagacagacatgagttatcccttgttaagcgcctatccgtgaatggaaaggaaccgaccgaatgagttgtccaagcgcccgagatcataggtacgcgagcgcctagtggaccttgagtcgtcctgtgagaccacttattaccccagggaccccgttgccccttatcgcgggtgccttggcataccgggggagcaccagtggaggacaggttgcttaagctcaatttctctgagggagctatagggcttggaacgggggttgacttgtttatcattattagccacacggaagctccagtccattgagattaggagacaaattggcctgaacaggccatccaaaaggtccattattgggatcgcagtcgcataggagcaggtccattgtcgagttcttgccgcgaaccaccgtttttcagcctttccgcgggacttaacgaccccgaaaaaaaagtcaaggacccttgggggctatgctgcaaccttggcacgagagtcgaaccaaagcagacacaccaagagaccacgcgggtttcccccaagcgcgttcggtttaggcgttccaaaccggggaactttttgtgtacagtataagcaagcgaaaggaactagagggtcgggcccggggggcaacacattgggggaccccatttccatcggacgcccgcaactggaggccaccaaagcaccacagtacaaaagcgttgggcacttatatatgtcgccaagggcgcgacatagcagaccaagagggaggtggagcagaaaagtccaaccggggcgccccaaggcgagaaggacgggcagacatcgcgcgtggacgcaagggggggacac

SEQ ID NO: 668297 - DNA, 617 bp, Homo sapiens
actgtagtggaagacagagcaaggaggtagagatggatatctaccccttttttttttgggtagagatgaggtctcactatgtggccccagcggctctcaaactactagcctcaaacaatcctccggcctgggcctcccaaagtgctgggaattggcaggcatgaaccaccgtgcccagccctgggacaactttttatgatgaattgggttatgtatagcataaatgaacctctacactcaggatgctccggcggtagtctggaaggggtgttaggctaacttacagggactggggagaggggggcacctctctttggaaagccggagttctgggcagctctggaagtctggatatgctaaccctcttcccggtgatcctcaaacctgggtaccagtaccaaagggtagagagcttgccttaattcatggtggcctagattctccaacagggtaataatcatttgggggcactcgtaaaacctacgaatgccaagatcccttcccgggagtattagatggagggcataggggtggcacaggatgtctgtctgaccaagtatctcactgctcttatagagagtgggcaacatacttagttgcgtggatgggatctctaa

SEQ ID NO: 668298 - DNA, 152 bp, Homo sapiens
agccctgccacacaacagtctgagcaagagacccttggcagcccctgtttcgtggcagacagcaggtgcctggctggtgacccacggggctcctggcttgcaggctggtgattggtctatagaactgactacaaatacacggaatggattga

SEQ ID NO: 668299 - DNA, 365 bp, Homo sapiens
  misc_feature (125)..(125): n is a, c, g, or t
ctgatggtggaaccaccctttcggagccctagccacagtagaacggtcgtgggaatgtcaaggtggacttaagtttccctctttgtgcctttcgggcgccagaccctattttccaagctgctcanacataaccctggcaaacggttgcccctggcggaggttgcagctcaccctggggtccgggccaactcaaggagggttctgcctccctctgccctttagcctgctccttggttttttgtccctgtcatttttcagtgttctttgtatgtctgtgtatgtgttctgagaaggggtgggaactggaaactattcctagctccagttctaggggatctgatctctcttctgacctctacaggcaa

SEQ ID NO: 668300 - DNA, 828 bp, Homo sapiens
  misc_feature (42)..(42): n is a, c, g, or t
  misc_feature (77)..(77): n is a, c, g, or t
  misc_feature (247)..(247): n is a, c, g, or t
  misc_feature (308)..(308): n is a, c, g, or t
  misc_feature (491)..(491): n is a, c, g, or t
  misc_feature (584)..(584): n is a, c, g, or t
  misc_feature (595)..(595): n is a, c, g, or t
  misc_feature (597)..(597): n is a, c, g, or t
  misc_feature (602)..(602): n is a, c, g, or t
  misc_feature (680)..(680): n is a, c, g, or t
  misc_feature (689)..(689): n is a, c, g, or t
  misc_feature (768)..(768): n is a, c, g, or t
  misc_feature (781)..(781): n is a, c, g, or t
  misc_feature (797)..(797): n is a, c, g, or t
  misc_feature (805)..(805): n is a, c, g, or t
  misc_feature (820)..(820): n is a, c, g, or t
ctcctctcgtatctctttcctaatggctcccagcagtccctnaacaaagcccctttattccccttcttgtgcctccncatgagcttaagtttaaaaaaacaattagctttgtccctccaaactgtgggagcaggactagactttcctggcaggaagaaagctcctcctcggccagtttccgagcctggcccaccactcctcagttcttcttgctcttggcttttgtggccttggcatcaagcgtgcnctgggcatgagtaaggggcttaaaagcatcaagcacaaggactccaggaagcaccagcaanagggcattaatgaagaaaaagtaaaaccagaagtagagagggtggcccagccctccgtgctggaatccgtggcggtgctctgtaaggaagtagagcacatccccatagatctggcccacagaaaccacaagctgtagaatgaagcggaggggatgctgggggagaaaggggataaccaccaanaggctgagtggtccccacaggcaagccgtaatggtttccatgcacactgtaaagttgtaacccaggatgtatcggctgtttcccttggcatantctttccagantngaganaagaaggcttggcctccaagcaggttttcgtagtagagaacgaacaagctctcgatcaccaggggaattaacccacanactgcaaancagcacagggacagttgccgccaagtccccaatgggacaaccgcagcacgacctgaaaacagcaatgtggtcacgactnaaacccctgttanaaaaaagaggccagcnagtttatnccagggggggcggtnataaggta

SEQ ID NO: 668301 - DNA, 388 bp, Homo sapiens
tgatgctactgaaataagccagacagatgaggacatacactgcaggatccacccatgtgaggcccctggagtagtcaatccacagagagagaaagtaaaatggaggtggccaagggctgagggaagagagaagggggagttagtgtttaacggggacggagttttggtttgggaagatgtggagacagatggtggtgatggttgcacaatagcgaatgtatctaatgccactgaagtgtacacttgaaaatggttggccgggcgcggtggctcgcgcctgtaatcctgccactttgggaggccgaggtgggtggatcacctgaggtcaggagttcgagaccagcctgaccaacacggtagaaccccatctctactaaaaatacaaaaa

SEQ ID NO: 668302 - DNA, 302 bp, Homo sapiens
cgcttgcataccctatcccccacagtgagcaggcgccgtacgagtaggtgaaatgcaacttcaatgtggcggaggccctgcgagagctgcggttcaacgtgaaggtagatccgagatagggctctgtgcttggagtgaagaggagtagcaggaactttgagcacggcttccgtatgcataggaaagaactttcacctgatccaggccaacaaggtgcgcacaccggtcagtgggcaagtgtagtcgagtactactcactagtgggggaaagggaatcgaattcctgcagcccggggaatcca

SEQ ID NO: 668303 - DNA, 208 bp, Homo sapiens
tcccccacaatggcagagtataacaagacttcgcagtatctattctgtgatatgtacaacgataaaacttaaataatcacacaataagatatatttatagaaaagtctatcgattgttattactctcgcttcatgcttactgctacctcttactgcttctgcggccgcaggcacatataatagcgcaaagaactgttccgggacggtg

SEQ ID NO: 668304 - DNA, 469 bp, Homo sapiens
actaaattccccgccggtcgacgtaaaacgcactgctaccagagatttcaactggcgtgaacctgcctgaaagagaatcgtgaaaccttattgaagcagacataccggcaaaaggcccgttaaaaacactaatggcataatgccttattgataggcaacactagtcaagcaggtccagttgcaagtactcggcgaccgcttcggcgctgggatgcttgagcttgggcacccttcccaggcatggcgcggggagtcgctcagccagggttgcaaggttctcttccagacgagaggtcttgggatcgatgatattggctacccaacccgccagcggcaaaccgtcccgggcgatggcttcggcggtcagcaacgctagactgatacaacacagtcgcaccgccaccaccaggatcaccggcagcttcagcgcatggggccaggttccacagattgtccgatccgccagggg

SEQ ID NO: 668305 - DNA, 276 bp, Homo sapiens
cctttggccaaaggttgggggtaggtggcccaagtggggtgctctttaggtaaacaacaggagtggtcagagttccctcaaaggatcctcccctccagagccccttaaaaggccgggaccaaaggccctgtgttatgtgtactccccaactgtttggggtgggacatttttgtacttttcgatttggttatgggtcagccattacctgggtcagtccatgattttgttgtaacagttttaaaagtaaataaataaagctgcctgatgtcccctcca

SEQ ID NO: 668306 - DNA, 427 bp, Homo sapiens
gtgtcacccacccccttcataaattgttcctgaaaaatttagtaaaatccagcattgtgagcaccctacgggtgtaattataaaggacgaacatgtgaaagaactctggggtgagcggaaaagaagctagcataatcagctttctaatgttcttgttatacttttacttagatctgtgtgtttctacagcaacatgtttctaaattgctacctcaattcactgaaaaataaacattcagcaagtctcttttttttctggagtgaaaaaacaacaacaatatttgtttaagatgtaagaaaatatccaaaatctatttagatatagttttgtcagaaagaatatcacaaaatagaagccaatattccatattaactggcttaatacaatatgctattctataaaacccaaaaacctattccataagga

SEQ ID NO: 668307 - DNA, 467 bp, Homo sapiens
  misc_feature (108)..(109): n is a, c, g, or t
  misc_feature (115)..(115): n is a, c, g, or t
gttctagacggatccctcaagacgtatcagaagaaaggctgggatggatatgatgtacagtggggaatgtacgacggacttagatatagcatacagattgggaaaaannggtggngaggtgtgaaggctatgagtcctctgaagaccagtatgtactaagaggttcttgtggttaggagtataatttggattatacagaacttggtctgcagaaactgaaggagtctggaaaggcagcacggattcgcctctttctcggattataattataggtggtcctcggtggattcctgtaacatgagtggattgattaccattcggggtactcctagggatcgcctttgtagtctataagctgttcctgagtagacgggcagtattctcctccatcgtactcatgtgtatcctgcattttcccaccgttaccagagatgcaccaattcagtaggacctcctcccccaggatt

SEQ ID NO: 668308 - DNA, 155 bp, Homo sapiens
gattgtagacattttttgtagaggaaaaactctgaagcactttcacactttgttcaatatcagggaatttatattgaagagaaatcatgcacactgtagtaaatatggcaagccactttttcaaaccctccagcttagagaccagagttcatcct

SEQ ID NO: 668309 - DNA, 914 bp, Homo sapiens
ggattgcgcttgatgtctcacagaaagtactcccggctcccagtacatgggtcccgtcggcttcctgccatcggaagcgcagtcagcaggcatcgtgggaatgtgaagagcttccctaaggatgacccgtccaagccggtccaactcacagtactttcctgtggatacagacggctggcatgactcacatcgtgcgggaagtcgatagtgccgggatctcccggttgaacagagaagggaggtgtgctgggtaaggctgtgagcattgtagagacacccaccccatgggtgggtctgtaggcgtcattgtgcggctagcgtggaaaatctccctgcgaggactcctctcggcaaccatttccacagtacctggtcctttggctgcagacaatacttcaccgatgcattgacatgacaacgaaagcgtgcgctgtgtctactggaggaaattcggcgcactgaaaaatcctaaagggagaggcacagtgccccgtgtttacccatagataactgccacaataagatgcgcagagggatggcaccggagtgggtagacgcacatgccaggtccttgtgccaggaaatgtgcaacgttttctaggggccaccgtcacctcgtaaagtacaagctcaccttggttccacagtcctacttctccggttggcttctaactataggccccaacatccaccaagaacttgcaggcacctttgggttgtcgcctccttgggagcccaagaaagccgacacgtgcctctacacgtgaggagtaaggaggaatcgcaatcgcgctaggaaactgcgatgaaggggatcgtagcttgtaacagaggcacacttcgttggaacctgggcgaccccagtggaagcaaggcatttaaaaccaccgaaagagttaccctaggttgacacc

SEQ ID NO: 668310 - DNA, 470 bp, Homo sapiens
tctaagccctcagcatctcttacctagtctactggaatggcgcataatttgtctctctgcatccaaggcgggtctctctcaaatccatcttattaggttgtccaagtgtcaaacatgcaaatctgatcatgctctttctatacataaaatccttccaaggcttttctatatggacatcgttggcatcacccacagggtaaaattcaagtacctgggcaggacatacatggctctccatcatctggcctccccatctccacacaccatgcctttctcacctccactgctgtgccctctgcctgggcacacattatggagctccataatgtgtgcccagtcacgagggtctcttttctgaacctctgcaatgaatctcagcactttcatcttgctagtctcatggtaggaacggaggccccagaggaactcatactccggggggttgctgttgggcactcgtctgtagtcca

SEQ ID NO: 668311 - DNA, 260 bp, Homo sapiens
ccctcgaaacccagtaacaaactgtgagagtcttcacgttatgtacctattactttaaaaacaaccaaatgatttgggatattcatttcatgcactgtctcacattaatagaacagtcaagcaataaaagggaaattagaagttattggttaacgggtagcatttctgtttggtgagatgatgagatcctaaagtatgatggtgttcatggttgtttaacaatgtgaatgtatttcatgtcactactgggtttcgacggg

SEQ ID NO: 668312 - DNA, 546 bp, Homo sapiens
  misc_feature (30)..(30): n is a, c, g, or t
  misc_feature (76)..(76): n is a, c, g, or t
  misc_feature (78)..(78): n is a, c, g, or t
  misc_feature (93)..(93): n is a, c, g, or t
  misc_feature (110)..(110): n is a, c, g, or t
  misc_feature (128)..(128): n is a, c, g, or t
  misc_feature (132)..(132): n is a, c, g, or t
  misc_feature (144)..(144): n is a, c, g, or t
  misc_feature (150)..(150): n is a, c, g, or t
  misc_feature (297)..(297): n is a, c, g, or t
  misc_feature (315)..(315): n is a, c, g, or t
  misc_feature (333)..(333): n is a, c, g, or t
  misc_feature (400)..(400): n is a, c, g, or t
  misc_feature (403)..(403): n is a, c, g, or t
  misc_feature (458)..(458): n is a, c, g, or t
  misc_feature (460)..(460): n is a, c, g, or t
  misc_feature (515)..(515): n is a, c, g, or t
  misc_feature (530)..(530): n is a, c, g, or t
caaaacaaccatcattctgtcattgcccangcacccagctggtcctctccccacatgtcacactctcctcagcctntnccccaaccctgcccnccccccccccctgcccnagcccagggacagagtcnaggnggagcctggggnagagcnggaagcaggaagagagcactggacagacagctatggtttggattggggaagagattaggaagtaggttcttaaagacccttttttagtaccagatatccagccatattcccagctccattattcaaatcatttcccatagcccagcncctctctgtcctcccccnactaccaattctttggcncttacacaatttttatccctcaaatattcatccctggcccaaccagtcccctgagcctccctctggnggngactcctccacccatgagctccccagagcatccaagaaagagtgcacagagaccngnggaaggaagctgaactttgcagagatgaggacaggtgcaggctagggtacagggnggtggtagaggaganaagttttatttccagg

SEQ ID NO: 668313 - DNA, 682 bp, Homo sapiens
gctttgggtgaggcggttcagccatgaggccttggctgtgcttttctcgggggccctgctgtggctactggcagcccagggacaggcaatgactgtcctcacaaaaaatcagctactttgctgccatccttcacggtgacacccacggttacagagagcactggaacaaccagccacaggactaccaagagccaaaaacaccactcacaggacaaccaccacaggcaccaccagccacggacccacgcatgccactcaacaagcccaaacacacaaacagccatggaaacgtcaacagttcatccaacaaagcaatagccctgccaccagccaggacccctcaattgccactcacagtcctgccacgcacatagtcatggaaattgccacggttcatccaacaaagcaaacaggcacttgccaccagcccaggattcaccagttctgcccaccccagaaaacagctccaaacctctccgagtcctagcccaaagctccaaggagaccattgggagactacacgtggaccaaatggttcccaagccctgtgtccacctcaagcccagattcaaattcgaagtcatgtacacaacccagggtggagggagagggctggggcatctctgtactgaaccccaaacaaaaacaaggtccaggaagctggtgagggtgcccaatcccc

SEQ ID NO: 668314 - DNA, 406 bp, Homo sapiens
  misc_feature (60)..(60): n is a, c, g, or t
  misc_feature (112)..(112): n is a, c, g, or t
  misc_feature (125)..(125): n is a, c, g, or t
  misc_feature (314)..(314): n is a, c, g, or t
  misc_feature (342)..(342): n is a, c, g, or t
  misc_feature (365)..(366): n is a, c, g, or t
  misc_feature (373)..(373): n is a, c, g, or t
  misc_feature (381)..(382): n is a, c, g, or t
agtatgggagaatgagtttttgtgtgtgttttggtgatgttaggtggaggaatattatgngtttcatattctgctattcttgtcctattttcctaatcatctttctatatgnatgactacataantctgagaataccaaaagagacagacacagaaccaatcggattcctttcttcttgaagcttctgcacagcaaaagaaactatcaacagagtgaacagacaacctacagaatgggagaaaatttttgcaacaatgcatgtgacaaagatctaatgtccaacactgataaggaacttaaacaaatttacaanaaaaaaaatctcattagaaagtgggcanaggacataaacagacacttcaannaagaccnatcggccnnaagcatatgagaaaaagctcatat

SEQ ID NO: 668315 - DNA, 473 bp, Homo sapiens
  misc_feature (25)..(25): n is a, c, g, or t
  misc_feature (375)..(375): n is a, c, g, or t
  misc_feature (433)..(433): n is a, c, g, or t
  misc_feature (438)..(438): n is a, c, g, or t
  misc_feature (460)..(460): n is a, c, g, or t
  misc_feature (463)..(463): n is a, c, g, or t
cagccgtagagagctcttgagccanagggaactgatggggttcacgcctgcattccatgctccttgcacgcagtacacgcagttcttaaggagttactggattctcggtgaggacatggcttgttgaaaggaggggagtttagaatggtgccactctctttcaaaattggcccctgcatcttgaggatttctgaaatagttgttcagatgtaaactcagggttctggacgggacaggagccaggcctggtgttgccttcccgtgattccagtgcttgtgggtcagaggaagagggagccagcctgggctacatggatagttctatttagcctgggctacacaagagattgtctttaaaaacaaacacacaaacanacaaaaaatctggtgcagtgtgcctagcccgagatttcactgcctgggtgtgactcantgggntgcacacatcccagtatgtccnagnccatgggttc

SEQ ID NO: 668316 - DNA, 995 bp, Homo sapiens
  misc_feature (701)..(701): n is a, c, g, or t
  misc_feature (714)..(714): n is a, c, g, or t
  misc_feature (903)..(903): n is a, c, g, or t
  misc_feature (931)..(931): n is a, c, g, or t
  misc_feature (954)..(955): n is a, c, g, or t
  misc_feature (962)..(962): n is a, c, g, or t
  misc_feature (970)..(971): n is a, c, g, or t
gcgtgagatggagtctcactctgtcacccaggctggagtgtagtgctgcgatcctgactcgctgcaacctccacctctggagttcaggtgattctcctgcctcagccttccgagtacctgggaatacaggaatgcaccaccatgcccggcgaatttttctattttcagtagagacggagttttgccatgttggccaggctggtctcgaactcctgaactcaggtgatccacccgcctcagtctcccaatagattacatatattattaatgaattgcttcctttaacaccctattcattgaattttccagtaaaccacaattactaattactcctgaaatcagaaaagaggttaaaaagattttataacagtatcctatgaaatctactactttcaagtaatagtagttgaattaccaaaacccgtcactcaagccaatgactacaattaagatatgagtaacatttcctagataaataaagtcaattaattatatttgcatctgggaaatagagaaagtacatataagccatgattttgaagtcaaaagagagagaatatttgccaaggaggggtgagttatagtatgtaattataacatacagaagttttttgtatgctggtaactaattttaatttcctacatttttatgtagatttctgctattcttgtcctattttcctaatcatctttctatatgnatgactacataantctgagaataccaaaagagacagacacagaaccaatcggattcctttcttcttgaagcttctgcacagcaaaagaaactatcaacagagtgaacagacaacctacagaatgggagaaaatttttgcaacaatgcatgtgacaaagatctaatgtccaacactgataaggaacttaaacaaatttacaanaaaaaaaatctcattagaaagtgggcanaggacataaacagacacttcaannaagaccnatcggccnnaagcatatgagaaaaagctcatat

SEQ ID NO: 668317 - DNA, 1008 bp, Homo sapiens
  misc_feature (714)..(714): n is a, c, g, or t
  misc_feature (727)..(727): n is a, c, g, or t
  misc_feature (916)..(916): n is a, c, g, or t
  misc_feature (944)..(944): n is a, c, g, or t
  misc_feature (967)..(968): n is a, c, g, or t
  misc_feature (975)..(975): n is a, c, g, or t
  misc_feature (983)..(984): n is a, c, g, or t
tcctgtgagtttaaacgacccccaagctagccctaacactcagcctggcgttcatccggggggaaaaagactcgctgcaacctccacctctggagttcaggtgattctcctgcctcagccttccgagtacctgggaatacaggaatgcaccaccatgcccggcgaatttttctattttcagtagagacggagttttgccatgttggccaggctggtctcgaactcctgaactcaggtgatccacccgcctcagtctcccaatagattacatatattattaatgaattgcttcctttaacaccctattcattgaattttccagtaaaccacaattactaattactcctgaaatcagaaaagaggttaaaaagattttataacagtatcctatgaaatctactactttcaagtaatagtagttgaattaccaaaacccgtcactcaagccaatgactacaattaagatatgagtaacatttcctagataaataaagtcaattaattatatttgcatctgggaaatagagaaagtacatataagccatgattttgaagtcaaaagagagagaatatttgccaaggaggggtgagttatagtatgtaattataacatacagaagttttttgtatgctggtaactaattttaatttcctacatttttatgtagatttctgctattcttgtcctattttcctaatcatctttctatatgnatgactacataantctgagaataccaaaagagacagacacagaaccaatcggattcctttcttcttgaagcttctgcacagcaaaagaaactatcaacagagtgaacagacaacctacagaatgggagaaaatttttgcaacaatgcatgtgacaaagatctaatgtccaacactgataaggaacttaaacaaatttacaanaaaaaaaatctcattagaaagtgggcanaggacataaacagacacttcaannaagaccnatcggccnnaagcatatgagaaaaagctcatat

SEQ ID NO: 668318 - DNA, 585 bp, Homo sapiens
gcgtgagatggagtctcactctgtcacccaggctggagtgtagtgctgcgatcctgactcgctgcaacctccacctctggagttcaggtgattctcctgcctcagccttccgagtacctgggaatacaggaatgcaccaccatgcccggcgaatttttctattttcagtagagacggagttttgccatgttggccaggctggtctcgaactcctgaactcaggtgatccacccgcctcagtctcccaatagattacatatattattaatgaattgcttcctttaacaccctattcattgaattttccagtaaaccacaattactaattactcctgaaatcagaaaagaggttaaaaagattttataacagtatcctatgaaatctactactttcaagtaatagtagttgaattaccaaaacccgtcactcaagccaatgactacaattaagatatgagtaacatttcctagataaataaagtcaattaattatatttgcatctgggaaatagagaaagtacatataagcctgttcattgtcttttatgtgagatccttcaggaattgcttctacacccttctcat

SEQ ID NO: 668319 - DNA, 1941 bp, Homo sapiens
cccacgcgtccgaacagcccaactactctacaatcaaccaacaacgtcatctattacccatcactgctcaagcccaaccacaggcactgctcactaaggacaaggtctaacacacacaagctaacaaggaactcggcaacactcttaccccgacctgctttaccaaacaacactcaccgtcgtagacactcaccagctatctagaggcaccgccatgcccagctgacacactgtttaacggccgcggctacccctacaccgcctgcccacacacggcgctacgccactaatctccacctatgctctcccattaaactctagggaaccatgctactgacactgcgccctccaccgcacgcggactctcaccgcctgcatccatccatctaaccttctctctacatgccccacgcctgcacaatccattagaaccctctgcccaccgcgctgcaacaacgcacgcgcccaggagacaacgtgcaccagccaagcccaacaacgccaccggcaacgacacaacgtaaccacccgaataaactgcgcaagacctatctacacacgtccgaccttcacaccttgactacgacaccaacgcctcaccccctaacacccacacacccacaaccacgcgcatcccctacaacccctaacccaccacaccctcctggcaccctcccccccaccacctcccccgcgcctctcgccgccgccccgaacgccgtatcgtacgcaaggcccaccgcacacccagcccacaacaccacatcactgtcaacgcccaacgcatagccacacctggcctctacacaagaacgacttctcaaccccccacgcacccttccacaccacgcccggcacacaccgtagcgactaactaagcctcccaccccctctggtacactccaccacacacttacacacctcctgcgacccccaaacccggagctaccagcccacacgtctcaaccccgcctactggcgaaactacccaccaccgcacgccataacacttccccataactcccctaagaaccaccttccccacgtcattccccacaccacaccttaaggcgagacacaacaaccacgaacgcaccatccgacactacctccggaacacatccacgacagacacaaacatccctcaccaaacgacgcctgcccaacaacacgccccaacttcaccacacgccataccgagccactggcacaccaacaccgacacacacaccaacgtacccagcacagacattacactcctgccacctccccaccacccgacaccgctaacgtcccacacgagtctcgcgccacgcccaaacgacacctacgaaaaacttcgccctgcacagcccacgaaacaggagccaccaaacaacacatcggtcccactaactcaccatacaacgcacattctccgcccgcataactgaactatcaccaccgcacacctcacacccacttaatcagccgaacctcccccaactcagtcacacctacgccaacagcgctatccacacaacacaatacacactcccccagcacgacacccatcctagcccgcgcccacacctagacgctaccaccaaccacccactctccacaacctcatcttcatctcaccgctccctcacctcctcactacctctccgcgccacctcccacacctcgccaacgcatgccttcaccccaccctccgcgacaccaccgccacaccccgctccaacttccacgccgaccccgaccactcacgaaccagcccaacacaccacgcccacccaacccgaccgcccccaccccaccgcgaccaccccacaccccacccctccgcccagcacccgcccctcgccacccggtccaccctcgccccctcctcctcccgcagccccccccaccccccacccacccccccccccccccccccccccccccccccccccc

SEQ ID NO: 668320 - DNA, 476 bp, Homo sapiens
taaaatctagccagataaccagcttcatgaactgtatgtatggcagcccatgttctctaatgccactgctctgttttaaaaactcaaaggcaatttttacatatcagataattgtttttcatcacatttgttgtgtttcccatgcaaaccatttgctatgcgatttcattcagtgcaacaacacttgaatttccccaaccagagtgcaactgcaaagtgttcattttcaactcattcataccatcaatcaaagcatccatgacctcatcacggcacattagctcaaaccttcaaacaatagttttgcattcaatcgaatcacaattctatccattgcattccattgtgccccaagttcttggcagtttggttgcacctttcatctaccaattcattcattttcaagtgctgtgcccagttgaacttgcttgcttcaagaaagtccccatagcccaagctcttgaaactattcccga

SEQ ID NO: 668321 - DNA, 469 bp, Homo sapiens
  misc_feature (11)..(11): n is a, c, g, or t
  misc_feature (19)..(19): n is a, c, g, or t
  misc_feature (37)..(37): n is a, c, g, or t
  misc_feature (60)..(60): n is a, c, g, or t
  misc_feature (468)..(468): n is a, c, g, or t
aaacaaaaaanggtggtcnacccttggaaaattaaangtggtcccccaacagcccatgtnatcctccaatgttgtacctccaaacattggaactttttcctactcccccaaagcccagacccacactcccccatagccatggtgcctctgtagaagacaggcagtttaaaaaagacttccagaggccgggcacagtggctcactccctataatcccagcactttgggaggctgaggtgggcaaatcacctgaggtcgagagttcccagaccagtctgaccaccatggagaaaccccgtctcctactaaaagtacaacattagacaggcgtggtggcgcatgcctgtaatcccagctacttgggaggctgaggcaggagaatcacttgaacccaggaggtggaggttgcagtgagctgagatcgcaccattgcactccagcctgggcaacaaaagtgaaattccgtctna

SEQ ID NO: 668322 - DNA, 155 bp, Homo sapiens
ccttctactttttcttcttctcctttcctctttcttcttcttccttctcctcctttcttcttcttattctcctcctccttccttctccttcgttcttcttctccttttcttcttccttcgtcttcttcttcctcctccccttctgtcgtcttctc

SEQ ID NO: 668323 - DNA, 499 bp, Homo sapiens
  misc_feature (158)..(158): n is a, c, g, or t
  misc_feature (166)..(166): n is a, c, g, or t
  misc_feature (200)..(200): n is a, c, g, or t
  misc_feature (223)..(223): n is a, c, g, or t
  misc_feature (249)..(249): n is a, c, g, or t
  misc_feature (253)..(253): n is a, c, g, or t
  misc_feature (461)..(461): n is a, c, g, or t
  misc_feature (492)..(492): n is a, c, g, or t
  misc_feature (499)..(499): n is a, c, g, or t
gactttggatccttcctgaggacgtggagaaaacttgctgctgagaaggacattttgaaggttttgttggctgaaaaagctgtttctggaatcacccctagatctttcttgaagatgtgaattagattacagcgatggggacacagaaggtcaacccnagctctgntattttgcaatcacaggttgctacaaatcgggcncttttccaaattttgggctaccnacacttgggggtcatcaatgctcctngagnaagatcataaaggaatttatcaataaaactttgacggacaagggaaatgccccaccctctgaggtgctgctcacgtctctctggtccttgtctgtggccatattttccgtcgggggtatgatcgggctccttttccggtcggactcttcgtcaaccgctttggcaaggcgcaattccaatgctgattgtcaacctgttggctgtcacngggtggcttgctttatgggactgtgtaagtnacctaan

SEQ ID NO: 668324 - DNA, 1091 bp, Homo sapiens
taaattccaatcgggaatcaagaaagcgggggattctgggcaaatgggtgccttgtggccctccccatctcatccctgggtctgggtcccctgttggcctatagcccttataccctgagcaccaccccaacagatctgggggaccagccccctcgccgtgccgtggtgttcttcttcccacaaacccctttaaatgtgggagagggagaaagagagagagaaagggagaggggagaccgtgcccccttccatcaggacattcgtggagagggcccgtcccccagtgggctttttaccctttccgcgtgggggacccttcttccgcgcgaaaacatttggcgttaaaactcaacaccgtgagattaaaactacagagttttacatatgtgaagagccccccaaaaaagaaaaaagaacaaacaaaagaaaaaaacaaacagaagaaaaaaaaaacaaaaacaaaaacacaaaaaaagaagaggggcgccgaagcacaaagaagaacaacccaagagggcgacacaccaaataacgcccccgcacgcaagataatagagaaaaaggccgccacaaagaggggacaacaaacaaacagacacaccacacagacggaggggagagcatcaaaaaaggcatagtaaacgagagaaagaacaacgcacccacacggcgacgacaaacaagaaagagcgcaacgacacaacgcgaggagggggagacacaaacacgggcgaccaaacacaaacaagaaaagaaagagacgcagaagggcaacaacaagaacagaacgcagagaggtataaacaggggaacaaacaagcgaaaagagagatggacggaagacaggctacaacagcaatcacaacagaaccaaacccgggggggcacacgacacacgaaaaagcaaccgaaacgagcgaaccacaagcaaggaaggagagggcgagagaaacggacagacgaggaggcggagcgcccaccagacaaacacaaaaacagaaagaacaagaacacacgcagcgaagaaggaggaggaaaacacaacacaaaagagaacgaaaaaggacaagagcgaacgcaggaaaagacgg

SEQ ID NO: 668325 - DNA, 724 bp, Homo sapiens
agcggggctgcgcgggatgggccgggccaggccaaggccgaggcgggagcggctgcgagaggcggtgggacgatgacggtccctcagcccagtcaccatgtagcacctagagcatgatcgagccttggcgaggctattcttatgcatggtgtgtgtcgggaaggaagctcaggtgcctagttctcacattgacttggtaaacagaaatgccgttccatacatctgcataagtactacctagaagggctgactgttggctatggaattcggatgtcacgtactagtgaccacacgaggtccctacatggctgcgaagtcatggaggtgcctgtgggcgagccatggggcacacgagtgtgccctccccaggcttgtccacagtgctcgagcctccttccgagggttcatcgtgctagttccattggtgaacagagttaaacatcaagcatgaaaacccgggagagaggcagttgacacaaggaggagagcagttgagattcgtatacggacgacgcagagaattcctcgtctgggcagtgtgcttgaagaggtaacgattcgcaaggcacggaagcaaatggtgattgaagtagatcgcagggctaagtctgtcaggcggaaccctcgctaggcaccgaagacccacacgaatggatgaacgtccgcaatttaccatacgcgtgggtatggccattcgagtggagttgggtacctttggacttga

SEQ ID NO: 668326 - DNA, 180 bp, Homo sapiens
accgcgatcgaaccttatttcgcgtctggatgcgacatctgtttacaaaaatcatcatctctgaacattcaggaccgcgcttgaggaaaaatattgtccatccagcgcgccgccgccccatcccccgtgccaccaccactgcctccatatatatgcgaaccgagcccgactgggcggccg

SEQ ID NO: 668327 - DNA, 760 bp, Homo sapiens
  misc_feature (439)..(439): n is a, c, g, or t
acttcatgaatcagtctggggcagctcccgataatcgccgacttaatatgctgcaacaaaatgtagaatggtcagacagaatgaatacgtatggcctacgtagcccataatgggtccagatttgctgcccagatgcgtatgccaccaacttacacaatctcttcgttcgcagagctgttcagatgtcgaaatgtggcatagggaatgatggacctctagtagctgagatgcaagaccctaagaggaagtctagatcttaatatacattcgctctcacatgtgacagctgtcccatctgctcatttggttggcactagactggtggcagaggcttctagctgactcgctcagggattctcacaatagccgatatcagaatgtgtgctgaaggaacgtgtctcttcatctcatatgatagcgggcaaaggagaggaacctnctgcctttagacaatataagtaaagtgattagagtgctcgcgttaccttgacacatagtttttcagtctatgggctcagttactttagatggcaagcatgcagcttatactaatagtaatttgtaaagttggttggataagctatccatgttgcaggttcatgcattacttctccataaaacatatgtatttaccacaacattttgtgacattccttctcccatctcttccgtgccatgcattgtaaataggttcttcttgttgtgagattcaatatggaatttctcctatgctattgtcaataaaatattattgcgctaa

SEQ ID NO: 668328 - DNA, 116 bp, Homo sapiens
tcgggggatgtggactaataggagaaatgcactacactgattcagcagcttctaagcaacagagaaagggtaaggagctatgatgagttgtgggagacagaacacataatggggta

SEQ ID NO: 668329 - DNA, 541 bp, Homo sapiens
  misc_feature (518)..(518): n is a, c, g, or t
  misc_feature (525)..(525): n is a, c, g, or t
gaacgggtgatgcggttggccggatcagatctttgaaaatctgtttctgaatgcagttcctggcttgtgccaagggaatcctcactagcggccccaactcctctgttatctccaagtcccagttttcccctgtgatctccaatgctgagcccagagcacagagagagcccccatctcaccccttgctagccctggagggtgagtttcctggggcttgaagggcgtgtttctggctctactcagatttctgggagaacacaacaagccgatgcatgaaaaagtcccagggcaaggaagacaccagcaaaggtaaggcatttaaagcagtttctttctctttcttttctttctttctttctttctttctttctttctttctttctttctttctttctttctttctctctcttttttctttctttttttttattatggttagctgtcacatacaacttttcttttttggagatggggtctcgctctgtcaccaggctggagtgcagtggcgcgatctcggntcactgnaaccgcatcacccgtt

SEQ ID NO: 668330 - DNA, 855 bp, Homo sapiens
  misc_feature (614)..(614): n is a, c, g, or t
  misc_feature (648)..(648): n is a, c, g, or t
tcaaactgtccgaagaactcaggctgtcattgaagatgctgtggtacctcaggcgtgagcacgctcagttctactgtgtctcatgattcccagagtgtcaccggtcactgaattgtacagtctgggaaggatgaaattagaacccaagtagattactgggaagaatgtgttcggaaagagaaagatttacaagcactcgttcatcgagctatggaagaaaaagacgcaagaaatttaaacacctgaagtttaagtcccaagccatagaaattcgtgaatgggctgtatttcatctaaattcttgtgcacaaatagtgaagattctgaatataccgatgctgagagtgaatggagctgatgaagacactataagcgggttttgtgaagattatacactatggatgtctctactatgtacaggtgatgacttaaaatgcttgagactaaggggagggatgctgtgcccttgtgaaaggctatcatggatttcgaaacaaacagattgactgtgctcaatctaatcttcgatggaaattctaacaattatacgagagtgatcttcttgggggtggcaaaatcgaggaagggaagacagcgcgtgcctttacatccangattggtgactcattggtaaacacacaaaacctncgacacaccttggagttgctcacacccaattctataaataaagagctaaagaggttaaaaaatccggaattaacccctgtggagagtaccaccgcgtttggaagattaatcgcggtttggtcccattgtttcacacaggtattctttttcgccccgaccaagtctgcttctgttctgttcgacatgcaacgacactagatgttggcg

SEQ ID NO: 668331 - DNA, 127 bp, Homo sapiens
cgctcatctggaacttttgtagacaagatggcagctatgggtggttggaggaggaacatataggaaaaatcagagccaaatgaaccacagccccaacaggcacagttgaacaatggactgattccag

SEQ ID NO: 668332 - DNA, 113 bp, Homo sapiens
ccgtgttctgtagatttggctctgctggagcatgtctcgggatatgtacaggagcagatcctcagagtcaagccacaccacggtataagattgagatactctggtactcaact

SEQ ID NO: 668333 - DNA, 104 bp, Homo sapiens
  misc_feature (4)..(4): n is a, c, g, or t
  misc_feature (84)..(84): n is a, c, g, or t
gagncaccaagacggcccagtcacagaggaaaaacccgaacacgacacagaacatagaaggagagtccaggccagggacaaggngggggccacccccgcgggcc

SEQ ID NO: 668334 - DNA, 651 bp, Homo sapiens
gggacaagtcgccggcggcgcccgacggagcaggtaaaatgtggataatacggccgggcgcggtggttcgtgcctgtggtcccggcacttgggagaccgaggcgggtggattgcctgaggtcgggagttcgagaccagtctggccaacatggtgaaaccccgtctctactaaaaaatacaaaataaatttgccaggcatggtggcatgcgactgtaatcccagctactcgggaggctgaggcaggggaattgcttgaaccaggaggtggaggttgcagtgagctgagatcgcaccactgcactccagcctggatggcagagcgagactccgtctcaaaaatacataaataagtaaaaaaacaaacaaaaaaaacaaaaaaaaaaaaatttgtgggggggcctcgggccccgaaaaaagctttttgaaaccccaatggcgcggtggggcgcggcgggcccccgtggtgttaggtcgcacagtgtcgccacaacggccgtgtcccaggagaacacgcgggccagaaacagatcgggcggggttctccacccccaagaaaaaaggcgccgggggcaccccggcgtctctggacacacatcccgagggaggcgggcaggccacagggggcacacaaagagcgccaggaggccata

SEQ ID NO: 668335 - DNA, 869 bp, Homo sapiens
gaggacacagtggacgcagtgagtggaatgcattacaacacagatggcagtatgctttctcagcagtccacagataaaaccgtggctgtgtgggatagtgaaacaggtgagagggttcaacaggctaagagggacatatcttcctttgtgaatgtcctgttatcgcaggccaggaggaggccctcatgacttgtctgcagctgtgcggtgagcgatggcaacagttagagcttagggactatccggaaggaagagcaggcatccagacatttcagaattatcgtaccaggtgttagctggtgaccttcaatgacgcaagtgatcagataattctggtggaatagacaatgatatcaaggtctgggaccgtgcgccagaacaaggtaagctacaccatgagaggccatgcagattcagtgactggctgcgtttaagtcctgacggctcttatctttgtccaatgcaatggacaatacagtcgtgtctgggatgtccggccatttgcccccaaagagagatgtgtacagatattcaaggaatgtgcaccaatttgaaaaagaaccttctgagatgtcttggtcaccctgatggaagcaaatagcagctggctcagccgacaggttgtcatgtgggggataccacaagcaggagaatatggataaggctggccggcatgctgggtccatcaatgaagtggattcacccagatgaggcccatcatatcccagcatccgctgacacaacggaatgggggagaccagaaattggctgaagcccaagaggggtcagaactagacgtactagcccatgggccggtaaccccgaaactggcgaaaaggggcatcaacctgcgtccagaaggccggaac

SEQ ID NO: 668336 - DNA, 815 bp, Homo sapiens
tcatcatggtgtggagtgctgcacatacacttgtcttcgagccaccattctggctccgacgctgcttttctgcactggagtatcgagacggtgtggtcagtgttagtgcctgggatcgttgccttccgtatggtaattccaatcccttgacgctggtaatgtgagctgaactcaccatggcctcgcatgccgctacagatcttcactgcgatcaggcgtggccgctcgttgtagttgtcactggagtatgtccgtggagagaatgcctggacatgaaatgcatgtctgcgaagtgctcaatgtgtactctctcagactatgtaacttttgtctgaggttttgattatcctcaacatatcaactgagtgtgtggcggatcatgcgacaggttgtttggcaccagtgacgtgattgtgagatggtgctggatgctttatttggtagggtatacaataactgtggtagttgaagatgggatgtgattgcactcttagcacgtcgtgcttgggtccaatgacggattaaggctacacacataaaggaaggtaaatatacatgagtaaagtccgtgtggtgatactagcctaacttctctagaagtccacaacgggtttatcttaacagagatacaatgtttgtaggaaaaaggttggagaggagtatatcataaattgagaggaagaaatacggaatatgcctggtgcgttaatgaggtagcctccagatggttatgagatcactgtattaataaaggattttgtaactaggccttaaatataagtctctaaaagagacctattatcacgatagattgc

SEQ ID NO: 668337 - DNA, 519 bp, Homo sapiens
aatccaaagagagtcacactgggaggctatgagagcacttatcgcactagacgtaatacttaccgtcattccaagacaggtaggacgccttttcaccaagtgaaagataatcaagctgaacaacctaaagatcactattctcattcggaacctaaaaacgctggctttgatgcgtctgaaggctacaagaatacccgaatgaagtctgacatcattgagcacaccatatcacgtacctgaggcacgtgggaaaggtcagataagtcggagggatgctgtatacaaaggccgctgaccacagcacggcgatggttaaaaggccttgagatgccttgaccatcatttcccaacccatcaacacgccatgggctgtattcaccaggacgcactgtctgacaaagccaccctgtatctgtacttgcagtgctgggcacggtatccatatcattgagaacggctgagctatcacacatacagaggaatgagccctaccactgttcgcacatgaatggtaaagga

SEQ ID NO: 668338 - DNA, 714 bp, Homo sapiens
ggagagaactagtctcagtttttctatgtatatttttctaatttttttatttattttattattatttattttatattttttttttttaaaaaaagtccccttttttttaaaaaaagggcccaaaaaaaaaaaaagcattctctgaagaacgaagagcgcactctgacgcgccaccacccccccctgcggaacgtctggcggaaaccaccaacgccacggcgcgcacgacagtcatcagtgcgtcccctacactgcgcgagccggcgaggagggaggggtgccacacaagcaaagccacactcactaagaagctgaggcactgcctgttactctgatcgagcgcgacacctactgcaacaaaaacaccgtgagagataaactatatgatggatagaccacgccacccaccaccccttcttatacacagagagcaacaacaaggcgagtgcccattctcaaccacttcctacacaacgacgacgctcctactgggtccctaaggacgagcaggggtgacatagcgtgcggacacaaaaaaattatcctctttgttccaccccccagcgagcggcatggcccatttttggtgcttataaacatgctataaagagaggagaaagaagggcggtgtgcactgggggggctccggcagaaaaccaagcccctccacgacacaacagtgtaccccattgcgggggcggctgctcgtttaat

SEQ ID NO: 668339 - DNA, 238 bp, Homo sapiens
tgctgggattacaggcatgagccatcacgcctggccatccttcgctttagatctaaagacaaaaaaggttgaaagttaaataatggaaaaagatcattccatgtaaatagtaacctaaagagaatttgcctggatatattaatatcagacaaagtaaacttgaagtaaaaaaactgatagaagagagagtgaatgagagtctatactgctagacggtacccttcatcaagaagataaa

SEQ ID NO: 668340 - DNA, 416 bp, Homo sapiens
gcagtcaatcacagtctgaaaattgtgcagtattttgagagagagaccacattgacataacttttattacagtatattgttataattgtcctattttattgttattgttgttacttttactgtgcctaatttataaattagactttatcatgctttgggaggcagaggcagaaggatcacttgagcccgggagttcagccaagaccagcctgggccacacagcaagaccccatctctacaaaaaaattaataaaagtaaaaaattaaccaaatgtgatggtgcacacctgtggtcccggctgctcaggaggctgaggcgggaggatcgcttgagctcgggaggttgaggctgcagggtgagctgtgattttgccacagttctacagcttgggtgacagaggaagaccccatctcaa

SEQ ID NO: 668341 - DNA, 210 bp, Homo sapiens
gtgctggtgatctagaggaccgtatgtatcccacacgaagtaatgcgtgttggcataaaagagatggttcaaatgaaaatataggctggggcagtggtcatgcctgtaatcccagcactttgggaagcagaggcaggcgtatcaacttgaggtcaggagtttgagacccagcatggggccaacaatggcaaaaacctgtctctacttaaa

SEQ ID NO: 668342 - DNA, 278 bp, Homo sapiens
  misc_feature (145)..(145): n is a, c, g, or t
aaccatccctttgtacacagcttgggggacagctggcagggaaaacggcaccttttcattatgtgtagctactgcagcacagatctgtactccctttggtcggctgttggctgctttcctgaggcttccatccgtctctttgctnccgagttggtgctggtactgtgttatctccatgacttgggcatcatgcatcgagatgtgaagctggactgtgctgctgccgagaccacgccattgcactccagcagccagggtgacagtgagagtccgtctca

SEQ ID NO: 668343 - DNA, 432 bp, Homo sapiens
agtggatgatctcagctcatcgcaacctctacctctcagggttaagtgcttctccggcctcagcctcccgagtagatggaattccaggaatgcaccagcacaccgggctaattttggtctttggagtacagatggggtttcagcttgctggccaggctagtctccgacccctgacctcaagcaatccatccagcttgacttcccaaactgtggggatcataggtgtgagccaccgtgcccagcagtgggtgactttcagggtccctgttggggctcaacattggtaacgctctgcaggcaaatgtgccgatattcattccctcccttgctctctcaagacgcgtcagaataggaggaccagaggcaaatcagaagaagccatctagttcccctcccgtgttgcgactgggctcaggatcgaatatagctccc

SEQ ID NO: 668344 - DNA, 160 bp, Homo sapiens
acacaccccacatgcccacgtggcccacacgtgcaagggtggggttggctgtccttgcccctgcgtgcactgcagagaaccaatgcctgggactctcctggggcaggcaccctgcatgggcctgcaacacctacctctgcttttttggggggcaggggat

SEQ ID NO: 668345 - DNA, 135 bp, Homo sapiens
tacgattgatcttatttagcaaatgcaacagacaagaatatcaccttgatatatataaaaggtagacttaatccaaaagtgtataagctcacagaaaaaatgcaaactgtcaattaatatatactatagtaatat

SEQ ID NO: 668346 - DNA, 432 bp, Homo sapiens
aaacacttacaatggctatatgtgcaaatctgtaggtgagttatttgggattccttcatttaaataaaaatgcaaaaaaacttcatgacttcctttacccccttccattcaaatttttaaagttatttttctatacaaggtaggtacatgggctatacaaagttaaatatacatatttacagtcccacttcttaagcacattatttttttttttttttttacagatcccagagagacggcaaaagatagggagttgggggctggcctttaccgggaagctgggctaatatatcaaatggtgtggcagggcatgccgccagttagtggcactggctattaataaccctgtttaaacatttcagcataaaaataggtactttatatcactaacggtctgaagaacacagagcactgggaaatctcggtttctgg

SEQ ID NO: 668347 - DNA, 488 bp, Homo sapiens
tgcgcctcgactcgccaaagctctacgctgttcctcccaccgtgcactgagaagtgctgaggatttccgaacatcaacctcctctaaccctctgtatgggaattagatttttatcatcctgactgttggggctctctagagctcaggcaacttgcccctgggtagggatgtagcctgcctgcgacctgtgcgaatgaggcttctgttcgtctgtggcttgtatcatctgtgggagcaaacttcagaatgcagtagattccaggtgcaacatttggtgcccggacaagttgtaaaacctgaccttgaggcactgtgaggaccaggtcaccgcgaggaggaggaggtgctcccagaaagataggttttgaggtgagaggccctgctccagagcgcagtgctgggcagctatgcaggtgccagtcagacctcaggttccagctgaggctcaagagggccatgagccccggagtgcagggagtggagagatc

SEQ ID NO: 668348 - DNA, 262 bp, Homo sapiens
  misc_feature (70)..(70): n is a, c, g, or t
  misc_feature (122)..(122): n is a, c, g, or t
  misc_feature (172)..(172): n is a, c, g, or t
  misc_feature (222)..(222): n is a, c, g, or t
  misc_feature (246)..(246): n is a, c, g, or t
  misc_feature (255)..(255): n is a, c, g, or t
cagcacccacttgaggaggtaggaggaagtcagaccgcgagggctggagcgccaccttgtggccagatgnacccttccccggaattgtcagaccattctacagaagttccagcctctgatgncctacagtctgtggtgccagaggagcttcagctgcattataacacaattngtctaccatgaagtgtcagggaccaagtatatgactaatagatgcttggnaggttctgagtacttcagaacaangtctactgnatcctct

SEQ ID NO: 668349 - DNA, 411 bp, Homo sapiens
cccccagaggaaaaagggggggtttttttttttaagcccccaggatgccccctttttcaagaagcgcctttttttttttggggtatccccccgaggcctttccctttttttttgggagcccctccggggtcgggggtttccccccggatctttcccttttttttgagggaaaagtttaggcggccccccccaaaaaaaaattttttttttttttttttaaaaaagggggggggccgattttcttgtgcccccaattttggcttttctttggggagaggcgggcggccctttttccccttggggcccccgaaaggggggggggggggaccccatacaagggggatgggcccccttttttttttaaaccccccccccactggtttttttgaaagaattataatggataaaggg

SEQ ID NO: 668350 - DNA, 610 bp, Homo sapiens
cttgacggtgttctggttgtactcactgttctgtggctgttctcctcagtaaaggccgactcaaaagccattacaacctcccttacaacaaaatggttttccactccattgttgttagaagccagtgagtttttagcagaagacagtcaagagaaattttggaattttgtagaagccagtcaaaatattggatcatcagatcatgacggtaccgattattcctactatcatgcaatattggaggctgcatttcagtttctgtcacccctccagcagaatttgtttaaattttgtctgtcccttcgttcttactcagctacaatccaagccttccagcagatagcagctgatgaacctccaccagaaggatgtaattcgtttttttcagtgcatggaaagaagacttgtgaatctgatacccttgaggctcttctactgacagcctctgaaagacccaaacctttattgttcaaaggagatcacagatatccctcgtctaatcctgaaagccctgtggtgattttctactctgagattgggtctgaggaatttccaattttcaccggcagcttatatcaaaagcatgcagcaaatcaatatgtttcgaatt

SEQ ID NO: 668351 - DNA, 380 bp, Homo sapiens
cggtaccgcactgcatgccagctgggacacacagcaagaccctgtctcaaaaaaaaccaaaacccagcactttgggaggccaaggcaggcggatcacctgaggttagaagttcgagaccagcctggccaacatggtgagactccgtctctactaaaaatacaaaaaagtagccaggcgtggtggctcatgcctatagtcccagctactcaggaggctgaggcaggagaatcacttgaacccaggaggcagaggttgcagtgagccaagatcgcaccactgcactccagtctggttgacaagaacaaaactctgtcttgaaaaaaaaaaaagggccgggcgcggtggtccacccccgtattgccagcctttgggaaggcgt

SEQ ID NO: 668352 - DNA, 902 bp, Homo sapiens
  misc_feature (25)..(25): n is a, c, g, or t
  misc_feature (135)..(136): n is a, c, g, or t
  misc_feature (142)..(142): n is a, c, g, or t
  misc_feature (237)..(237): n is a, c, g, or t
  misc_feature (357)..(358): n is a, c, g, or t
  misc_feature (381)..(381): n is a, c, g, or t
  misc_feature (493)..(493): n is a, c, g, or t
  misc_feature (503)..(503): n is a, c, g, or t
  misc_feature (543)..(543): n is a, c, g, or t
  misc_feature (568)..(568): n is a, c, g, or t
  misc_feature (577)..(577): n is a, c, g, or t
  misc_feature (584)..(584): n is a, c, g, or t
  misc_feature (599)..(599): n is a, c, g, or t
  misc_feature (605)..(605): n is a, c, g, or t
  misc_feature (612)..(612): n is a, c, g, or t
  misc_feature (759)..(759): n is a, c, g, or t
  misc_feature (768)..(768): n is a, c, g, or t
  misc_feature (772)..(772): n is a, c, g, or t
  misc_feature (779)..(779): n is a, c, g, or t
  misc_feature (806)..(806): n is a, c, g, or t
  misc_feature (812)..(813): n is a, c, g, or t
  misc_feature (815)..(815): n is a, c, g, or t
  misc_feature (819)..(819): n is a, c, g, or t
  misc_feature (877)..(877): n is a, c, g, or t
gaaggccacacaggggggagaaaancagaaaatgcaaagcaaaaacaaaaggtctggagtcttagcatcagaagggcaccatatatacatctacagttggtggccaatacaagtcattgccagacagtccttggnngcacanaacagcctagacccagccaagctctaggaactcacggtcccaaggagtctagacgcttgttctgatgctccgaccgtaagaaaaatgtgggagtnatgaaggctttatgatttactcattatagtaataatagcagcctagctaggtacaaaagcagttataaaccatttatattacacagaattattcaggtctccattctatcttatgttgtnnaatttttaattggatttccagtnagttgtttagatgattagtgataataaggaatggtaaatccatagcaccatttcaaagacttgttgtcactgatttctcatttagatgtgtgacgaagatactccacctgtnagggcaagtntgccaatgccacaagccgtgtttttgcaagggctccagtntgggcattttgtccgtgtgcgcgtnaagcttcanacaggtncgggcagcggctgtntctgtnggatgcnctgggtcacccaccagaaaagggcttttggacatttggggtttctacccacactttggttttctaaatgaggtggactgggagggaggtatcttctttcagatgaaagggaaggggcgagatggagttatcttatttctgggtaaanaaaacaaanaaanaaaaaanaaaacaaaaatactgagctggattatnctgttnngntgtnaagttccttagctacttctttaaggctcaacacgaggctgaatggtcaacataaaaancaaacaatactatgtacatatatgt

SEQ ID NO: 668353 - DNA, 820 bp, Homo sapiens
  misc_feature (25)..(25): n is a, c, g, or t
  misc_feature (135)..(136): n is a, c, g, or t
  misc_feature (142)..(142): n is a, c, g, or t
  misc_feature (237)..(237): n is a, c, g, or t
  misc_feature (357)..(358): n is a, c, g, or t
  misc_feature (381)..(381): n is a, c, g, or t
  misc_feature (493)..(493): n is a, c, g, or t
  misc_feature (503)..(503): n is a, c, g, or t
  misc_feature (543)..(543): n is a, c, g, or t
  misc_feature (568)..(568): n is a, c, g, or t
  misc_feature (577)..(577): n is a, c, g, or t
  misc_feature (584)..(584): n is a, c, g, or t
  misc_feature (599)..(599): n is a, c, g, or t
  misc_feature (605)..(605): n is a, c, g, or t
  misc_feature (612)..(612): n is a, c, g, or t
  misc_feature (759)..(759): n is a, c, g, or t
  misc_feature (810)..(810): n is a, c, g, or t
gaaggccacacaggggggagaaaancagaaaatgcaaagcaaaaacaaaaggtctggagtcttagcatcagaagggcaccatatatacatctacagttggtggccaatacaagtcattgccagacagtccttggnngcacanaacagcctagacccagccaagctctaggaactcacggtcccaaggagtctagacgcttgttctgatgctccgaccgtaagaaaaatgtgggagtnatgaaggctttatgatttactcattatagtaataatagcagcctagctaggtacaaaagcagttataaaccatttatattacacagaattattcaggtctccattctatcttatgttgtnnaatttttaattggatttccagtnagttgtttagatgattagtgataataaggaatggtaaatccatagcaccatttcaaagacttgttgtcactgatttctcatttagatgtgtgacgaagatactccacctgtnagggcaagtntgccaatgccacaagccgtgtttttgcaagggctccagtntgggcattttgtccgtgtgcgcgtnaagcttcanacaggtncgggcagcggctgtntctgtnggatgcnctgggtcacccaccagaaaagggcttttggacatttggggtttctacccacactttggttttctaaatgaggtggactgggagggaggtatcttctttcagatgaaagggaaggggcgagatggagttatcttatttctgggtaaanaaaacatcccgggaatccggaccggtacagcgtgcttttttgtacaacttntctatagtgt

SEQ ID NO: 668354 - DNA, 922 bp, Homo sapiens
ggctcagtagaattagaactgactttctgagggccagaactgtccaccactggaatgggctggctatgaaggaggtgattaccttgtcacgcagtgaggtatgcaagaatagcagggattgacttgccacataggcagagtatgtatgactgacgaagcaaacctcaaactattctactagcttggtctagaactaggcagaattgagttcctatccttactctgtttaggttataggtcttagtttcggttttaaatacagatgtggtctcactgtgttgcctaggctggtctcgaactcctgggctcaagcaatcctcccgcctcagccttccaaagtgctgggattacaggctcctgccaccacgcccggctaattttatgtttatgtatagtatggagacagagtctcgctattgtcaccagggctggaatgatttcagctcactggaaccttcgccaactgggttccagcaattctcctgcctcaggctcccgagtagctgagattataggcacctaccagcacgcccggctaaattcgcgtattctgagtaggagacgggggtttcaccagtctcggccaggctgggtctcgaactccttgaccttaggtgatccaatcgccttcattctcccaaagtgctgggattacagcgcggtaagccaacgctgcctggccaggcccaactaacttagcgatttacgtagcacacacgggttacaccaagtagccaggccgcctctgacattctggaacctaagggtatcgagctgcctggcctccaaacgtgtgggactcccgcgttgagcacacagcccgacaatttctcaacatgacactgctcatgggaaccttcggcccaccaattctgtgccacaccccagttcgccctaaacttactgcgagcgaagagctaga

SEQ ID NO: 668355 - DNA, 673 bp, Homo sapiens
  misc_feature (318)..(318): n is a, c, g, or t
  misc_feature (426)..(426): n is a, c, g, or t
ggaaaaaagagaaggcgctgtcccgctcttgctacggtggcctggaggagtggcgaaaccggaacagagaatttatcacttctgggactcacagtcgtgatgtctttcaagagggaaggagacgattggagtcaactcaatgtgctcaaaaaaagaatagtcggtgacctcctagccagttacattccagaggatgaggcgctgatgcttcaacatggacactttgcttgtgccatctgcccccatcaaccgatactgtacaccctgaccatgctgactgcccaccgtgcatgcaataaacatctgtccagcttgcancttttctatgacaataagcatccatgaaaggaaagaaagcataatccaaaacatcataatgaattgataatgtaataaaccaaatcttaaactcctctactaactcanacactacttatcacccagagtactctacacagaactccgcactataacacgtactaccaccttaaatacacttattttacgtcaaaaccgagaatactaatactcataatgagacacatggctctaaaagacttgtccactctacattcttactaatactactcttctatatatcttacttaagacttgcatggaaactttagttcgttcatcacttgatatgactcatctctaccaacttacgcct

SEQ ID NO: 668356 - DNA, 344 bp, Homo sapiens
  misc_feature (53)..(53): n is a, c, g, or t
  misc_feature (100)..(100): n is a, c, g, or t
  misc_feature (240)..(240): n is a, c, g, or t
  misc_feature (277)..(277): n is a, c, g, or t
ccgatgcgctggaaggcaaacatccggctgttccggttgatgtggtgcatcgngcgctgcgtgaaatccacgagcgcgccgatgccgttcgtcgtcagcntttccaggcgatggctgctgaaggtgtgaaatacctggaagaaaacgccaaaaaagaaggtgtgaatagcaccgaatctggcctgcaattccgcgtgatcaaccagggtgaaggcgcaattccggcacgtaccgaccgcnttcgtgttcattacaccggtaaactgatcgacggcancgtgtttgacagcttccgttgctcgtggtgaacccgttgaattcccggttaatggcgtgatccctgg

SEQ ID NO: 668357 - DNA, 858 bp, Homo sapiens
ggatgtgaagtcagtttcttcaattgttgtccaggccaaggtgaaagttccccctcacccttgaaaaaatcagctcattagctcattggctgggcatgattgctcatgctgtaataatcatagcactttgggaggctgaggtgagaggattgcctgagcgcaggagtttgagaccagcctgagcagcatggtgagatgctgtctttacaaaggaataaaaaattgcctgggcgtggtggtgtgcacctgtagtcccagctgaggtgggaggattgcttgagcctgggaggtccaggctgcagtgagccatgatcatcatggcactccagcctgagcaacagagaccttgtctccaaaagataatcaactcattcacaaggccaggttcagtggctcacacctgtaatcctaatcccaacactttaggaggccaagatgggaggatcacttgaagccaggagttccagaccagcctgggcaacatatcaagatcgcgttgcttacccaaaaacacaaacaacacacacaaccaaaccaaccaccgtgtgtgtggggcgcgccgtgggccccccgggagaaggtttttgaagaccccaacgttgcgatgtggggcgcgggggggccgcccaagagggcgtgattgaaaccacgggggcagcaaccgcggtttacccataaaggaaaacgccggggcacacgcgacatagcgggtgtgcgattctcctccaccaagataaaaaaaaggcgccggggggaccacagccactgtttggggacaaacaaccaagaagagagtccgagaggcaagaacagcggcatgtaacacaggggcgtccaaagaggcccgaaattaagttc

SEQ ID NO: 668358 - DNA, 106 bp, Homo sapiens
gctttgcatttatactgatgtgctcagcaaagacagtcttgaaggtcggaggctcgaggggtttccacgtagcccacaattgcccacaaccaccatggttggtgtc

SEQ ID NO: 668359 - DNA, 192 bp, Homo sapiens
gctcggtacagactgtgtacaacgacactttttttttttctggggacatttggagcaatcagttgcagacatttggatggtgttttctctgaacacggcaggtgtctttaaaaacaaagatgacctacccccgttcgtcacccccagagaaggaatttatattcacagacaatagtcgtggttacacattcg

SEQ ID NO: 668360 - DNA, 274 bp, Homo sapiens
tcgccgtaggtcatcagcaagtagttgccgacccagacctcgacctggtcgccggtgaccgggtgcgtcacgtacaggccggtgggcaggccttccttttcacgcgtggccagttcggcttcggtggtgccgcccagcttgcactgttcgatgaaggcggccagcgccggattcgactgcgcggcgtgggtggccagggggtgttccggcgccacggcgcagaaggtcacgcccatgatggcgtcgacgcggccgcgaattttttcgcggccat

SEQ ID NO: 668361 - DNA, 335 bp, Homo sapiens
  misc_feature (4)..(4): n is a, c, g, or t
tccnaaaaattacccttttgggcccctccggttttgggccttttcccccctgttttgtgggaaatgtttctgggggaataggcccccccccttttggggggggtccttttttttgggagggaggccccaaaatcctttttccccctggttctgggaagggcccggggccaaattgggggggttttttcctttttggatttttccctttttaaggggttttttttttttccccgcccaatttttttttaaatgggggggggaccccggtggccttataaagcgggtccttttttgtccccggttgcggggggaaaaaaatttttttttttaaatta

SEQ ID NO: 668362 - DNA, 266 bp, Homo sapiens
  misc_feature (254)..(254): n is a, c, g, or t
caggcaggtgtcagactggctgaagtccacatgaaaaaaaaaaaaaatgtcagttgttcatgtgaccgcctgcacacttgaaaaatcaatatttccaaaacactcttccatttaccattttaaaacagcaaaagaaaaaaatcaaccacctttgacaatgcttttctccaattggtttggcccctttttttttggttctctaaacatttattttaaattcgaaagttccaattttaaaaccattattttccagnttaatttttcca

SEQ ID NO: 668363 - DNA, 985 bp, Homo sapiens
caggtgtatatcgttcagggcacttgttacagatttgagggcgctggagcaagtggacatggggatagtggtgttggaggtctctcttcccaaatatgtaaatagtctataccagataagttgaaataggaaatgtacttgctgcttcatttttgattatgttcattgtgtgtatagcaagccttgtcaccagaagttttttttatatcaacttaaatcgctgctctttagcagccaaacaggagcaaaatgtaaaatttttaaactcgttatgtttaaaggtcacttgttagttgatagttaatgttaaaagttaatttatgaacccacacctgttctgtactgcaccagaggcggccgtgagagggatgcagtgttctgcattctttgaagggattctcctggtgtaaagtgggtgcgcttgttgtcttcattgtcgtgttactttttaataatagacacctaagctgccatgtgttactttttgatggtttttgaggaagagcacagaacaaattttcatttcatattcatagtatgaaagtggtttctatttgtaatgctgcaaatacctaaaggtacattgaacacttggaagggaacactttttgatgctgattctgaactgtttctgattcaggagaaaagatcaatctgtggattttctcccttccggtccagtagctaggcttaatttaccattaggagattgatactatgtgacgttccaattttccctgggaatagctttcgaaagccgcgctttttcaaatggtgctcgcctgcacactcctggacttcgggattctgggtcccctggggcgcgtgtgggtgccctggctctggggggtctcccgtggggcacccctggagttggttatgggcgcccgcacacgtggttggggggcgtcatcgcctcgtgggcgaagcttcgtgggtcggcaacttcctttcgctatctcggctctgtcgcttttttttcttg

SEQ ID NO: 668364 - DNA, 803 bp, Homo sapiens
ttaaaccctgcgtggcgatccctgacgcaccggcgtgatgcccaggtaagacagggcgaccgtggcagagtccatactacttgccttagggatcatccaactataggatgattagtccgcaaatgtgttccttggtgaggcacgcctagatcgataatgtgcggcttcgcatacgacaggattgcagtcagggatcccgtctagtgctcccctatccgtcggcgcaagagctcgtgagtcggctgagtagcggcgaagtaacatccatgattgcgcaatggccactcgcgagggccccctggcataagacaacaccacgctctggcacgacaagcctggcctgccctcagatagatccggcggcgaagctgctgcgcgcctataccgtgatctcagccaacgaggatgcgaccatcaggcatgagagcacctcacgggaacagatgttctgcgtggctcacaccgaaacggggtgtccaggcatgcatgctcccggcttccatggggtgaccaagtgtgctccctaatggtgaacgctccacgtgtgtgccgagccccgcagccaagcaccttggtctgcaggtgcacctttgcagcaacagacccctccgatttttcatccccagggcctttacaggaggtaatgctacccgagcgttaacaactcgtcccccaggggtgcgaccccatacgcagacatccccttagaatctcgacccgtcgccatctgcatcgatcccagacgcacgttgggacggaccaaccacgtggctgaaggcccaagcctgaatgtccacgcctgg

SEQ ID NO: 668365 - DNA, 381 bp, Homo sapiens
aaaacttaaagggggaccccaaacccaaattccccctataccaaaccgatttacaatcaaatacccttcgtttaaaaacatgtaaactaaaaaaccctaacccttcccaaattaaaccccctaaaaacaaatcccctttaaccaatataacgaaataggaaaaaaccccgtcccaatcacctttccaaaaaatttccaaccctaaaacggaatatggaaattttaaactttaattttttgtaaaaattcccttaaaattttaataaaacaacttaatttttaaaccaataacccaaatatccgaaaatcctttataaatcaaaatattctccccaattaaagttcaatatttgcccaattaaaaccaaaatgcccttttaa

SEQ ID NO: 668366 - DNA, 246 bp, Homo sapiens
  misc_feature (38)..(38): n is a, c, g, or t
  misc_feature (54)..(54): n is a, c, g, or t
  misc_feature (169)..(169): n is a, c, g, or t
  misc_feature (190)..(190): n is a, c, g, or t
  misc_feature (226)..(226): n is a, c, g, or t
ctggctgctgctgctgctgcttcgcggaggagcgcagncctggagtgctacacntgcgtgcagaaagcagatgacggatctcccgaacaagatgaagacagtgaagtgcgcgccggcgtggacgtctgcaccgaggccgtggggcggtggagacatcacggacaattgngctggcagtcggggttcggtncgggactcccggcaagaatgaccgcggctggatctnacgggcttctgcgttcatca

SEQ ID NO: 668367 - DNA, 364 bp, Homo sapiens
aaattccccggatttaaaatgggtttttttacttattgaaaggccttttagtgggggttatggggaatattaaagatttttccacccctttccccttttacaggtttataaggtcccatgcttttaaaataggagccagtttaacttccctcttgaatttttttccatttaagtccaacttagttataatttagggttgtcttttaacagcccttcagaaacaaaactgtagaactggggatttgattgggaatggggcttttgcccactttaaaggatttaaggaacggagatataccccaatttttaaattatgggtggtccccagactaaaaataatttaaaaaaaaacccccggtcctta

SEQ ID NO: 668368 - DNA, 638 bp, Homo sapiens
  misc_feature (255)..(255): n is a, c, g, or t
  misc_feature (304)..(304): n is a, c, g, or t
  misc_feature (346)..(346): n is a, c, g, or t
  misc_feature (380)..(380): n is a, c, g, or t
  misc_feature (382)..(382): n is a, c, g, or t
  misc_feature (384)..(384): n is a, c, g, or t
  misc_feature (387)..(389): n is a, c, g, or t
  misc_feature (392)..(393): n is a, c, g, or t
  misc_feature (395)..(395): n is a, c, g, or t
  misc_feature (398)..(398): n is a, c, g, or t
  misc_feature (400)..(400): n is a, c, g, or t
  misc_feature (576)..(576): n is a, c, g, or t
ttatcccagccgggtgacagagtgagacccgtcttaaaacaacaaaaaagtagcagctaacatcaactgaccttttaccaggtgcctattgataccatagtttaatttcttataactgtttcttatttcacttaccaactctgtcttcagttactcccagatttttactgtgtgtgtacagatgaccttttgcttagattgaattgtctccccagaagtaagattactgtgagtcatggtgaatggacattctcnttacccttgatgtaaattgacagggttttgggtgcctcccagctataancttagcactttgggagctaagagaggaggattgctgagccangagttggaggaggcagtatgcagtatggtgagtncntntcnnnatnntntananaattgacaggctttaccctggaaggcttatacacaatttaaacacccctcatagtataagaaagtgcccatttcactgcacctttgccagcacagggtattataatttagtaagtcatttttggtttgattattttacatagataaaagaactcatattactttacttgtcacatntcaacatctttcctcagcttataagctctatttcttttctgtctgtaaatagttatggggga

SEQ ID NO: 668369 - DNA, 1121 bp, Homo sapiens
cgaatagggttcttttatcttgtcaatgcaggttgctcggctcggatcctacgggctagggagctccttgggaatccttgacaacaagaaaggacatgaagtttaggtagtcctagtattatgtgtgccccacgaggaaactttgctcatagccccttagcggcaagaaagggcctaacaagggcatttgctggaatttttggaacccttgaaggaccaagttgttgtttgtacaaggggtaagtccagtttgttagatagtgaaaggtatacgttacgatttgaaaaagggggtataggacgagatagtgtttgcttcattctgggtgtttgttgtcctttagcctccctcctggatgctgcacgagactaatgcgtccgtacacatggatacatgacccttgcatctgtcactataagacgccgttagtaggcctaggtgctacagcagagaccagcgtgctagtagctcctacgctgatcaccttcgacctctacaggcaggctgtgcgcattggcgattgcacgaagcagaggggctcgacgggcgagaacggggctttacaggagagtggattgtgttagtaatcgctggcttgtcaccagggggacataggaaaaatttgtgtacatgctggccttccggtgcactataattctctatcacacgcaatgggcgccaggctaaattcacgcgcgtctctgcaacttgcctgtagtactagaagtagtaagaggttcaagggactgtctgaacacagacgcaaatcacatgggggcgtaacgtgctcgggaagcacgtggggcgtgtgtgtatttcattcgttataacactagtatgttagtacttagcgtgaaacgaaccaaagtctaccctccacggccgctgaggcccttaatcagtgtcgcgacgtgattaaaaacctttgctacattccacggactgttaagcgccggtaggaaagagagaggaggagggggaagagagcaaaccatcggttcttacaggccctggacgtgctcctatgggctagggccaaggtttgtatgtaccacaccatgcatgactacagatgccctcaggtccctgtataacatccgtaggatactgcattgtttgg

SEQ ID NO: 668370 - DNA, 988 bp, Homo sapiens
cagcctgcatcgcaagcacacaccctgcgggccttcaagtctcactgttccgtatgaggaaacagacagcggactgaggaagcgatggccccagagaaagggcccctgtagcctggctctcacacagtattttatctttgattctgaataaatatttttgtggggtttttttttttttttggggggcagttgttggtttaaaactgaccatttggaagaaacacctgggttatcgggggttttcatgcctggtccctggcctctacccccacccctttggagtcggggtgactcatttttcggttgtagagactcgggggcccaggcaggaggtgaaagcagccatccggaaggcccgggggaccctggtgctgtggctcgccttcaggtcaccagctgagcgtgcgataggaaaatctgatggaggcagcaaacgggcaaaaaaaagattccccaccgggcctgggtgcatatgaagtcttcttccccgacaatctggaacgagtgatgatatcagacgaagcatggatgtatgggaagaaggaaggaaaaacaaatatttttatatgtgtgcaagaggcagacaattccaggggtgtggggtacaggagtgtggattgagattccagaaaaccaattccggtgacacaggtaagctcgaccaagggactttggggagccgggtgtgtagcatggtgtgggtgtcccaagccctgttccggggaagaatctgggtgcagcaattcttcagtgaacacacgtttggagcaaggaggcctaaggaatggcttagcgttactgtacggagcaagttgcggtgccgggtttccgaatgtactgtgcctggttggaaacacggccagagaggtatcaacacggacgagtgcgggacacgggggtgccaagaggcgcgaggcccgtgggcctacggcgccagtgaggatacaggtagggtgaccgcgtgtgcgcgctacgggctcaatatcgc

SEQ ID NO: 668371 - DNA, 991 bp, Homo sapiens
ggatgtgactgctgcccgagctgctcggatccagcgacatgtggcgtcctggacattgtcgaccatatcctggaccgcctggcgtaaccttcattattcacggtcgaataggttggcagggtgatgtgtgtcccgctagcggtatcaatattcaaagaggcagaaagggcaatcgaaacgagctagtatggagccgggcgcgtcgtctgccacaaccattgagagttagcagtctcgcacgcgtatgggagatatacactgcaacatgaatagcagtgctaacatgcgtcacatagatcattccgggcaggcactcaaactcatcttgtgaatatacatcatgagcctcgatgaatgcactctttgcatactaaaatagcttgtacacgtaatcctatgagtagtggttcgagaggctttgtagcccgaaatgcggatgagatgctgcaagctatgcgcgagttgcagactggttgtccctatgggccaggtacgcgctggttgcgtataccaatgtattactccccccaactggctcaagagatcgggcagcaacaatctatagtcggtcgccgttcctggagcacgtacgcgaccgacatgcccccgatgatacccaagtagtgagctagcaattcttgactattcaagttaacttatctaccgaagctgtcgacatactcaattaacaacgagcaatacaagcacttgtagtttgtgtaagatcccctgcgcagggaaggaaattagtccatgaaaaccagagtgatatcgccacaaagtggattccttaacagtaagatccctggcgcagtgtgcactgcgtggcgtgggtttcgtgcgtggaccggggtgtactcatgcgaatgtacgaagtctcagattccgtttatggcatgtcctgtgagcaggaggaaggccgggttaccgggggacgtacggtccgccgcctctgccgaagggagactgtggaccaatcacccgggccaaa

SEQ ID NO: 668372 - DNA, 171 bp, Homo sapiens
  misc_feature (27)..(27): n is a, c, g, or t
  misc_feature (77)..(77): n is a, c, g, or t
  misc_feature (98)..(100): n is a, c, g, or t
atttcaataaatctctaataaatattnatatgttttgggtttttttcttcaaaatggatgataacttttgggtaatntgtctttatgttttttatatnnntttttttttttcccccttttatttaaacttttaatcttgcattactttcatgtcttggtggaattcttttt

SEQ ID NO: 668373 - DNA, 243 bp, Homo sapiens
tgcctgactatttgtggtgctgctgacttttaggttgtggctgtgtagagacaggagtctcactccattgcccaggctggagtgcagtcgtgcatcacagctcactatagcctcaacctcctaggttcaattgatcttcccaccttagcctcccaagtagctgggaacgcaggcatgctattggatctatttcactccactaaaaaaggcgataaaaggcaagctggatgtctaagcataaac

SEQ ID NO: 668374 - DNA, 515 bp, Homo sapiens
ggggtcccccccggggggggccgctttagaaatagtgggtcccccggggtgcaggaatttggcccgaggttacctttgttgttttgggggtgaagaaaaaggggccacccgctttcctttatttaggaccctgcccccttattactgcccccgttgttgcctggagacgtaaggaaatgaaaaagttttggaaagggtaccgctttccgatgatgggccctttgggttgggccccaaaagaaaaaaaccctgtgatatttggtgaacagattgtccccccataatattatgggggaccgctaaaaaggggccttgattttttccaaaaagacttcgactttttaaattggcttttgaattgcccatttgaaaaagttttcaatgatatgcttgcaaaaaaatatttttatgagctggggctgcccgttccctcataaaaaaataaaaccctttgcttttaatgttaaaattgggccttccccttaaataaaacaaatggtttgggtagtttccca

SEQ ID NO: 668375 - DNA, 150 bp, Homo sapiens
aatcccggtatagtgtgatcaccttgctccagtcaacggttaccacggatgatcaacactctgtcgagattgcaccatgaagctttgagtgaagctcttcctgagtacaatgtgggctttactgtctagactgtgtctgtcatggatgtt

SEQ ID NO: 668376 - DNA, 494 bp, Homo sapiens
tcgatctaagatcccttgggcccatcagggcactcggcctagttgtgtacacagcggtgatggcatgcagggcaagcggggtgggtcaatgggctagagagaaataacctcatttgcatattcttactactggccttgggaataaagggtatctctctgggcctgggttcctcccacttgatattcacaggtctctgagcagtctatcctctctccttcctggccgggggctctgaggagagtgcacggctggtaggagggccccctaatgtcttgccagggcagtcagtcaataaagaccgggccacttcttggggaaagtcactcctcctgaacctgaatgcacattcaggcacagtcactcagtttaagcacaagcatgtacaacaagcgcttcgggagtcaggggcagtactggtcctgtctatcagaacacggtctgatcagtaagtcttctggcctccctttggagtctagaggctgccatcgtgggt

SEQ ID NO: 668377 - DNA, 926 bp, Homo sapiens
gcctggatccaggcggagggagcacgactccgtgtgtcgaggctggtaggggagcgaggagggccacataagtccagattccatcagctcggctagtaccacaagtgactgaacgtacttctataagctcgccgtgcacttgttccccatacgtacgagggtgacccgccaacgaagctgctacaacgaaggatgctcaggtattcggatactattccagtacagagctgtgtgtggtcccgcgaacgcggtgttgtctggtggtctgctcctgatcctcgcgagctacacgtgtgcactttggccgtggctgtgaaccgtacggtggcccatcacttccctcggttactctacttcactgggcagcaggggggcccgggctccagcagggatgcaggtggtgtctcatggggatgagcggcccgcctggctcatgtcagagaccctgacgccaccttcacacacactttggggccgactacgactggttcttcatcatgcaggatgacacatatgtgcaggacccccgacctggcagcccttgctggccacctcagcatcaaccaagacctgtacttaggccgtggcagagagagttcatatggacgcaggcgagcaggcccaggtacatgtcatgggggctttggactacctgttgtcaccggagtctcctgcttcgtctgcaggcacatctggatggctgccgagagagacattctcagttgcccgtcctgacgagtggcttggacgctgcctcattgactctctgaggcgtcggctgatgtatcacagaccaagggcagcagtatcagctcatttagaactgggcaacaatagggaccctgagaaggaacggagctcggatttcctgagtgccttcgccgtgaaccctgtactcgaagggtacctcatgtaccggttcccca

SEQ ID NO: 668378 - DNA, 242 bp, Homo sapiens
gctacacagccaacgaacttgatagaatgctgtggtgcagactgtgtaaggcatcctacgtcgcctctaccaaataccaaaagtcacaggctatggcttccctacaaccttccgtgctgtgtcatgcgaagatgtaaggcacctagagaaataagccattaggtgtagacaattgagacgttcaattatctacacatacacaccctgcaaggctgagagactataagtatcggcgcaactcg

SEQ ID NO: 668379 - DNA, 702 bp, Homo sapiens
gtgggcaggggtggcagaggaacacgagcagccatctgcccgtacccccttgtcctctctgtgaagcccatggccccgttgtttcccagggaacttgtgagccttcttccgctgtgaacggtcctacgtctatacttgccaatcctctccccctgctgtatgcagccccttccccggggagtttggtgactttcgtctatgtcaccatagtgagactgtccagggggagggaggagaggaaggagcgggatcagagctgtcccaaagagggaaagcggtcgagctattgaggaggggcagaagcagggccggcaaaggtctagctaccttaactaacggtcggtatggagcggagttggggtcaggccctgaacatcgtccgtactctgagaatctgtacaggggaaaaagtacaaggggagcaggaggaagagccaggagggccagaggcagacgaacgagatggagtcattaggggaccagggctgagcgaggcggctaccagggcactagaggtgcttcttgggggcgggggaatgcagccagatgtccccctcccctcttccaccccagctccagcctggtcttgtcttttcatccctcttccccacgacagaagaagcttgtggcccatggcactgtcatcgtgttcctgtgtcccgtgcatgtaccccacaatccacccgttccttttgccggctg

SEQ ID NO: 668380 - DNA, 349 bp, Homo sapiens
cccggggggggggcccaaaacccccttccctttccaggcaaaggtggattttaaccctttgaacccgggccaaaaaaggggaaaaaatcctttttttttcccccatttaaaaaactgaaaaagggggggtttttttttgcgggaaatgaaaccccctttaaccaaaaatggttccccccccgggggggtttttttttttcccccccccttccggaaaaggggttttccccccgaaaggccgaaattttttttttttccccttttttttaaaggggggttttaaaaaccaattttgggaaaatttccccgccccccccttttttttgggggggttttttaacccccttta

SEQ ID NO: 668381 - DNA, 1023 bp, Homo sapiens
gcctagcgtgctcgctcgctcatgctttccttccctccctcggtcttccttcgcacgctgttggtgatgtggcgctcgcgaacagacagggaggcggtggcagaggacacttgtcatggccgcctctaaacctgtggaggcagcgggtggtcgcagccgctgtaccgagctccgggagtggggtgggcggcgggcgggactgttggcaccgggcacgggggggctgccgcgatggcagactggctctggcggtcggggcacccctgctgctgggcgcgggtgccatatacctgtggcgtcggcagcaacggcgccgggaggccagaggacggggcgacgccagacggactgaaaggcgacaacaggaacggaagaacccggagggcagggccaagtccggacccgggcagcaggacaccctgaaggtcccggtgctcacttggacactgacactctcttgatagagaccaaagcagacaagaataaaggcacttacactctttaaagcaggaaattatgaccaagctattcagatgctatactgaggtacttagcattgtgcctacagagaagaatgtgacttatctacatggactcaaacgcccgagcagcatgccttaggaaccagatgcacacaactggaacgcacgggcgcgcagacaggtgcagaacgcgatgaattaagaccgcaactatggtgagaggctcaccttagaaccgggccagaggcccaaggagaaggcggaccagacacgagggcagggagccgcagatgacaacgggagggagattgacgaggggtacaaaccacaccaggcgggggataaggcggcaaagacctcacgaactgaaaccaaggacacgcaaggaacgacagcggccgatgaagacccacgggcgagctaagcggatcacacagagcagagagcgaaacagccagggagacggaggaaacagggaggcaaaatcaagagaacagagacgaaggaaccgccaggaggaggcaggcaggacgcgacagca

SEQ ID NO: 668382 - DNA, 529 bp, Homo sapiens
  misc_feature (415)..(415): n is a, c, g, or t
aaaactttacctttttaacagggggcctcccatatgcccagcaattcccttcctgggtttatatcaaaaagaattaaacgcagggctttaaaaggtgcttataccccagtgttcataccagcattattcccaatagccaaaagttggaaataaccccagtgtcctccaatggatgaatggatatccaaattgtgatatccccatccaatggaatattcagttttaaaagggaatgaagctaggtgtgatggctcgtgcctgcaatcccagcactatgggaggccaaggtgggaggatcacttgagcttaggagtttaagaccagcctgggcaacatagtaagccctcatttctactaagattaaaaaattaccaggtgtagtggcatgcatctgtggtcccagctccttagccgntggggcagaagggctgcttgagtccaggaggtcaaggctacagtgaccataattatgccactgccctccagcctgggtgacaaagtgagcccttgtctcgaaatcaattcgaat

SEQ ID NO: 668383 - DNA, 407 bp, Homo sapiens
aaggtagtttgatttttcattgaattctacaagctaatattgttccacgtatgtagtcttagaccaatagctgtaactatcagctgcaataccatggtgaccagctgttacaaaagattttttcctgttttatctgaaacatactggatttatatatgtataagcgcctcaatggggaattagagccagatgttatgaattagagccagatgttatgatttgtttgctctttttcttttatagttatagcaaaaatatggataatttttagtgaatgcataaattaggttgcgtttcttattttgctttaaatctctggtagtttttccacccctgtgacacaatcctaatagacagtgtcctgtaaatggacacaactcaataaagtcaagttattattgctgtta

SEQ ID NO: 668384 - DNA, 268 bp, Homo sapiens
  misc_feature (42)..(42): n is a, c, g, or t
  misc_feature (67)..(67): n is a, c, g, or t
  misc_feature (126)..(126): n is a, c, g, or t
  misc_feature (143)..(143): n is a, c, g, or t
  misc_feature (202)..(202): n is a, c, g, or t
atcggaaccaatgagccagaaaccagagagagcaggataaanctcaagtccaaagaggagaaaaggnctgccttaaattagattggacctaaacctgggggtttctcaaggcaaaactctcttganctttggggccagattgnccttgtctgtggggctgtccctgtgcgttaatggtcttgtttaggcagcaaccctggtncctggcccactaagattgctggtggcacccaaaccaaaacgctcatttgggttcccgatggggtac

SEQ ID NO: 668385 - DNA, 355 bp, Homo sapiens
gggggttttgggccccccctttgcccccccggaggaaatttccccgccgggggggggtttcccccccggcccccaatggaagctttcccggtgggccccccccctggggggggccccttggggtagggtgggggttttccttagggccccaaaccccccccccctttgggggttttgggctcccttgggtggccccccccccaagtttgccttccctttcctggtcccccggggtttatttttttttttttttaaaaatcctttttaaggttttttttttaccttaaaggggggcctggccccttttttaaaaaaagtttcccttgttttaaaggggttttaaggtccccaggga

SEQ ID NO: 668386 - DNA, 662 bp, Homo sapiens
  misc_feature (523)..(523): n is a, c, g, or t
  misc_feature (531)..(531): n is a, c, g, or t
  misc_feature (567)..(567): n is a, c, g, or t
  misc_feature (625)..(625): n is a, c, g, or t
aagctttcagccctggaatgctcagcatctgccatctaacttccatttaaaacgttttgagcatttgctgatacaggttcctctgtcctttccccattattttcagttccttggccttgcccatagtgatctgtggatattgtctgcatactcttttttagaaacctagagcatcgcagtgtccttaattttcctcttcaaactctatatattcctgagctgatcatccctactgctgttcctacagaactgtgtgactaatcttctatatatgtccctacatctagccatctaggtggagatctaggtacctatctccctaaaattgtacttggtatccacattgacctcaggacagtatgtgataggctcttgtgccttttcgactaggagtttgaaaacatccactcttcatatttattgtcacatttgttgaataatttgggctcttgtccattatgtctcagtcagtggagcccagggtgggcctgagccagagtgtttgtgtccctagttctctttnggttctgntacagctctcagtgacagtgtcattgaggctaacanggacagagtactgctttcagccaccatttgtccaatgagtggctgatcttccagcctnttgctttgagaacatctgtgatatctggcagcatcct

SEQ ID NO: 668387 - DNA, 215 bp, Homo sapiens
  misc_feature (153)..(153): n is a, c, g, or t
  misc_feature (167)..(167): n is a, c, g, or t
gatagatcgagctcggtacctttcttcccacaacactttctcgtgcctatctggaatgccccgatgttactctggactacccctgatgcatacaccacatgaaacatcctatcatcttgtagtgctcattggtgttcctgatgggtggatccntctatgagtctgancctgcatgtgcatgcaatgcttgtgcacttggcctgtctgttattaca

SEQ ID NO: 668388 - DNA, 1436 bp, Homo sapiens
  misc_feature (954)..(954): n is a, c, g, or t
tgttttggcgtcggggtactcacattctgtctgtgtgttctcccccgatggtcttgccgggtgtgtttggtcgcgctttctgccgcagtctgtgtggtggctctttgtcccccgggctccggccttgggcccagggatctgcgcgggtgttcgctgtgtcgcgcggtgtgcccagatcacgctcaggggcccaaggcggcgaattagttgtccggggatgagcccttcgagcgcgcagctctcgggccccgtttatgtggcctgtgggctccctatcgggccgctgtccctctggggttcgtgatgcccctgggggatttaggggcttccggctttcggccttgctgggagggcaccaagggggcatcagccgcctgtggcgtgtgcatgcccgatggcaaccgcttcttgctccaggatgcccgcaaggatgctcgagctgcctgttgctgggatttccggcagttctggttacgcccctgtggtcccctgggttgaggaggtgaccccccatcgacgcgcatgttacttcgattctggacccgaccgggcagttcctaagtgaatggcagcaccgatgccgcgggctgttcttctgtgtggggacaccggacgggcctggcaatagatgggaaagccggagcccctgttgagtttttctggccccacgagaggactgccccacatggcgtgagcctgcacccctagcctgcctttcctggccacgctgcctccggttacgcgtgtgtttcctgaggcccccacgaggaagtggggacgaaggaagaggacctgggccttcccttgctctccaccgcgccaccgtccacaccttgaaatgtcggcttcagcttctggtggtgtgggggggccccagactccacgcatccctgatgatcaccagggcgagaaagggcagggaggaacggagggaggtgtgggtgagctgatatnaaaaggtttttatgataaaaaaaaaaaaaaaaaaaaaaaaaaaaaaaaaaaaaaaaaaaaaaaaaagaaaaaaaaaaaaaggaaaaaaaaaaaaaaaaacaaaaaaaaaaaaaaaaaaaaaaaaaaaacaagaccagaaacgagaacaaacaagcaaaaaagcacagggcgcggagggggggggcgggagggcgccagaaaaacaggaggaaagaggagagaggggagggagagcacaaaagaaaagacgcaaagaagcacaaagggaaaagagaacagacggaacagaagacacgagggggcaggaaagaaagaaagaagaaaaggggagcggggggagagaaggggagaggggagagaaaaaggaggcgagcggagagggggaggacgggaaaggaggagaggagcagagaccggagggacagcggagggggagaggagggggaaggaaaggaacgggcgggggaggcgggggggagaac

SEQ ID NO: 668389 - DNA, 180 bp, Homo sapiens
  misc_feature (118)..(118): n is a, c, g, or t
  misc_feature (132)..(132): n is a, c, g, or t
tacgcgtattgcaagctgcgctgacttcatcactctgcgccttccacctggcttcccctgtcaaaattgagattccccttttccacgtgctcaatgccctgtcttcaaggtggatccntctatgagtctgancctgcatgtgcatgcaatgcttgtgcacttggcctgtctgttattaca

SEQ ID NO: 668390 - DNA, 314 bp, Homo sapiens
ctagctaatattctgctccagtacatgtaccccgttcttctgatacttcgtgggggagagtgcttgagactcagcaccggggcccggaggccaggtgatcgacatgattgacaactaccccgatgtgagacggccagaaggtgcttcccaaggatgacattgagtgcccactgcgctggaagtgggaacatgaggaatggtccacagacctctataccgagctgtctatgaccaaggctgcgagtatagcatcaccatccccccggagcggaagccgaaccactgggtccccgctgataagatgtactacacac

SEQ ID NO: 668391 - DNA, 572 bp, Homo sapiens
taagctcatcagctatggttagtgtaagtgtatttaatgtgtggtccaaaacaattcttcttccattggtggaccagggaagccaaaagattggacacccctgtctagggcaaggattccaaaagttattgttctggtataaaacttgcttttagattccaggaacactgtgtttcaaagtgcaaatttccgtggctccaaattcttcaaagattcagctctctcgtgcacgtttgggacatttttataacaagcaacccctcatgtgattttaatgactccttaagtttgtgacaattctcatagggcctgtggctcttcaaaatgtgacacatgtgcattaccctttgaaaacacaccaacatttttcccatgtgggggtaaggattacattgcattagctctatgtggaaaccaactttaaaaagtgttccaatttttccattattgttgtttgctccttaaaattatgtggtgcctctgagtgagagccccctttcagaattcttacacatttcctcttttaccttccctttttcaaaaaacagccaaatacctcccttatcctttcc

SEQ ID NO: 668392 - DNA, 258 bp, Homo sapiens
cccgggggggggggcctgggggggcccctttttttgtttcccttttttttgtatcccccccttggcgggccccccccccggtggggtggggggttttgtgataattttttctttttttccccgggggtttgacgccaggtttgggggcccctccccgggggcccccgtgccccccctccttttttttttaaaggtttttttttttcccccccgcgagccaaagaaaataaaattggtggtaataatgacattattata

SEQ ID NO: 668393 - DNA, 697 bp, Homo sapiens
aggtcagcactgtgtggcacgtgttccggggcacagggacgcccagcgcatccgccggtaggtccagatggtgtgcccggccggggcaggcgccctggagcctggcgccgcaggcagctggtacctggatgcagggctgcggcgggcctgtcgggaaggaagtggcggcgtgagctagctggagctctgctcaaggcccggccgggagagggccagggcttggtgccatgctaggggctctcccatcaggatgcgatgggccttggtgaggcactaaggtcaggctgtcaaatcatggcaccgtgtcccattctctgcgcatgaaggaccatcgtgcacgctcgtcatttgacatctaagaacattccgtgtgtcgccaaacaccaaaagcggggaccactcaaagggcacaatgtccacgcacacattgaacatggcgcaaccttgctttataatgccgcagataggacacttgtgagcctgttgtgtccaaagcaaggtgcaaggttggccagtggtcgcacacttgctaggggatggccaagatacgaagggattgcaaaagtgacgggcgaatcagagagtggggacacaaggtcacagcacggtgctacagcccaggccccaacttcagcagggggatgacgcctagggagactaggagatacatgatcaccccacaagcacattctgggaa

SEQ ID NO: 668394 - DNA, 229 bp, Homo sapiens
agtgagcgagatcgtgcactgtaccccacctgggggacagagcgagacttcatctcaaaaaaaaaaaaaaatcagttgggcttggtggtgcacattttatagtcccagctatgtgggaggctgaaacaggaagattgtttaaacccaggagttcaaagttacaggaagttaggatcacacaactgcactccagcctgggtgacagaatgagacactgtctcaaaaaaaa

SEQ ID NO: 668395 - DNA, 345 bp, Homo sapiens
  misc_feature (7)..(7): n is a, c, g, or t
  misc_feature (20)..(20): n is a, c, g, or t
  misc_feature (54)..(54): n is a, c, g, or t
  misc_feature (64)..(64): n is a, c, g, or t
  misc_feature (75)..(75): n is a, c, g, or t
  misc_feature (82)..(82): n is a, c, g, or t
  misc_feature (88)..(88): n is a, c, g, or t
  misc_feature (100)..(100): n is a, c, g, or t
  misc_feature (103)..(103): n is a, c, g, or t
  misc_feature (119)..(119): n is a, c, g, or t
  misc_feature (158)..(158): n is a, c, g, or t
  misc_feature (187)..(187): n is a, c, g, or t
  misc_feature (249)..(249): n is a, c, g, or t
  misc_feature (275)..(275): n is a, c, g, or t
  misc_feature (295)..(301): n is a, c, g, or t
  misc_feature (322)..(322): n is a, c, g, or t
  misc_feature (341)..(341): n is a, c, g, or t
  misc_feature (344)..(345): n is a, c, g, or t
aaataantgacaatatgaanctatacatagaacttaggaagtctcatcttcctnaaaatgactntgtggatcccncccaaanccaacncatcctggtttnctncacactggttcatcancagaaggttaccgaggaaggaactaaaggtgtttgcacntcatgttactttttgagtttataaacatnaaaacagaatttactctgttacagaacctagttactgggaattcattacttgccatggactncctttgctaagaaaagtctgaatganaagatggcaggacgtctgannnnnnnagttataattaataaaatctncggagaattgtaaaaaaanccnn

SEQ ID NO: 668396 - DNA, 1039 bp, Homo sapiens
  misc_feature (504)..(504): n is a, c, g, or t
gatgttaggacgaaggggaaggaggagaagcgcttaaagcggtgcggtggtagctgggttgttcgggatgaggggttggtacccagggctgagtgcagtgcccctgacctccctcccgcctcagtggatcatgcccagaggcgagcagcggcgtgacggtagcggtgtgggcaagtgactgtggcggtgccttgccaccaggagacgatgccagtcgtgcccaagtttaccaaccacaaggggaatcatcaatgcataacgacaatctcggccacaaggaaagcccacgttatgggcacttcacctttctcactatcagggctctaggcacgccccccaaagggagaacttgagctggcggtactttaacaacgacgaaagcctatctttggacgcacagttgcaaccagcccccctttcggcggcgcctcacgcaggcacacgcacgggcaccagcagcgcaaacctcgcccaagccgccccacgcaatctcacccaacaccnctctgggcggcaacaccacctcaccacattcaaccccttggtgtcacaaccagcagcctgctcattaccccgcacggcacacattccatcttggaccacagcccagcagccaacactcgtctcccgcgcgcacatccttgcctaccatcgccaacacattgctctcgccccagagggaacaacaacactttccgaccaccattttcggggaactcttctaaccgcacattcccagcgacactgcaccaatccaccaccaccagcggtcgccctcccacttcatcgcacccgccacttcgcgcacgtatatctccgccaccccacccaacacacttgttccgcactaccgaacacgttgcacaccttactcacacaccccttccctctcccatatttccacttccccgcgtctgcacaacttccaccaccggggcacccacacacgtctacaaaacacattctacacccacaccccttatcctgcacgaccacccacccccttacactccacccccacacatacaatttcacacag

SEQ ID NO: 668397 - DNA, 442 bp, Homo sapiens
aaattcggccattatggccggggtatttaaaactcagatgggccacataatggccacggatttccgaagtttggatttggattaccattgccgggattactgggggttaaattttttaaaacctgaccactgggattatggggtttggaaatttagcagaactttaactggtggaaaaaatagacctgaattatgggaaacttttggaaaggttaaatcggatttcaaattaatcatggaaatccaattccatggtaaggttgtccagaaggttttagagattatatggggatgctggaacttgaagtgagacacacatcattgggcatttgagttgaagggtaattaacagtattgctgccgttgttcggaacttaaggacactggacctgttgggcctgtggccacttctgaaagggaaattctttgtggcagataactg

SEQ ID NO: 668398 - DNA, 141 bp, Homo sapiens
  misc_feature (32)..(32): n is a, c, g, or t
  misc_feature (42)..(42): n is a, c, g, or t
  misc_feature (93)..(93): n is a, c, g, or t
caggcggccaccaagtacacagacggggcccngggggcaagntacacaccatcccagcacgctccacccacctcaagaccccggccagtgggntgcagacccccacaagcacaccggcgcctggttttgccacacgcaccc

SEQ ID NO: 668399 - DNA, 112 bp, Homo sapiens
ttaaatagagacggggtttacgccatgtaggaccaggctggtcttgaacacctagacctcaggtagatcctaccctacttaggcctcccacagtagtgctagggattaacca

SEQ ID NO: 668400 - DNA, 320 bp, Homo sapiens
aagaggggggaagatcaggtcatactatctactctcctcatctctgacagttaaagacaacaattacatctaattaaaatgctgagagatcctgagcgtgttagacgcatgaggagagtagatagtatgaacccgatcttactgcctactgtgtaaagccggatgcatcgtagttaaacaaagtagacaacatcattagagcgaggcgtggatgggtgacgcgcctgtagatcccaagctactctgagagcgctgaggcagggagaatggcgatgagacctggaagtgcggagtttgcagatgaggctgaggatggtgcc

SEQ ID NO: 668401 - DNA, 251 bp, Homo sapiens
ctgctatagtgtgtcatttcaggctcccagattggtcatagcaacatgagcggcgaatgtcaggggttacagcattctgatcatagccgtcaatcttgaagtctgccaggtggtgatagaaagtggagcataacggatattggccctggctagtgcgtacatacgacggttggtgaccgctggaatgatctgatctaaggcctcatcgtagggcactatatgctacgcgcaccggtgtatgaacagcgtat

SEQ ID NO: 668402 - DNA, 567 bp, Homo sapiens
cgcgagtgtcctaaaaagttttttcagcacgtcgaacaatcaacttcttccagcccccactctacatcaaaatgtgcagctttgacacgacaggttacgcagtattttttttttcttcagggtccacgagggatagatttatgcagcatctcaaagtcctcttcatgtgggctaatggatttcacattaacctgaactcgggatatctggatggtgggacctctccttttccctggtccttttccctcgcgggcattttctttacagctgctcttcgtataccggcatggttgacacacagatgtggtggatcagttacacccaggcgcttcagatctgccaccgacttatctaccagctcagcatcaggtgctaatgaacttccagcggttcaagagggagaccaaacttcttataagccttgatgaaccttcggatctctgcatcagtaaatccctccacgaggtccttcggaaaactcctcggacgccctctgcgcttgggattcttgtaatcatcagagtcttcggtttcactctcggaagcagaggatctctggggctgcct

SEQ ID NO: 668403 - DNA, 1827 bp, Homo sapiens
ggagacctccacaggggagctgctgatccgctgcttcaactccttcaatgaccgtcaccatggttctggtctcctggcatcatggtggattcgcacccttgatggccagtcactgtgccgtggctggtgtggcgaaggatcgtggagcatggaggatgtggggctgacatcgtttagacccgagcttggagaagctatcaatttctgtgacatgaccatgactggtggcatcaggtctgaatccgaatgggacatccgtggctagctgcctccttcattcgtatgttgccatgcgttcacatccgatgaataagaggcctcatagccgtcgtgtgctgtgatgggacgccactcgaatgaaccgtcgacgtgggcccatcgtgtagcattttgaggaacccatacgtaatccaagctgtcgccgttgcaacagtcgtcgacatcggcatggcattcgcagtgcataggatggcggatgcggcatgggacgaaacagtgatactgggggtgtagagacgcacgagggcaacgtactacaagtggcggcgtcattgagatacccatggcaccggaatcgaagaagagatgcatcccgttccaagccagtgtgaatgagggtggaacgaggagaaaagaaattatccagttgtaggagatgagtaaacagacaaaagttggactatcaaatttagaaaagataagaaggattaaggaccaaagaccaaggggaccaattatgtagaagcaatgtgaggcaatttaaggggaatccaatttgaaacaggaatagcgaatggggtaaccgagtggagacaccatcgaagaggagaagcgctagatgaagagatagtgaagtggtgcctaaggacagagtgagcaaaatagctaaagtgacgtggaagaacggagttcggtgtcgaataacaagatgcactggggaagcagagtaataaatgctattgagaaatagatacagtaacggaatagacataatatccatgggaaaccagaaaactacaaaataatactattatattttagacataccaatatgaggaacgatgatagaggaagaaatggcggcataaaagttttgggagagcacggaggaaggaagtggaaaacacggcagaccgacaagatggtagtcgaacaagtgatgaaaccacccaccgtagagagggggaccaagtaaacaacacctgaccagagaaaacgtgacacggatggagaaccagcacacaacgggaggcgaccagacatggacaacaggacgacgaataagcgaacgacaggaagtgagcaacagcaccagaagtgagcaaaaaacgagcgaacgatggggtacacgacgagaacacatagacagacggacgaaaaaacagacaagcaagagacggacaagagacaaacgagacacgagacgccacgacagcctatacaagaaggtgtgaaacagtagaagcgaaacagcaacgagaaaaaactcagaagaaaaagaaaatcaaagaacacatgcacgccgcaaggaggcaacacttacagctgcgatgtgcgccggagaatcaatagatcaagcatggacgaaagaatcaagagcagacacgagggacatagatgggaacagcaagcaacgcacacatgcagcatgagagacaacagacagagaacgacgaccgccaccacaagagacggagcaacatagacacaaacaagacggcggacggctgacgaaaacacacgaagacacaagaaaagcaagaagctcatcaaagcaggcaaataactaagtaacatgagcgctgccaacaccatgactaagagaca

SEQ ID NO: 668404 - DNA, 233 bp, Homo sapiens
  misc_feature (157)..(157): n is a, c, g, or t
gacatagagatcagtgtgaaggagttgcggacaatcctcaataggatcatcagcaagacacaaagaactgcggaccaagggcttcagcctagagttgtgccgcagcatggtgaacctcatggatcgtgatggcaatgggaagctgggcctggtgganttcaacatcctgtggaaccgctagcagaatgaccttccatgcttccggaattgactaggacaatgcggcagcagga

SEQ ID NO: 668405 - DNA, 924 bp, Homo sapiens
gcgtcgcgctagtctcacttctaggattactagtatatcggtcacgcctcatatcctccctagtatgcctagaaggaataatagtatcggtgttcattatagctactctgcataaccctcaagaaccactccctcttagccaatattgtgcctatggccatactagtcttcgccgtctgcgaagcagtggctgggcctagccgctatatagtctcactgctcgcaagcagcagtagtgggcctagaacgtacgtgacaataagcctaaagcctactccaagtgctatgagacataactcgctgcgcaaacaagtatgagtattaactatccagctggagcagtgtacgttctccaaaagaacagcataattgggaatcaatggcaggcacccacaggcctaattattagcatcagtccccttcttacgtaatcttctgctaaacgcatatatctaacaaactaactcttatttacgcgtggttcctcgcaatacgcattttttcgcttgcctgactcgcctctaacaaacgcgccaccgtccgttaaatacgtagacttacacttggactgtacgtacccgccgtcacaaaagtcgatgggcaaagctcaaagggcgcatctttaatcccaggtgaggaccggctgatgcaacgataagaatcaacgtactacctgctgctatatctaatcttgcctatcaaagtctgcgcttacagtctataacgattcactagtccacaagagctagtcattatatgaatatgtatctttgcgaaagcatgacttatgccccatcatttgggtatcaacacccgatgaggcaaccaggcagaagtcctgaagtgcagcacctaattgctatgctaaaccgtagaaggtccttccctaacgcgtggactaattaactccaaccctaggtccta

SEQ ID NO: 668406 - DNA, 150 bp, Homo sapiens
gagcaatgacatcacgaagggacagtcaggcgaatgttatacacaagctcatcgtctgtcatctccgcgtgagcaacagctacagccagacataacagcttcttcatttggcacttgattgtggacttcacctcatccacgatgatctct

SEQ ID NO: 668407 - DNA, 402 bp, Homo sapiens
gcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcacttaggctaaggcaggcggatcacaacatctagagatcctggccaacgcggtgaaaccctgtctgtactaaaaatacaaaataactgggcatggtggtgtgcacctgtgggaggctgaggcagaattgctggaacccgggagatggaggttgtactgagctgagaccttgccactgcgctccagcctggtgacagagttaagtctcaaaatctaggtaagcactaagtgggctttaatacagcatattcc

SEQ ID NO: 668408 - DNA, 106 bp, Homo sapiens
taaccatcacactccatcacactccatcacactccatcacactccatcacactccagcctagtgcaaaagagcaagagtctgtctcaaaaaaaaaaattgtcttac

SEQ ID NO: 668409 - DNA, 313 bp, Homo sapiens
  misc_feature (223)..(223): n is a, c, g, or t
  misc_feature (249)..(249): n is a, c, g, or t
  misc_feature (270)..(270): n is a, c, g, or t
  misc_feature (274)..(274): n is a, c, g, or t
cgtctacgccatgtggtcaccgtaacaccttttctcttcaacagctggctcctgtactttacgaaatagttgctttgtgtataacctcctttgcatgccggagtcctcgtacacaggcactctctgttgggggctctggagccgggtggagacaaaatttcatcaactaccggcccaccccaagggttggcgggcatcagcgggtgaggtccgagaggcgggncaccattagcgggaaggggtcggctntggtgattaggagtagttccncttntcgttcactccagcgtgctgataccagggtaccgagctc

SEQ ID NO: 668410 - DNA, 273 bp, Homo sapiens
ggatttagataaaaaagaaaatggattacgtgatatttagctgttcttcctatgaaaagggatgggtctttcacatgtgacatgcccagatcaagaaactggaaaatgtgaagccatctctattgagatagcctcttagtgttttagagaaatcaagaatttttaaaaccaagaatatccccctttggttttgggtataagtggggtttgtattaaaaaactttttcaatgacctgtataaactatgttttttttaacccccatatatccgta

SEQ ID NO: 668411 - DNA, 943 bp, Homo sapiens
gacgagtgtggcacgtcccctgaaaccacggggaggggagacccatctctaacctcaatgtgcagggaatgcggaacccctgagagtgatgtgcgcccccggaatttctgtcttgaaagacgcacgtcgccaccaggctcgtttaggggacattgtttgggagaacacgccgccaataatttatgatgattgtattcgcagtgcgttgaccaacaccatccggcctgaccacccgtgaggaagcattttatcagtccgtgccgatccgattgtacacactggggccacacaccccacatgcccgagaaggtactcccctctcggggcgaaatttttaacgccgaagtcttctactcaaggttgggagaccgaacttctctctaagcagcaattattgaaggtatagggttgtttcctgctccccccccaatctggtgagcttcacatgggaccgcgttggttcacccacatttcagtcgcggggagttgacacacaggccgccggagccgtctgtatttgtttgagcatgaatgtattatggaatggaattgtgtccagcaatcattttaattaggtctctcccccaccggcagaccaccccactcagggggtgcactcctgttcggcccgacaaccctcggacaacgcgcgcttaatgaatgtcagcaacaatttgttgctccacgttgacgtgtttctgagtatcccagcgcagtggctgatgatatagaggagcgtcctaagattcttgagaccctgaggtacaccagactattgtctttttgtcgaagaatgttctcccgcaccggggcgcacgccaggaggtggagagaaccccgtgttggcaccccacctactctgggacacctgtggctaaaaacccaacaagaggtgtaactgccacgccctggccaaaaaagggaacccccctttaacaaaaca

SEQ ID NO: 668412 - DNA, 141 bp, Homo sapiens
gcccacccagggtgataacttggcccaaggagagaccggccacagttacctgaggagcagacatcatttgggactgtaaggagtttttcacttcgtacccgtcaagctgccaagtgccaggcccttttttttgggcggttt

SEQ ID NO: 668413 - DNA, 1100 bp, Homo sapiens
tgagaacggacagactgcctcctcaagtgggtccctaacccctgagtagcctaactgggaggcacctccaagtaggggcggatactgacacctcatacagctgggtgcccctctgagacgaagcttccacaagaaggatcaggcagcaatatttgccgttctgcaatattcgctgttctgcagcctccattgctgatacccaggcaaacagggcctggagtggacctccagcaaactccaaccgacctgcagctaagggtcctgactgttagaaggaaaactaacaagcagaaaggacatccacaccaaaaccccatctgtacatcaccatcatcaaagaccaaaggtagataaaaaccacaaagatggtgagaaaccagagcagagaagctgcaaattctaaaaatcagagtgcctcttctcctccaaaggaatgcagcttgtcaccagcaacggaacaaagctggccgggaaatgacagaagtaggcttcagactatcagtaataacaaacttctccaagctaaaggaggatgttcaaacccatttgcaaagaagctaaaactcttgaacaacagattagacgaatggctaactagaataaacagcataggagaagaccttacatgacctgatggagcttgaatgaccattggccctaagaactacatggacgcatgcacaaactttcaattagccgattcaatcaagtggcaccaagggattcactgactgcaaatccctgcatgaactgacccgaaagacagtcgccttatcactttaacgggcgaaacccttccacacgccacctgggccgcactatcggaatgccgaccaccgcaccacgcacaccaccggcacactaagcaaacctcacagggtgcagacaccgaggcggtggcactaaccacgcagcgacacggggtcaaccacccgcccgggcgacggcgcacactcaggcatccccgaccgagggcgtaacaggacacggacagaccacgacagcgcgcgcccacgcagccgcgaccggcgcccgaccccacgtcgcggccgacccgcgcggccacgaaaccaaaaaaggagcgagcccgctgcgagcac

SEQ ID NO: 668414 - DNA, 288 bp, Homo sapiens
atggactgactggagcatcctcctcttggtggcagcagctacagtcacccacgcgagttccgtctgaaacagtctgggggtgaggtgaagaggcctgggactactgtgaaagtctcttgcaaggctctgaatacacattcactgtctactacgtccattggctgcgtcaggcccctggcaaagggcctgcatggctgggactcgttaatcctgaagatggtggtccaatttattcaaggatcttcctgggcagactaaccataaccgcagtacggcgggttaccgagc

SEQ ID NO: 668415 - DNA, 503 bp, Homo sapiens
ctctagaggttaccagctatccaagtagagccaatatattagcattaattttgttactttccttttctactcagctctctggtgaggccatggttggaataaaaagctaaaagtaacactcacggaataaaactatgacctttctgaaaactgcactgtgttccaactaattcaaataaatatttcactgaagggtctttaagaaataactatgggctgggcacggtggcttatgcatgtggctcacacctgtaatcctagcactttgggagactgaggtgggaggatcaacctgagctcaggagttcgagaccagcctggccaacatggtgaaactccatctctactaaaaatacaaaaattagcggggcgtggtggcgggcacctgtaatcccacagctactcaggaggctgaggcaggagaatcacttgaacccaggaggcggaggttgcagtgagccgagatcgtgccactgaactccaagctggacgatagagcaaaa

SEQ ID NO: 668416 - DNA, 396 bp, Homo sapiens
cacgaggattcctcagaaaatgcagctcaaaatctacgttgggtctggaaaacagatcattaacaggtccaaggatgggactgaggacactttctacagtcacacgacaagcctgcagctgattaagtcacagatatttctgaataagttggtggtcttggaggaacaagataaagaaaagatactgcgaccagcatatgtttttgctgacaccactttgagagaaggcttctgacaactcctgcagtagatgaagaacatgcactcaaagtaaccggtgcccgacatgatgaccatcttcatcagcacctggaagatgtgtaacgccccccctctcagaaagatcatgtcctgcattctctccatcgggcagggaacgacgcaggacgactctgc

SEQ ID NO: 668417 - DNA, 504 bp, Homo sapiens
  misc_feature (46)..(46): n is a, c, g, or t
  misc_feature (108)..(108): n is a, c, g, or t
  misc_feature (152)..(152): n is a, c, g, or t
  misc_feature (230)..(230): n is a, c, g, or t
  misc_feature (240)..(240): n is a, c, g, or t
  misc_feature (375)..(375): n is a, c, g, or t
  misc_feature (498)..(498): n is a, c, g, or t
taagtctccctgtctacctgcagcttccaatataatcccttcctanaagcacatggatgatctgcccaatatataatgtaaaaattattttaaaatgtactccctcanacttagtttccccggtctgcgaaatgatgtcagtccctcagatntgaatatatatacatacaagtacacacatcatgggactgtgggtgcaaagagtcaaaccttcagccaaggccggacanagtggctcanacctgtaatcccagcactgtgggaggccaagacaggaggaccacctgaggtcaggagttcgagaccaacctggccagcatagagaaaccccgtctccactaaaaatacaaaaattagccaggtgtggtggcgcanacctgtaatcccagtttcttgggaggctaaggcaggtgaatgtcttgaacccaggaggcagaggttgcagagatgagaccacaccactgcactccagcctgggatacagagcaagactccatntcaaaa

SEQ ID NO: 668418 - DNA, 147 bp, Homo sapiens
acgaagaagaggaatggaggagcaacccactgtcctgggcccaaactgtccactttccatttggcaagaactaagaaccccacctgactgcaagggatcagcgaaatgcgttcaccagtcaggaggccacatagccatctactgggt

SEQ ID NO: 668419 - DNA, 746 bp, Homo sapiens
accgaatgggtgttcttcccctctcggggggacaaagcccctttctggaaagtaatcttttttggcccccacccccttcgtggaagctcttatatccgcgcaaaggccgcatctcactacgctgtatgtctgtccacatacacgccttaattgagagggggagagtctttccccgcgagagagcttctcaccccggccgggagaaattcccacttgggagtctctcccacaacgggcggaccactcaccaccccctctctctatacactctcgcgaggtgtgcgcacagactctgtagaccacgcctgggtgaagaacacatccgcgcactcggcgtcaccgaggcgcaccgagaatcttccacggtggcgacaccgccgccggtgtgtgctacgacaccccctgtgggggtgtgatagcagcacacacagagaccaccttcgccccacagagaaattccctcctcacagagaagagagaggagcgccgccacagtagataattcctgggtggggagaagacaacagcagcgccccccagaaaagaactccttgctctcgtcaccgccgaacaggagaagattatcagaaatggtcgttgattgacgggcccacgcggggctccccgcgccacgcgccccacgtattccctcatcggccgctcctcaaggagtcaccacagcattggtgagcaccgccggcgcccctcccctataagagaagtttttgaggctccaacaaagaaac

SEQ ID NO: 668420 - DNA, 863 bp, Homo sapiens
aggatagacaatatcagattgatgctgctatcgtcagaataatgaatgatgagaaagactcttggtcataatcttctagtttcctgaattatataatcagctgcaagatttccagtaaagcctggagatttgacaaaagagaattgaatctctgatagacagagactatatggagagagacaaagacaatccgaatcagtaccactaccgtgggcctgacgctatctgctagacggttccccttcatgaaacactagtaatgtaccctcagagcaggaagcacacctgtgccatttctgggactctgattgatccagctgtggtacattggcaacaggcgaaggaaagggaggtggctcctgggtcatctttcacaaggctcaagacttcaacctgcagatgtatctttttccctccagtctttcctctagttcttctgaaggcatttacattgttgctgtttactctgtgcaaaaataactttgacgattggacgaaagaagatgttactaacagagcaacgttcctttaaaaggtctgtgctgtgtgtcaaaaagctgcaagtcggtcgttctcgtgtgtgatcatgaggtgcacaaatgaagaagaccctagatgcttgcattttgtaagctctgaagattccttaggtatgcctgaagacagatcgctcagaatgatcaggattagagggaaacaagggccttcatggcgtgaacattcgaagagcccggtcaagctggcgaaaggttaagccctaaccctggcctcctgtttctggttccccaagtggacattggggggttcgaaacagggacctggaaccgcaagggggccggggtgggcccccacaaaggtgggcc

SEQ ID NO: 668421 - DNA, 227 bp, Homo sapiens
actactctgttggtgtgtgtagtcttactttgtaatttctctgtgtaaaaccagtgaatataactaaagtgttagtggatggattaaaagaaacttattaggcaagaacaggtaatgtagttatccactgactaccttttaacccatgcagacataataactattctgtgaggtttataggctcggcagccttcagccttttttcagctggtatttcagtgtaaggc

SEQ ID NO: 668422 - DNA, 146 bp, Homo sapiens
ctgaggaacggagctgatgacctaaccagattatgcgtgagacagaaatgaactttgctgggaggagccctgagataagggggtttgttgttgtggcagctagtataaaatcatcctgactggctcactgcctctgtccaaggcct

SEQ ID NO: 668423 - DNA, 185 bp, Homo sapiens
accccggccaattcctcctcctctgtgagactcccacctcagcctcccgagttgctgggattacaggcctgagtcactatgctcagctgctttatgccgagtcctaagggaaaagcgagaggtcaggtgcaacaacactggcaaaagccaggagaacatcagctctaatttcagctgcatcaagg

SEQ ID NO: 668424 - DNA, 276 bp, Homo sapiens
gggggggggtttggggtggggggtttttataaacaaggtttttttttttacccctcagtttgcttgggaacccccccccccttttttttccccccttaaaaaaccccggggccgttcccccccccgggttttaccctgggccgggggggggtttccattttttccccggaaccagtttttcccttttggccttttccaaaagtttttttggtgccctttttaagggggcccccccggggcccggtccggattttccgggttgccccccgggtccca

SEQ ID NO: 668425 - DNA, 250 bp, Homo sapiens
tatgagacagggtcttgctctgttgcccaggctagagtgcagtggcacaatcatagctcactgatacctctgactcctgggctcaagcaatactctgacttcagcctcctcaatagctgagacaataggtgcaagccaccaagccaagctaatttaaaataatttttttagagatgggattttgcagtgttgccaaaggctggtaactttggcctcaagtgatactcctgcctcagccttctgagtaatt

SEQ ID NO: 668426 - DNA, 179 bp, Homo sapiens
aatcagtgtcgtcatgctgctcataatgagatataccctagactgggtaatttataacaggacagtgggaagagtcacagttcctcatggctgggctggcctcgcggaagctacaatcattgcagaaggggaagcatacacattcttcttcacatggcaagcagatcaggtggtggttg

SEQ ID NO: 668427 - DNA, 94 bp, Homo sapiens
tatggggcatcctctttttccaacttggctgcaggaatctttaaaaaatgcttttaacagagtttgaacctattttttaaacccttgcacccta

SEQ ID NO: 668428 - DNA, 1907 bp, Homo sapiens
  misc_feature (1616)..(1616): n is a, c, g, or t
cttctgttgcgcatcttgtagttgtgtgaacaagcagtcggggtgcgtttgtgtatattcgtctgtttatgcgcagcccgccgttccgttatgttggtgttcatgtggggagctttgttcattgggggtgccttctgtggtgtgctcttcttcgttgttgctttcggagtgggtcgttgtttctactggggtgtatgctcactcctgttgtttccgggcccctcctcgaattacattgaggtgtcctctgttggtgccgcacactcactggcgctgtctccccataagataagtatggttctccctggtggaagtcgccctcgggcgggttcacatgggtgtgttccgaccatcactactcgttctcttcggggtgggagtttcctttgttcgttgctggcacaacgaacacaaggcttgtcgcccatcgccctccctcttgtttaagtagaggggggttccgctcgcatgtgtgtttgtaaaacgcccttgtgtcgcatcaccaatggtgcgtgttggtgttatctaagtcgccgttcgccggtggggagaaatatctggggggggtactcaaacacccctgttcttcttctctgttttgtgagggaaagcacgtgtcaaccgactggttgttttcttggtgaggggatttctcctctctgtaggggtgggatctcctcctgggcggcgccttctccacaaatctttcaacgggcgcgggtagtgagtattaaaatccctccggcgggggagggcgggcctccccccctcctcgttgcaacataaacaccacagcgccgcgcggtgggtacttcatcccctcggggggggtctccccgccggggagaacaaccgcggggacaacaacatggggtcaacaacacacccccctcggcgccgtcgtggttccacagcatatccccttcgggggggtgtgtctcgcagagagatgttctctcatagcgggaacacggccctccctggagagcttattaatagggggaacagtggtgttgtgtttttagaggggcgccacaccacgggtgttttctcctcgagataaaaggcgcctggggggagagttctactagaggacgtttctcctcgcttcgctctcatcttgcgctactagaagagccacaacagctctttgtgggggggcgcaccacaacatgggcgaccccacaggggagaggggggagatatgaacagcgccacttttctctcactaacgcactctttttcccctcgttttatccacggcgggcttccctctctggtttcttcttgctgcgctatgtaccccctcggggtgtccctctggggcggcgcgagactcttcacactatatttgtggagacatctcggggtgtgttctctctttcacagagagattattctctggggcttctcacggggtgcctcgcggttgtctgagagggagagctctaaaggggagaagagagactgtgtccgctgctctcgggggtgtgctctgtttctctctctcacagtgtttgtcgtgcggcgttgtggcgtctttctcccccgtgtgtcagaccgcacacacagtggagacgctctcacacacagagagagaggcgcctctctctcgnccacacacacacagaggtgcacatgtggtggtgccccaacccgccccacactctgttgtgagaggtcacctcgagaccgctttaacacagtgaatttaataatttgttgagaaattttcttatacccctcacactatagagaatgtaaaacttccactgagaaggcacacacagagacttttgtttgtttttttttttatttcctatgaggtaaagagccacacacttgagaacctgggaatatatatgtatagactggttaaattaaaaaactcctctgtcacaatgaga

SEQ ID NO: 668429 - DNA, 436 bp, Homo sapiens
ccctagggctaaccagtacctggcgtaacgctcctctaagaatggtatcgatgttgtctgaagcctcctccgaagagttccccaactccaggatccagaacatcagacagtagctgcctaaggaaaaaagaacaattattagcattatatttgcaagtgattccaacagtcaggctctgaagcaagtgaacctttaacatttaggcaatggctaaataactacctaccatattcttgctgactacatacgaattatacgctggacaatttcctctttgtcgcaccatatgagtagtatactgaacacaaatgtattttattcataaatgtgatagaaataggaattataaatacgtggaaagagttaaaaattatgatacattgacaatcatcctatcatctgcctgaaaataataaaataaagacaacaatatac

SEQ ID NO: 668430 - DNA, 373 bp, Homo sapiens
aatttatgccctttttacatgacatgcaccctaccttttcagtctgaagcaagtttcactcctggggaggaatgagactggccccatcgctgcggctaaagcaaactgggcttgaggcatattaacatggcaacacaagaatataacagaaccggtttgatccactcatatgcacagtgggctgtccctgatcattttttatgtgttgctactggagccttcatgttcagattaagaaataatgtgtgagaggaagggcgaaagagccatcttcagaaagaaaaactgtgggccatcctaccttggttgctcgctgtgtgaccacggtgattcggttgcattgtcgtcgaggtggttgcatattacggtgggt

SEQ ID NO: 668431 - DNA, 794 bp, Homo sapiens
atttaccatctcacttctaggaatactagtatatcgctcacacctcatatcctccctactatgcctagaaggaataatactatcgctgttcattagtagctgactctgcataaccctcaagcacccactccctcttagccaatattgtgcctatgccatactagtcttggccgcctgcgaagcagcggtgggcctagccctactagtctcaatctccaacacatatggcctagactacgatacggataacctaaaccgtacgtccaatgctaagaactagatcgtcccaacaattatattactaccactgacgatgactttccaaaaaacacataatttgaatcaacgacaaccactccacagcgcgtaattattagcatctatccctctactattttttaacgcaaactcaacaacaagctatttatgcttgtgtccccaaccttttcctccgagccccgctaagaaccccgcctcctaagtactaactacctggactcctacccctcaacaatcatggtaaagccaatcgccacttatccatgtgaaccactaagtcacgaaagaaagtctctacctctctatactaatctccctacaacatctccttaattatggcattcacagccgcagaactagtcatattgcatatgcttcttcgaagcacacttatgcccacttggttatcatcacccgatgaggcagccagccagaacgctgacgcaggccgtacttcctattctaagcctagtaggtgcccttccctatcactcggctaatttccctgcgaaacc

SEQ ID NO: 668432 - DNA, 157 bp, Homo sapiens
  misc_feature (112)..(112): n is a, c, g, or t
  misc_feature (150)..(150): n is a, c, g, or t
tattaaggatctcggcggcggtgggagataatcattctcatggctcatgtgttcagcagctctcagatctgtgggggcactgagtggctctgcggttggtctagggctggcnaactcataccaattcctctctggcttcatctcctctgnctcacct

SEQ ID NO: 668433 - DNA, 141 bp, Homo sapiens
tagaggatcccgtagatctagcgaggagagaggctccaagactcattaataattaagagcaccccatctgggaagagttataatgatttgtggccaccgggcatgggaagtatgatgaaggtgcttgtggaagggagtgct

SEQ ID NO: 668434 - DNA, 516 bp, Homo sapiens
atgtctccaaatctaacaatgttgaattaatccgtcttttaaatagtcattggtgtgtgtgtgtgtgtgtgtgtgtgtgtgttaattatatctcactatggttttaagtttttttgagagtcagggtcttgctctgccacccagggtggagtgcagtggcgtgatcatagatagtccagtgcagtctcaaactccgggacttaagcaatccacctgtctcaacatcctgagtaactcggaccacaggcacacaacaacatgcccagataacttgtgtatttcgggtagagatgaactcttactatgttgctcaggggggtcttgaactcatgagctcaaaagatccttccatctcagcctccctaagtgcggggattataggtgtgggccatcacacctccctcattgtggttttaattttcatttccctaatgactaatgaatgatgttgaaccaccttttcatgtggtcatctgccattcatacattctctttgaagaaatacttttttattat

SEQ ID NO: 668435 - DNA, 245 bp, Homo sapiens
tcattctccgttactcacctgcagttcactgcactgggtatcacccaaatagcccatcagagctctttataatttctgaaagagagagaaggaactttttaatgcacagtcgaaaataccattgctgatatatcagttctgaagcatctgtgtccagtgtgcacagcatatggtcttttggtccatagcatttcaataaaatgtagcgtaaccagccaggaccaagagtcctgagataagggtcc

SEQ ID NO: 668436 - DNA, 106 bp, Homo sapiens
gcgttaaagtagacatcatctcaggttcgccttccatatagggatatgctctgtatttgtgctatgtcatcttttgtgctcatctgctctgaagatagctggctgg

SEQ ID NO: 668437 - DNA, 145 bp, Homo sapiens
tgaacaatcacttacaataattccaagtaagaatattaagaacaaaaagtaccataataccactaaaatagctaaaatgtaaagacagaatcaaataactgatacacacaacagcatggataaaatatcaaaagctataattata

SEQ ID NO: 668438 - DNA, 343 bp, Homo sapiens
ctcacctgggctgcagggagaaccaggaaggacgctgagtccccgtcaccttcgggctctgaaatttacgatgtgcttccctacgtgttcactttgctcttcctttccaccctgaagggaggctttcctcaatgccagcctctttggaagcaggctttcaggggtgcaagaggaaagttatcttgattcaagaggattccaagaagcagaggcagtgacacacatttttaaagtttctgtggtacctttgggctttgagaacttgatatagctgtgaagaacaagggctttggattgagatggatttgggtttgaattccagttctacttgggagctgtgggg

SEQ ID NO: 668439 - DNA, 441 bp, Homo sapiens
acggaatagatacgaatgcgtcacatgctacacataggtacaaacgcagagctactagtaagggtctaacaaagatcatcatgcttctgagggaacaggacaaagggcaaaagcagacctactgggaagtgtccagcaaagatcacaaagcaaaggacaaaagcagaaccactgataagggtctatgtacattcacgcatgtattgtcttgataaacatcttaaacaacagaaaacagggttcaagagcagagaaccagtctgaccacagatatatcagggcggaggttttctccaccctagtaagcctttgggtactgcaggagaccagggtgtatctcagtccttatcttaaccgcgtaagacagacgttcccagagcagccatttatagaccttcccccaggaattcattcctttcccagggtattactattaatata

SEQ ID NO: 668440 - DNA, 753 bp, Homo sapiens
  misc_feature (431)..(431): n is a, c, g, or t
  misc_feature (471)..(471): n is a, c, g, or t
  misc_feature (478)..(478): n is a, c, g, or t
catatattaggtaatacatagaggtgaatatatgtaaaatcaggattctaggcccaaggcatatttattttcaacatgaacaaatactgtaaaattattctacagaacaattgttccaagttgtacctccaccagcaatgagtaatgacttcaatttgtgtttccaaactcatttaccaatttaataggtagaagtggcatctgtgacagacacagacactgtatatatactgaccccatctttatttctaaaactttaaaaattcctgtctccactatggaaaccttaaaaggtcgaaagtttattccctaggagaggaatccaagtttccagataccaatcatgggccagtcttgcaaggaggcctttgtaaggatagccatctcaagcctgatatgttaactcttttctgcatggtccactcccttgncatttagccaaggtaccttgacagctaagccttttagagntccagantgtgtccagttataacaaattcaatgttaataaaggctatcatagaaagcagttgctttccgccttaagtttttgaatttaagttccgttttatcgtgcctgaagataatttggccaggacatatcggttaagttgatcatcaagttttaaagcttttaaagcgcctgatattcaggttccacatgaagggagcgcttttccaggggcccttatagtcctgaattggtctggatctgggctctaccctttggtggattgcaccctacagttcccg

SEQ ID NO: 668441 - DNA, 281 bp, Homo sapiens
  misc_feature (50)..(50): n is a, c, g, or t
  misc_feature (84)..(84): n is a, c, g, or t
ggtagaattcacaattttttgcaagtacacaatgggaatattcaccaaanataaaccattacctgatttataaaataaactaancaaactggcttctctcacttagcaatatgaatttaaatttcccccatatctcttcatggctttatacctcatttccttttattgctgaataatgtttcattttatggatgggccataaaatgtttatctatgcacctatagagggacatcttggttgcttccaagttttggccaatattaataaagctgttataaac

SEQ ID NO: 668442 - DNA, 1394 bp, Homo sapiens
  misc_feature (367)..(367): n is a, c, g, or t
  misc_feature (379)..(379): n is a, c, g, or t
  misc_feature (389)..(389): n is a, c, g, or t
  misc_feature (402)..(402): n is a, c, g, or t
  misc_feature (426)..(427): n is a, c, g, or t
  misc_feature (453)..(454): n is a, c, g, or t
  misc_feature (495)..(495): n is a, c, g, or t
  misc_feature (507)..(507): n is a, c, g, or t
  misc_feature (545)..(545): n is a, c, g, or t
  misc_feature (550)..(550): n is a, c, g, or t
  misc_feature (552)..(552): n is a, c, g, or t
  misc_feature (564)..(564): n is a, c, g, or t
  misc_feature (575)..(575): n is a, c, g, or t
  misc_feature (578)..(578): n is a, c, g, or t
accacgcgtcgggagattagccagatgtgacggcacctgtggtcccagctgctcgggagactggggcgggagggtcgcttgaacctgggaggcggaggttgcagtgggctgagatcgcgccattgcgctccagcctgggtgacagagggaaaacttcgtctcaacaacaaaaaaaaaagaaaaagaaattacagtcttggccaggtgcgtggttcgcgcctgtgatcctagcactttgggaggctgaggggggcggatcacctggggtcgggggttcgggaccagcctggccggcatggtggggccccgtctctgctaaaagtgcagaaaagttggccgggcgtggtggtgcacgcctgtggtctcngcttcccgagtngctgggactncaggggcccgcancacgcccggctaacttttgtgttnntagtagagacggggtttcaccgtgtnngccaggatggtctcgatctcctgaccttgtgatctgcccgnctcggctcccanagtgctgggattacaggcgtgagccaccggcccggggngaaanangatatgtactancatcttaattngtnataaaatctcacaaaccccctgacatagtctcagagatctgtagggccgaggttacatttggagaacccgtactctagggccaaatccattcttcttgccctggctcacttgtcccccccacgccccgcgctggagccactgctagttcttcagcctaaatggtgctcgccagacctcctctccaactgctcatcacacacagggctcattcctttccctccaatgcaaccaaacgccctcccgccccaccctcccaggctccccactccctcatgtccccctttgccatggctccaccccttgccccctcccctggcgtcgcccgcacgcaggtcgcgcctcgctccatcccccgccagaccgccgcgcgtccctcttgtgcggttcaccacagttgctatttaagctgatcgctgctgcagctccgtcgttccaactgcctgctctccccgccggcatccatggcgctcctcgaggaccagcggaccggcctgtctgctccacctcgctgtccaccccccgcgccccggcccctcccgcgccaccctacaggccccaccccggcccgcgccgcctcccactccccacgctaccctcgctcgcgattccccgacccaaaccgacacccccgcgcgcccagcctcaccgccactcctccgacctccccgccccgcccgcccacacccaccgccgctccacccgcgcctctccccctcctcgtacgcgacctaaccgctgcctcccacccgctcccacccacccccccccccccccccccccccccccaccccccccccccccccccaccccccccc

SEQ ID NO: 668443 - DNA, 778 bp, Homo sapiens
aacgaatactatgcggcagtactcgttgtcatttaagttacagggccgggtttacattgacttaagctggccgtcgtctgacgaggagcctcccggactgtacccctcaccccaactccatcagcatcgatgccggtccccggcaggcccccaagattgcccagatcaagcgcaacctctcctatggagacaacagcgaccctgccctagcacgcgtcctcgcatgcccccacccagaccccctgagctcgcgacctcctccagactccccagcagagccaggcacagcccaggggccatagccgccgagacggccaactggtaccctaaacgctactgcagcgcacacaacaagagccggcctggaacgctgatgctgccacgactggacaccggagaccaaacgatgaacaacctctctgaagaagtctctaggcacgccatgtcctcagtgctgtgcgcgcaggtgcccaggctactgagtgtcccagaaattccagcagttccggggccctctggtgaagcaaaacttgaaccctgatgccaacccacgccccaaagccccaggacctggacagggctcctgaggacctgcctacagccttgtccatcgacggatatcagcatgaagtccgatgaaactctaccaactcaaggccaacagctggcagctaggtgaagacccccgagaaagaggaaggaagagaagaaaccagccctacgcacccaagaagccagcaaaccaagcggcagaagccgcacaaagctaaagccgcac

SEQ ID NO: 668444 - DNA, 432 bp, Homo sapiens
  misc_feature (270)..(270): n is a, c, g, or t
  misc_feature (299)..(299): n is a, c, g, or t
  misc_feature (303)..(303): n is a, c, g, or t
  misc_feature (335)..(335): n is a, c, g, or t
  misc_feature (364)..(364): n is a, c, g, or t
taatttcggtttggggtttcggtctgtacgccaggaagggaggccaggcctgccccaggggagaaaagaggaagtgaagttggacctttatgcttctgagtgggttgagaggctcaaaaggaaactctcggccggggcatctcacagtccctgcaggcgtcaccagcacctggcactgagagggctctcttcccgttcaacagaagcagcccactctgaaggccagacccagatggtgcccactgtggaacactgagctagccagggctnggcagctttgtgcctatgatgctgtaggncctngtgccctgcagccagcagaggacagctctctnggctgggtataaacctccaggagcttctngagaaagccccatgtgccaggactgggcaccaagaaatggaggccaaggtcacagggacggtggaggg

SEQ ID NO: 668445 - DNA, 1251 bp, Homo sapiens
  misc_feature (224)..(224): n is a, c, g, or t
  misc_feature (236)..(236): n is a, c, g, or t
  misc_feature (246)..(246): n is a, c, g, or t
  misc_feature (259)..(259): n is a, c, g, or t
  misc_feature (283)..(284): n is a, c, g, or t
  misc_feature (310)..(311): n is a, c, g, or t
  misc_feature (352)..(352): n is a, c, g, or t
  misc_feature (364)..(364): n is a, c, g, or t
  misc_feature (402)..(402): n is a, c, g, or t
  misc_feature (407)..(407): n is a, c, g, or t
  misc_feature (409)..(409): n is a, c, g, or t
  misc_feature (421)..(421): n is a, c, g, or t
  misc_feature (432)..(432): n is a, c, g, or t
  misc_feature (435)..(435): n is a, c, g, or t
caccggttaggcaggatggtctcgatctcctaacctggtgatccggccgcctcggtctcccaaagtatgggattacccgcgtgagccacgcgcccggtgcaataatctttctttgtttctgagacagagtctacgctctgttgcccaggcttggagtgcagtggcagcgatctcgggtcacggcacgctccgcgtcccgggttcacgccattctccgtgcctcngcttcccgagtngctgggactncaggggcccgcancacgcccggctaacttttgtgttnntagtagagacggggtttcaccgtgtnngccaggatggtctcgatctcctgaccttgtgatctgcccgnctcggctcccanagtgctgggattacaggcgtgagccaccggcccggggngaaanangatatgtactancatcttaattngtnataaaatctcacaaaccccctgacatagtctcagagatctgtagggccgaggttacatttggagaacccgtactctagggccaaatccattcttcttgccctggctcacttgtcccccccacgccccgcgctggagccactgctagttcttcagcctaaatggtgctcgccagacctcctctccaactgctcatcacacacagggctcattcctttccctccaatgcaaccaaacgccctcccgccccaccctcccaggctccccactccctcatgtccccctttgccatggctccaccccttgccccctcccctggcgtcgcccgcacgcaggtcgcgcctcgctccatcccccgccagaccgccgcgcgtccctcttgtgcggttcaccacagttgctatttaagctgatcgctgctgcagctccgtcgttccaactgcctgctctccccgccggcatccatggcgctcctcgaggaccagcggaccggcctgtctgctccacctcgctgtccaccccccgcgccccggcccctcccgcgccaccctacaggccccaccccggcccgcgccgcctcccactccccacgctaccctcgctcgcgattccccgacccaaaccgacacccccgcgcgcccagcctcaccgccactcctccgacctccccgccccgcccgcccacacccaccgccgctccacccgcgcctctccccctcctcgtacgcgacctaaccgctgcctcccacccgctcccacccacccccccccccccccccccccccccccaccccccccccccccccccaccccccccc

SEQ ID NO: 668446 - DNA, 514 bp, Homo sapiens
ggggtcactagcgggtagcaacgctctgacttcctaggtaccaggatatccaggtctgtgagcatctcatatatgggaaaagttgtgcatttcactctagataggaaacacttaagtaaatttcattatccaaaccaaattcagccttctgggacatacctatccctatcctgatataggtggggaaataggattcctcgtaatggcagcccccaactgtaggtgggtgcaaaagtaatggcagttatggccatatggatgcaaaagccgcacttacttttgcagcaccctaatatcttccagactaggaggccaaggtatacagggggctcaccagggggaaaacctctacccttactcaccatttaggacttgaccactatagtggagctgccatccccaccgtggataatagagctgttcctgcttaggccactgcatacaacctacccaccaagtttaacaatctgtcctactttgtttaccctttgtcctactaggccttatggcctta

SEQ ID NO: 668447 - DNA, 1398 bp, Homo sapiens
ggcggagcacggagatctcgccgggttaacggttcacctcggtgtctgcagcaccctccgtttcctctcctaggcagacgcagacccagatggttagagacgttcaccatgtctatctctcactgatccatggccagggagatctctggagtctcgcggcgaatcccactgtctgcatcgttcgatctcgttggacctcgagacaggtctctctcacgagcttgctgtgcccacagttgagtgcctttcaacactggtactctattgagcgagcctaacagctaccggggagacactgactatacgacctcgctagtctcgggggaacgggtggtatcacaacggcatgtatcgcgtagcccatcagggttaagataccctgctttgccacgcgcttgtacacctagaggctctaacgacagaaggacgacagggtagcatcacggattcgagccgagggacaccagacgcaaggacaggacttttgacccataagagcccttgcggttgactccgaagcaacttggcactgggaagcacgacaccactaaaacactacctaacagcctaaatgcgattggccgagaatccgccgcaataccctgggtgcgcgaatcggtccacccgttgacccaggtccattgcgctagacagcctgtgtgctcggtccgagagtgacattcaatgtagctacctatacaccactacctggatcaccctgcccgaaccaattcgcacgtaagaacacactgagcggcgcagagcacaagcgtcatttgacgagagatacactacgaaatgaccatatgtatcacaactgaggaggatgtcggcaagggctccaaaacatactagaggccaggggaaacgaccaattcgtcaatgaccagaaagaaaggcgtaagggcaaacagtacagaacggagcgtccaaacagagtagcgctacccacagagtgaggagagcgccgtgcacacaccatctataaggggcacaggaccatagagcgcaaagtgtgggacagcgcggaagcgctaaaccagagccacctcaggtaaacgcaacaagagtcgtccggagaggcacacacagctctcatggagcaagagacacaagacacaagccacccgccaggacaagtagacacacaacaacactagcacccccccgcaggtccagcgacaaaatgcgcgacaacggcaccaggaacacgccgaagggcagtagcaggggcaagatgagagaaacgcggcgaggcgaggagacgacccgaatagacgcggaagcagtgggaaagccggcacccgaggaggcgggtcagaagacgcactcgacagtacaagcaacaaccggctacgacgacagcgagagcaagaaacaagcaagactcgtaaccac

SEQ ID NO: 668448 - DNA, 86 bp, Homo sapiens
tgggcgcgacctacatgaaaagcagaaatcggttgctgttttgcttctttttccctcttatttttgtattgtggtcatttcctatg

SEQ ID NO: 668449 - DNA, 155 bp, Homo sapiens
  misc_feature (130)..(130): n is a, c, g, or t
  misc_feature (135)..(135): n is a, c, g, or t
acctgccccactgcttcttcgcttctctcttggaaagtccagtctctcctcggcttgcaatgagccccaactgctcccgcgccgctggtgtctcctgcacctgcgctggttcctgcaagtgcaaagagtnaaatnatctgcaagaagagctgctg

SEQ ID NO: 668450 - DNA, 179 bp, Homo sapiens
ggtgtgggaacgccaccttgactccaggctcagtagatctcccacttcagcctcctgagtagctggaccataggtgcatggcaccacttgtggctaattaaaaagattatttgtagagatggggtctccctttgttgctcaggctggtcttgaattcctggcctcaagcagtcctcctc

SEQ ID NO: 668451 - DNA, 403 bp, Homo sapiens
  misc_feature (30)..(30): n is a, c, g, or t
  misc_feature (78)..(78): n is a, c, g, or t
  misc_feature (82)..(82): n is a, c, g, or t
  misc_feature (109)..(109): n is a, c, g, or t
  misc_feature (116)..(116): n is a, c, g, or t
  misc_feature (120)..(120): n is a, c, g, or t
  misc_feature (135)..(136): n is a, c, g, or t
  misc_feature (150)..(151): n is a, c, g, or t
  misc_feature (154)..(154): n is a, c, g, or t
  misc_feature (156)..(157): n is a, c, g, or t
  misc_feature (202)..(203): n is a, c, g, or t
  misc_feature (205)..(205): n is a, c, g, or t
  misc_feature (208)..(208): n is a, c, g, or t
  misc_feature (212)..(212): n is a, c, g, or t
  misc_feature (214)..(214): n is a, c, g, or t
  misc_feature (217)..(217): n is a, c, g, or t
  misc_feature (220)..(221): n is a, c, g, or t
  misc_feature (225)..(225): n is a, c, g, or t
  misc_feature (229)..(229): n is a, c, g, or t
  misc_feature (231)..(232): n is a, c, g, or t
  misc_feature (234)..(235): n is a, c, g, or t
  misc_feature (237)..(238): n is a, c, g, or t
  misc_feature (242)..(242): n is a, c, g, or t
  misc_feature (244)..(246): n is a, c, g, or t
  misc_feature (250)..(252): n is a, c, g, or t
  misc_feature (254)..(254): n is a, c, g, or t
  misc_feature (260)..(260): n is a, c, g, or t
  misc_feature (264)..(266): n is a, c, g, or t
  misc_feature (322)..(323): n is a, c, g, or t
  misc_feature (336)..(336): n is a, c, g, or t
  misc_feature (341)..(341): n is a, c, g, or t
  misc_feature (365)..(365): n is a, c, g, or t
  misc_feature (367)..(367): n is a, c, g, or t
  misc_feature (391)..(392): n is a, c, g, or t
  misc_feature (398)..(398): n is a, c, g, or t
  misc_feature (400)..(400): n is a, c, g, or t
gtctctcttctcccatttcttccataaganaggctccttattctctctctcactctaatgtaacatatcccaaatggnaggncagttcatgctcattccccccacccanttctacnagtntctctctcttcttannggcgaagccagacnnggnannggagacttgggaaggtcctttaaggcaaaactgtggagtcctagnngngtntgtntnaangcnncgtntctncnncnntnnccanannngcannncnccctangctnnnctacgagttaagagtactgtctaaccagtctggcttcttccttcttccagcagccnnccctccccccccnttacngttttactcccccatcctcaaaancncctaacttgaactttgtctaaatnntctctncnact

SEQ ID NO: 668452 - DNA, 432 bp, Homo sapiens
tctagagtatccccctcgggctctttattaaaaataaaaaaaagaccactagggaaatgtgcgtgtggactatcattattccagtaattttagatgttatatgtatttgaccatggtattgaggtattgtagagaaatgcatatttacttagaaaacctattcggaagtatttatggcaaattcccatgatgtcagtagcttgcttttgaatagaccatcataacaacaacaatcatgagtgcaaatatagcagagtgttctcaatcaccctgaatagccaacacagtcttgaagaagcatgaagttggaggattcccatgtctcaatttcatattttactacaaaggtacagtattgaaaacagtgtagtggtactggcaaaagaaaggagatacagatcaatggaacagaatcagagtccagaaataaac

SEQ ID NO: 668453 - DNA, 262 bp, Homo sapiens
  misc_feature (17)..(17): n is a, c, g, or t
  misc_feature (175)..(175): n is a, c, g, or t
  misc_feature (199)..(199): n is a, c, g, or t
  misc_feature (220)..(220): n is a, c, g, or t
  misc_feature (239)..(239): n is a, c, g, or t
ggtggttgtcgggtgcngggttttcgggtctatagccccggggtaaaaggagcactgcggatacatggagtacacttctgaagggctcaatgccaggaagctcccgtcctaaacagcgtttcgttcttgctgggccatggaagcagcgagagaaggagtgccctcacagcaccangtaccctctttcatcaaccatccntggtatgtggccagattcgcntctcaagttggcgtggcanggtggtgccaggtttgagtactt

SEQ ID NO: 668454 - DNA, 1165 bp, Homo sapiens
tgggtgctgatgtgcctgtgtgctgtgctgagtgagctgctggacccctgtgctgctcgtgctccctgtgctgctcatgctgatgtgtgtgtgctctgtgtggtgcctgctgtgttgtgtgcctgtgtgctgctcccctgcctgtgagtgtgtgaacccacatccctgcccccatgggccacgctgcagtgactgcctgacacctacccctcagcagactgcctggatgatgaaatgagtagcaacaaagagcagctggtcagcagtgttcgtgatcctcttttgccctcatcaccatcctcatcctctacagctccaacagtgccaatgagtgtcttccattactgtgctccctgctggggccgtagcctgcctgaccttgtcaacctcaatgaagtggagcatcactgactggctatgtccccattctctggcaacaatgacactgcgcctctcggtgccaccatgtgtgtgattgtcagcagctccagccacctgctgggcaccaagctgggccctgagatcgagcgggctgagtgtacaatccgcatgaatgatgcacccaccactggctactcagcttgattgtgggcaacaatgaccacctaccgcgtcgtggaccattccagtgtgtaccgtgtgctgagtgaggcccaggagtttgtcaagcggaccctgaaacgttgtcatcttctgggggcccccgagcaacgatgcagaagcgccagggcaagctcgtacagtgtgatccagcgagctgggcctggtgttccccgaaattggaagcatattcctgtattctccccggacgcatgctgcaattggcgacctttaccgggtgttgagacgggccatgaccacgcgacaaagttccatacggtggttgagcaccatgttgtttaacaatgatgatccagtggaaacttgaagtaccacggtgcaaggttatcggcgtggggccccccaagatagggtagccaagacggcccgctccacgtaggccgaacgagtgcacccactgtgctctctaatgttccattcaggatgagcacccaggacaacgcataatacgaagtgctttctggcaccggtagagtacatacactggtcacagccgtgagtccgatgtagactcctgatagcaataatgtgttctccctgattt

SEQ ID NO: 668455 - DNA, 642 bp, Homo sapiens
aatatgttttctcttatgacgttcttaataacattttcttttctctagcatactttattgtaggaatacagtatgtaatacaactaacatacaaaatatgtgttaatctactgtttatgttagcagtaaggcttctggtcaacagtaggctattagtagttaagtttttgggggtcaaaagttacatgtggatttttgtctgtgcagaggtttggtgtccctaacccccatgttgttcaagggtcaactgtatacaaaattactctatattgtttaagcataacaactccagcttcttcatggtgttcatactattttttcttacctttaatggttctttttttgaatgaatatttcttttggtgaagagatatttaaagtttagcaatttctttatatttcagattcttatgctttagttaaattcaagtaaaatcaaatttaatacttattttgtaaattgcatgtaactatgcagaggcagatgttgagaactgtgtcttaagaatgttcatatgatttctgggtctggaggggtggcacttggggagatttcttgccttcttctctgaaccctctatgttgcttaaatttattttaaaaagcagcattttttcattgtggtggggatcctgtagagca

SEQ ID NO: 668456 - DNA, 515 bp, Homo sapiens
  misc_feature (274)..(274): n is a, c, g, or t
gcgagcagtgatgacaccttagcgggtagcaggagaggaagtgcagctcttcactgtatgaacgcccgggggggggcagtctaggtgcaacagacacttagattaatgtggggataaacaatgtagcaatggactccattacctagttatttcttaggactaaatctctagaagtaagattgctagttaaagcgtatgcacatgtttgaggctttcgatgcacaggaacatacttccctccccagacgtcacaccagttgcctttcctcttagnggcctgcgaaggtgagagaccagactccatgaggataggaagtgcaagtcccagattccccacactgctctgccaagtccagggacatcatctggaaatccccagaggcatcagcacatggagcacatcccacgcagggcatgcaggggaaatgtgatcataccctgtgaacatacccagagacagcgaggaagacttttggcacaggagccagcctcggagatggtgagttggggaaagc

SEQ ID NO: 668457 - DNA, 1024 bp, Homo sapiens
ggacccttattaagttagaggaaaataagtttaaagggtaaaacttcttttgcgagaaaccctcattgccacaggcagcggagttggcaaagcgacccctgaggtcaggttctgatttcaaaaccaggcaaagcacagagcaagcggcactcaagtcttcccagtgaagatgcttttggttgcaaggagcaaaaactctctcactgagctggagtcctgaatcgttatgatatcaggtgtcagggaaaccaggccaggaagaatgcccccagtctttcaatgaagcaccagtacagaatttatggacgccaatacctatgaccctcttttctcctatccttttccctctctctttccttctacacctgctctgtgccccgaggtcccgagtctcccagcggtgagtgcctgtgttcacatgtcctccaccttgcggccaaggtgccgaggcccattcctgggggttcttgatttgggcccaggctcgaagtcagcgtggtcccatcccaccggggtccatctcaggattttacgcacatggggtggcccgagggcccacgctctacaaaaccttgggttcgctttaggggccctggtttggtgggccccatggggacaatttgttggccacaggtaccccgggcttgatcctttattctccctctgcgggttcgagggcctctgccctcctttcctaaatgaattatagaggggtggttttaagggcccatgacagcccattgtgagtaaagtttgcccgatgggggttcaccctcatttggccccccttttaatagaaagccccctgttagggctggaagaacttaaaagtgtgtatgtcccagcacaaaaggtgtgtgcctttgatatcccccgaagggcctatccggtgagatagaaatagggagagccgaagattttggcacagagacgaccccaactgttgttgtggtgttcaaaagagatatcaccgcgggatgattgtgtggaacaccatattcagcacccagaggggggctctctg

SEQ ID NO: 668458 - DNA, 164 bp, Homo sapiens
atatgcatttgccaccctctttatccttaaagaccatgcacatcagtgtaagggtatttccagtaattactcacagcacttagttaaagttagcaatttcttcagccatttaataatatctttctgtgaaggaaacttagctgagttaaccataaatgttcatt

SEQ ID NO: 668459 - DNA, 194 bp, Homo sapiens
ggagtaagcatacagaattagcttcagagggcacaggaaggaaaagggacatgtgaccctcccagcacactcagagccagacagaccagcagcagcactcaggtcagactgggtgccctgccagtggccagtgtgaccgcagacaccaggagtccaggcctagttgcatggggaccccctatggagggcgcgga

SEQ ID NO: 668460 - DNA, 331 bp, Homo sapiens
ttctcacgcattaactggcgacacagtgctagagtggcggcagctctacatgagatcccgggcggcgcgctgcccgagggaagcaaggccagctttgcagtttctcctggagtatcgctgaggagcagctgcgagccgagcatgtcttcatttgcttccacaagaaccgcgagaacagagccgccttgctccgaaccttcagcttttcgggctttgagattgtgagaccggggcatccccttgtccccatagagacccgacgtgttaagcaatcaatggagataccgatctccgaaattccgtcactcatggtccttgctgtgaccacagg

SEQ ID NO: 668461 - DNA, 317 bp, Homo sapiens
cattgtgccacacccgccggggtcctaccatcgactacactcagtaaacgtcacactggtgttggtaaaaagcctacagcttgctcagcttccgacaatagagcggattcacagatccgttcgagtctcagagaatgtgggtggtgcacccacttcatggggtcaaccccactaaaaaagaaaaggcaagcagcaaccatcaaaactaagacaaagagcataataccatgcaaccccacgattttagagcaatactcatggctcgtggtcaaatagagtaattgcttatcaaactgtatcgaaaaccttcaagatca

SEQ ID NO: 668462 - DNA, 849 bp, Homo sapiens
acccacgcgtccggagttgttttcaggatatttacattaggatttcacattaaaagggatattttacattttcacatataagccataatatttgtgtctaaagtcttggtacttggacttggtatagaaacttcaagggttagttaaaacaacagcaaaaattctgaaggggattccttcattaatcaagatactataactcttcattgtagctgtcttgtgtttttatttctgtggtgctggagttggagcccaggcctcaggcatgctaagcagtgcctctaccacgtgagcttatggagttactgctcagactggccgccgcctctctagttcagtgagtactagtgtgcaccactatagctggcctgtccttcatggatttacttgtgatataattctgtctcatttttgtttgtttcaaagcatcataacctaaaaaaagacaacccaaaataacagtgttccctaatttgtggaatatccttgatggttctatttcatttttgttcattaagcttagaataataaaattggcagacaaatggtaccaacctggtgattccagcacacgaggggcctcaggtcagaggattcagtttgagggcagtctggggtaaacagcaaaatcctgtctgtcctccttagtctcccaaaggtaagataatcaacgggttttcacttatggtcacaactttttatggaggttttgggccggcctgaaatacacaagtggtccctatgggaaccccggcggtttactgaaacagcaacaccagatttaagaacaaaaaacttatgtctgccattgggcccaacttggctaaatttaacagtgtcccaaaaagt

SEQ ID NO: 668463 - DNA, 161 bp, Homo sapiens
cgtgaatggctatggtctgcccagcataccatttcactgagaaaatcaaagccaagtaccccgactacgaggtcacctgggtctaacgactggctactgtagcactcccacgcccgggcgcctgcgtgcctccacgcggccacttcaagcgcctccggggc

SEQ ID NO: 668464 - DNA, 418 bp, Homo sapiens
tcacctgggtatactatgtagtgagagaataagatgtatgaggaaaagacagacgcctaatgtattactccagacgtactttttatcttctgactatcatagaaacgaatgtcattgctccaacttctttaggggcatccagttgcccagataaagtccaagtgattgtaaaaaggaatctccttgatggtacataagattggggagtaatggaagcaaaatgccaacatctatgggggtcagtttacaggtcctcgcctacgtgccacactgcaattggtacattcatggctgtcacattgtagtagggaggttgggacagatcatagtccatcctatactgaactgggcttccccagtcataagctaggaatatcccagacttaacagcctggatccaatggaacatgtgatgaac

SEQ ID NO: 668465 - DNA, 169 bp, Homo sapiens
  misc_feature (84)..(84): n is a, c, g, or t
gctctggatgcagatatgaccttgattcgcccttcgagttcggtacgcggaggcgttgaatggccggaggcgttgaatggccgnaggcgttgaatggccggaggcgttgaatggcccagaactccagggctcaagcgatcctcccacctcagcctcccggccatggggg

SEQ ID NO: 668466 - DNA, 470 bp, Homo sapiens
agaggatccccattcggcgaggcagtctcgaggggcggcggccgcgctgctccctgtgaacgggtcccgcagctgcgcaggcagtcggggtgagtgtcgcggagccatgaagctgacagactcagcgtcctctacaaaggcgaggccaaggtggggctgctcaaagccgcatacgatgtgtcttccttcagcttttgccagagatccagcgttcaggaattcatgaccttcacgagtcaactgattgtggcgcgctcatcgaaaggcactagagcttctgtcaaagaacaagactatctgcgccacgtgtacgtccggaatgatagtctcgcaggtgtggtcattgctgacaatgaatacccatcccgggtggcctttaccttgctggagaaggtactagatgaattctccaagcaagtcgacaggatagactggccagtaggatcccgtgctacaatccattacccagc

SEQ ID NO: 668467 - DNA, 165 bp, Homo sapiens
tagaggatcccgcaaggtccggtgttctggcggccccccaggctctcgaggatgagacaaccactccggcccggcggtacttcttccttttagcccttatttatggtcggtctgcccaggggacggggagccgcccactttggtcctcaataaagtttctaaagt

SEQ ID NO: 668468 - DNA, 553 bp, Homo sapiens
gttcaggagactttacaaacctttgtttcaactttcttatctggaaataatatcatttataaagggacactttatatgtattcccttttctcatgtcggttgatataacacaaagagatatttaggaaacatgcttattggatgaggttaactctatctgtttttaaagcaccgaggttgcattctagataaccttgtttcattaagcatggcatacttttaatcattatttgagactgtcctgtgcctgattattttagctaaacttcagggacgattgcgtgtgggcagcgacaagcatgctcttgacaaaactttctaaccagcggttatttacagcataatctgaaaacatctagcccaaaggtaagttcgctattttcatcacagttgcctatgcccagggaatacagatgtatctttcataattgaattgggtttttcccacgtctaactggaaacaaaacagaaggggcgtcgatacattgtgaatatggcagaacattactgggttctcagcatacgtgtaatcaaaaaggaggaaatttcagtg

SEQ ID NO: 668469 - DNA, 1196 bp, Homo sapiens
gctgagacctgtatccccaaagtcaacgtgatgacgcatcctcccgtacatctaccatgctgtgaactgtcgatctcattccaagtggggcatgcgaggtgtccagatgggctatgcctgctggtaactcgtataggttgtaccatgggattcagccagatggtgatgttgtccagtgacaagaccagttggattggaggcgcgtagcaacatccccttactatgcagcattaccttcttgctggaaagcatagggtgtcttggaccagacacagtactcgcacgaggcgcgtttaagtgggctctggatcgctacgtgtctattgaatcgagactctcgatattctggcctcgatatctctgcaccgtcttcttcactacccagagtcaactcatcacgtggagtaatagcaggaatgcatgcacaactaacgtaataccgctgatgggtctgcatagtatgcaattggcaaaggagagtcaattgacccgagttgcgtggatcggatcacgataagctgtcctgacacaggtgcacaggactttcgatggtgcttctctggatgttctcacaatgctttggtggggggcactggctctggcttcactctccacttccttgtattggagcggatcgtctgtttgactatggccaagaaatccaagctggaattctccatctacccagtcccccaggtgtctacagccgtggtcgagccctacgaactctatgctgacacccagaggcagcctggagcactcagactgtgccttcatggtggacaacgaagcgaatctatgacgattgtgccggcgaaacctaagacatctgagcgcccaaactaagcaaagctcaatcgcctcattaaggcaaattgtctcctccatcacaggttctctggcgcttggaggggccctcaatgttggacctgacacgagtccagaacaactgggtggccttacctctgagtcacattccccccgtggcacactattgaccagtcattctctggagagaaggcgtacccagagcaagctgttgggtggcagaaatcacccatgctgtttgtaagccgtgccacacgaatgggtaagtggtggatcccgggaccgggaagtactgcggaggcgtggagtgttacagcggagaatatgtgtcccacgagtagtatagagtgcaatgtgggagaaaaaag

SEQ ID NO: 668470 - DNA, 181 bp, Homo sapiens
cccccccccccccaagggttcagaccttcccctaaaactggggccaaaaggggggggaacctttaaggggcttggggatttcttgggattttaacctttaaaaagccccccctaaagggggaaaagatcccccttaatccagggttttttttaaagaaaaaaaaaaatttggtttttttga

SEQ ID NO: 668471 - DNA, 325 bp, Homo sapiens
acagagtctcagtctgtcaccagggctgggagtgctgtggtgcaattgtgggtcactgcaaccctcacgtgtgagattcaagcgattctcctacctcaccctcccgagcagcatggctaacatggcaaaaacacacctctcctaaaaaatatagaaattagctgggcatggtggcacacacctgtagttatggctgctcgggaggctgaggcatgagaatcccgtcagcccaggaggcggaggttgcagtgagctgagttctcaccactacactccagcctgggtgacggagtgagactcttatctcaaaacaaacaaacaaaca

SEQ ID NO: 668472 - DNA, 606 bp, Homo sapiens
aatcggtcgatgcatgccttcgagatcatacagcctgctcacagtgccgagaaccccgtctgcaggtcctggtgaaggcgccatcgatacaatcgagtggtccccgggaaggagcgtccactatcgcattggtgcgcgaccgggaactgttgagactgagcagggctgtggagtgtgtcccgccctgcgcctgctgctgaacgaggctccatcgtggcatgctgtgctacgaggggtcgcgtggaggctgccttccggaacacttagaggaccactatggtgaagtgtgccgtggccagagtggaggctcatccaactgcttgccgaaggggctgtccatcggaaagtccctagtggccgatatgaaggcaaaaacggtaagaagggggaatcgggaaaggggccgtcggggggtaacggaccggttttggtttggggacggccacaatgcttcgcgaaaaccccgtcggtaggaagtttgtgtctcgcatggtcgtagacctcgtctctcgagaattagaccaccattggtgctggccgcttttgggggaggcgaggccgcgcacgacctatacaggacaacaaagacacacatgtgtgtggcgc

SEQ ID NO: 668473 - DNA, 329 bp, Homo sapiens
ttttttggggttaaaatggggtgggcccccccccccccagggaggggggaaacccccctccagggaaagggggccccctcagccctggggttaaacccgttgagggttttaaaaggggggtcctttttttgttcccccccaaccccctgccctgaaaccccggggggcgggggggggtttgggcctcttttcccttttgggggtgggtcccaaaccccgggcccatgggaggggaagggggggggggtccttgggggcggggggggggttgttcctcggctcccccccccggcccggcccctttgggaaaaaaaaatggccctttttta

SEQ ID NO: 668474 - DNA, 146 bp, Homo sapiens
agcccaagccccatcaggaggaggctaaaaaaaaggcgggcagggaggaaggggcgttcccagctccaaggttccttaaatgtcccagtgatacttgtgtagggggacatgtactttatttgtcaataaacgtatctgtcccctga

SEQ ID NO: 668475 - DNA, 1033 bp, Homo sapiens
aggatttgaaacgcaatgagttcacatggtgccagagacactcccaagccattatggccattcccctggttcgctggtcccgaagggcacgatcgacaccctcccttcacccgcctactgttagtctacaattctcgcaactatcatcctttcgcaccagcgtggaccctcctactgccgtagcgtcattcccactgtaaggggcctttccaggcgtgtagaccccggcaacaaggacatagaacatcctcattgtccgggagaacacagatggcgcgagtacagcagcctggagcatgagagtgtggcgggactggtggagagccttatagactcagtcaccaggccaagtccctgcgcatttgccggatgtactgcctttcaagcctggctgcaggacgattcgggcagcaatgaaagtgacggtccggtggcacaatggccaacatcatgataatctgggctgattgggcttttcctccagtgctgcatgggagtgttgactagcctcgctacccctcagatcaccttcgagaacatgattgtggatgacaccaccatgcacgtctgtgtgtcccggccccagcagtttgactgctcatggtgaatgcccaatcgtcatatcggcaacatcgtcaacaatgtctgcagcagggactggtcgggtggcccaggccttgtgtgctggggccaactatggccactgtgtacgcggtgtttgaaacagctacgaggaacaccgtgcaagagtatcgccaataagaacatcggccaaccctactggccaccctgctggccagctgcatgatagctggaccacctcatagctgcactcctatgccacctccatccgtataggctgtccatggcagtccatggacaatgagaatactgcacactccggacatcgggggccagggcacaacatctgaagccatccacggacgtcatccgccacatccgcgtcatcaacggccgggccgtggaggcctaggctggccctaggaccttcttggttgctccttgacacccc

SEQ ID NO: 668476 - DNA, 96 bp, Homo sapiens
  misc_feature (82)..(82): n is a, c, g, or t
attcctgtgatttttagaattttcacttttcatataaagttgcattttatcatgaggaaatgttttggctgaaaaacatatncccccaaaaaaaaa

SEQ ID NO: 668477 - DNA, 171 bp, Homo sapiens
atgggtgctccatcccccggtgtgtgtgtgtgtgtggaggaggcgcggcccttagatcaccttcttgagctcgtcgtacaggaccagcacgaaggcgccccccatgccccgcagaacgttggaccacgcaccctttgaagaaggccttgcccccccatcatcttctgaaag

SEQ ID NO: 668478 - DNA, 1462 bp, Homo sapiens
  misc_feature (367)..(367): n is a, c, g, or t
  misc_feature (373)..(373): n is a, c, g, or t
  misc_feature (657)..(657): n is a, c, g, or t
  misc_feature (1040)..(1040): n is a, c, g, or t
gtctgtgtggggcgctcggccggtgcggccgcggcgggtgttgtatccccgacgttgtttgtccgcaccccccaccggtggtgtgccccctcggccttgttgtggtgtccgcccctattgtggggcccgcctctgattattttttgagtgtggcgacccccccacgctgtttgtggaggcaccccaggagtgttgttgttgcaacacccgaacaaagatcacctcacaggcggcgcgttgtgtggtttgttgcccccgcgtggttttctccgcggggggattttttttccccccccgggcgggggagtttatttttgcttttcgtcgcacagcaccccaccacgcggcgttctcgtcctcgccggcncttctnagagaggtggtgtatatctctatggtggggaaagaatagggggtgtttcctcgccgcctgtgatattctcgcccactgtgtgggcccctccctggtgtggtgtcccccccccccccctccgcggtgtgattctctgatcgccgcgcgaatttcgcacagagagaggtgtcccgcacgtaattattattctttggtgtgctctccacactgtttgtatgagagagacaccccctctcctctttgggaatcttctgtctctctaccgcgcgccctctcacaacagnggtgtatacagcgcaataatatagcgcgcgagatatagccccccctgcgatgatttatatcttgtagagagagatgattttccacctccttgtcgcgcgcgagagacccacgtgtgtgtgtacccacactcttcctagacacgcgtgtacacacactcatgtgtgtggtggaggtgttttgcgcacgacgagttgtgtgtgctgcgcaacacgcgcgcacacacgcacacatgtgggggtgtgttgtggacacacacacacacgtgtgtctcgcgtgtgtgcgcgctcacacagagagagagtgtctgtagaattttttttttctgcgcacacacatcggtctttataaagcacgccgcgcagagagagtgatatatattctngagagactctatatagagggtgtttatagagatatgtaagagtttctctttgggtgctcttggagagcacacattcccacgtgtggaccacacacgcgcctctctaagaatggccgcccccccggagacctctcacacgaggcgtctctctctgtgtgtcggggtgtataacccacacacacactcgagagtcgtctcttctcctctcccacacactcttgagagagagtgatctcctttccgggaaaagggacacacagagtttgttctctcttacacaccacagagaagagaggagaggtgttccccacagagaagaaataaagtatatctcccacagagaagaaacttgaaagaacacccaaaacatttttggccccgggggttaatttccccctttaaaaaaaaggaatttaaaggga

SEQ ID NO: 668479 - DNA, 370 bp, Homo sapiens
agaatgtatgtagaaaggtaagctacgagaactagttagtgtattataaaatccctattgcaagcctaacactagacctcgctagataactcttaaggcaatacaagacggaacatgtgtttagagcaccacagatgcacagaatcctgccctcccctcaacctttgttcatcctaacagaccaacctggctcctgcattaatatggagtaggaggagaacagcaaaacaattacaatagatatgtacaaaaagacaattcagtgcaaacctagaaacttctacttagtcaatagtttccaattttactgagaacgaagatctatgctccatcacccaggccggagtgcagtggcacgatcctaactcta

SEQ ID NO: 668480 - DNA, 837 bp, Homo sapiens
  misc_feature (687)..(687): n is a, c, g, or t
tctcatctgcgcgggacctctcatttttggaggtggcaaacgtcgcccgagtgtgccggcgtgcttactctgcgattcttctcggcgggtttacgccctaacaagctgtagggcattccagcacacaggactaggagtgcccccccgctgggccccccagtgttaaacgtcccctggggttggtttagaccatacattgggggtcccgagtctggcgccctctgttagactctgtgtcgcggtggccccacagcaccagtggcccaaaggacatttaaccagggggagaattttgtgcaacttccggttattgggcctcccccccttgggagtcccacttgtgtcagaaccccttgtggccgcccccgtccccggtagtttttgcttctggtgtggccccccgacttcccttggtttggccccccgccgccgcccgatgttgacctacattttccggctaggcgcccagcacacatctggggagcacctgggcacttaatttgtcgcgccccgctgttttctcctcccgggtgtggccccaatcacatgttgtggacatctgggctcatcctgcctctcggtcgtttcaagttgaatctccctttttcgcctctttcactggcactccttgggccggtgactctctctccccgtgtcaccacgccgttgatttgtgtaagtgtagangcgcgtgggtcgtgtacgcctcgccgcgaacaggtgtgtgcggtctttcccccccttgctggttccaattgccgcccccccgagggccccccccccccccccctttttcccccttttttttttcccacacctttgtttcccccaaaaaaa

SEQ ID NO: 668481 - DNA, 239 bp, Homo sapiens
ctccccgttactgacttgacgccggctgagaccagattgatttattttttttttttgtggagtcccaaccccaaaaattattccaggacacaagatagggggcaggcggggctgggttctctgggcctaccgtgggggagacatgttattgtaggacgttgagaaactattacgtccgcgcgcgtacgtccggtggtacccgtaaggttccagtacccatggggtggcgccaatgtgga

SEQ ID NO: 668482 - DNA, 332 bp, Homo sapiens
gccaggtagattaggaatcataacaagtgttttattgcatatacttgtagtctgtctaaatgccttctagcaggaatatagtaatgtagtgcttattctgtgaatattaacatggattttttaccactgtacagtatagaaaacacaggttaactccgaagtggcaggcatgctccactacaacagacagacaacttttgctgtaagcaatacctagtggtatgagaattctttttcaagtcctaaaatatttcaacttacagcttgtgtggaaaaaaatttccatttttgtaaaaatgtatgtttcctgattacctcttgctaataaatct

SEQ ID NO: 668483 - DNA, 346 bp, Homo sapiens
tctcttctaactgcatgtcatcagggtgagcctacctttcctatcttcagacctgccacctcatgttcacacctatctttctcaccttttttttgagatggagtctcactctcttgcccaggctggagtgcaagggcacgttctcagctcactgcaacctccgcctctggggttcaagcaattctgctgcatcagcctcccgagtacctgggattacaggcatgtgccaccacgcccggctaattttgtatttttagtagagacggggtttggccatgttggccaggctggtctcgaactcttgacttcagatgatccatctgccttggcctcccacagtgctggg

SEQ ID NO: 668484 - DNA, 1164 bp, Homo sapiens
  misc_feature (113)..(113): n is a, c, g, or t
aatttctatcaagcagtaacaacaacaatatttatagactacaattaattttcctattatcgatctcaccactacttctccatatctccctacacaaccaaaaatgcagtgcngatatgttattgtctttattaatagatcaagaagagattctttgttccatacgtgctacattaacacataacgtacataatcacaaccaacaaaatccactaaacatgtatctctactatactcctcccaccatacagcaacacaccatctcaatcatcactccatcctccctcttaccccacacactgctctcgtgaccttttcgtatcgtagtatacgtaaaaatatagacaaacccgataccgatttccatcacttaacacacaacaaatcactaactcaaaggacatgaataaatcctccctaacgacgagctagcgacacaggacaagcacgggctgcgcactccgctctggctccagcatccctccccactatcatcacctgctcttcttacatcgtgtgatctcgtaatgatcagcaaacacacagacatgaagaaacaaaaaacaccacaaaaatcttatattatatatttgtgcgtatgtctactgtctgtaccgcctaggctatctatattctcttccttaaacactatttttattatattattctcttcgcttgagccaatttcttcatcgaactatcgttcttcctctctatctcacagacgtcgatcacctcctggagatcatcacataattacatttatcctgccacgtatcctcattcagccgatcttcagtcctgctccttctcacttctacaatgtaggcattggtagtgcacctcgagcctacattagccctaacttgaataacagctcaatagcttaagctataccctaatatctctacttatattatatgttacttaaatatccaatttaatctggtatctatccaatcatgtacacccaagagacgttcagattcaaccacacagtgctcttctatcgatgcctctctcgcatcttatctccaactcagagatcatctaccaattataacacagaccatatcgctcgacacgctcaacatctacatacctcttaaaaaatacacgcaatatcatactctcacatataacgatcagtttaatttattatat

SEQ ID NO: 668485 - DNA, 100 bp, Homo sapiens
tacgggcagcagagttcactgctggcctataatacaacctcccacaccgaccaatcctcacgattgagtgtcaaagaagacccttcttatgactcagtca

SEQ ID NO: 668486 - DNA, 378 bp, Homo sapiens
gtagtcctagtaaatcattgtcaatctctgcctagtcacacgtagtgttcccctgatatagtccaggtaatcatcctgaatctgaaagaactctttaatctccagcatgatcttcttggcactgatgtgctcattcttggtcttccattctttgacatgtgcatttgtgctgtgccttcaggaagtgttgtccgagctgaaagcctgtcttgtccgtcagcaatgagatttgttgtcctcttttcgcgtgcctctgccatgatccatcattgccctcggcgcgtcgtgattcggttcagggtctgatcggtctcagtctgatccgcattctgctgcccccagctccatctggttctgctcatatggctggtcccggcg

SEQ ID NO: 668487 - DNA, 347 bp, Homo sapiens
gcccaacactaggaatacccaaatgtcctgtaatggtgaatggttaaagaacctatgggacatccataccatggaatacgatccagccataaaatggaacaaacctttcacacaggcaacaacttggaagaacctcaaggaaattatgctgagtgaaaaaaaaaaaaaggccagtctcaaaaatggggcatacgacatagttctattaatgtaacatccaaaaaaataacatattaacagagatgaagaacagataagggattgccagaggttagagatatggagagagcatgattgtggctgtagagggatagctctaggaagctctgtgctgatggaagtatagt

SEQ ID NO: 668488 - DNA, 329 bp, Homo sapiens
caggtagactaaccatacagcacagaccaattagccagaatgcaagaataaagtagattcttaccacaactatcgctataaatcactgcaactatgctttccaaaaggaccctaatcttatgtgaaaacacctactgtgggggaaccagaaacctagctacctggccgaaaggaatcaaatagcgattcgagtggttatttggtgatggcaggatatgtatgcccttgactgtgctgctgttgctgctgttgttggtgcttttgttgctgctgttgctgctgcggccggtgctgctggtgctgctgttgctgctgcttgggtcttctta

SEQ ID NO: 668489 - DNA, 84 bp, Homo sapiens
cggacgcgtgggctataaatataagtggcctttccagtacagattggattttatgcaaccttttttccttgaattaacagcaat

SEQ ID NO: 668490 - DNA, 110 bp, Homo sapiens
ctttaatttaatgagttaaatttatggattatgctttttcagtcttgtggtttttgttttcggacggggtctcgcaatgtcgcccaggctggagtgccgtgattttgaat

SEQ ID NO: 668491 - DNA, 268 bp, Homo sapiens
tcccaaaattttttttggggttttttttaaaaataggggaataagccctggtttttttgccgcccaatccccttttccctttttagatttggaggtggggttttttttcttgttattagccggggggttggttttttcctttggggcccttttttagggttttatggtttcccgggtatgggctgggtttttccctggggggttccccttggggcctttggggttttggcccctttttggggtttttaaaagttttgggtttttttta

SEQ ID NO: 668492 - DNA, 398 bp, Homo sapiens
  misc_feature (32)..(32): n is a, c, g, or t
  misc_feature (70)..(70): n is a, c, g, or t
tgaggcaggaggatcacttcagcctgggaagntgaggctgctgcgacctgtgattgtgctcctgcattcntagcctgggtgacacagtgagaccctctctttcaaaaaacacccaaagtgctatttttaaaataaggtataatataaatatgtattactggtcattcttcagaatatctgtttatagttcagatgtaaactgatctagtgtgatatgctaggcttctgtttttagcatgttttatttattttagcgtattttaatgagaagttttcaagatgctgaaaacagttattttgatctttgatagtgtctgcaacattcagaaatttaatttataagttaatacattatttgaagcagcctgggtaacagagcgagactccgtctcaaaaaa

SEQ ID NO: 668493 - DNA, 162 bp, Homo sapiens
ccgccatatacgtgtcgctgcggaacagttgcccttgttccgcgagagaccatgatcactagcggccgcgagcgcggctcaatcggcgcgattgcgaggtgccactccggtttaacatgcatcttcccatcctccctgtgtgtattaatttttgtcctacaa

SEQ ID NO: 668494 - DNA, 341 bp, Homo sapiens
  misc_feature (136)..(136): n is a, c, g, or t
tttttttaaaaggccccccccaaaaaggattctttctgggaaaggaagttcggtaaggaaatgtcaaatttggttttttaacaaggtccccccccgcaatgaaacccccccttcagccccaaaagattttaaaaanttatgtggccaaagggcccaccccctgtggccccggggttttgccccccccccccccccatttggttttggtaaatgtccccaaacggggtgacccctgggcaataaaaacatagatcctaaagggtcctttggaaactgttttttttgaattaaaatttcccaattggccctctgttaaaaaatgttttttttggggctggcca

SEQ ID NO: 668495 - DNA, 129 bp, Homo sapiens
agccactatgctgagcattgacagaacagctgcaccatgtaccccaccttcagtttataagaaaaaaaaaaatccctttcactcctactgggaggtgggacccctttacattttcagtggttgctacat

SEQ ID NO: 668496 - DNA, 694 bp, Homo sapiens
  misc_feature (189)..(189): n is a, c, g, or t
  misc_feature (479)..(479): n is a, c, g, or t
  misc_feature (588)..(588): n is a, c, g, or t
  misc_feature (591)..(591): n is a, c, g, or t
  misc_feature (594)..(594): n is a, c, g, or t
  misc_feature (602)..(602): n is a, c, g, or t
  misc_feature (607)..(607): n is a, c, g, or t
  misc_feature (660)..(660): n is a, c, g, or t
aacactggtgctagtatacatcaccctggtgcgcaagagcaggcatactcagcccactgcagccgactgttgggacccgaagactggaccgtgtagtatcccaagttcctagcaaagcttcatcacactttgtcactaagcacatcctaagccactgagaaaatcacagacaacaatgatgctgtttanacagtggaagaaatctatacagtgattacactactgcactagcagccaggaatcagaaggccaagagcatccatacccaagtgaagcacgtacgacatagcagttttccaggaacggagtcctcgcccgtagtgataacgcaagagttcaaacagagttgagaaggaagcaacggagttaccagcaaagtatgcgacacaataaccaaggtgctaacggaaccaggacggatgtactagtgaaagaatgcgaaggggacacagaaacagtatgtaacatgtctcatatgncacacaggaatcgcacagagtcgactataattaacactgttacgaagagagtcagctggtcaaacacagagatgtcgcaatattatgtggagccgcgtagcagtaacgncantgngctgcagngtccnggtgccagtttggctggccttgcactgccatgctaatgttccgcagtcaattnttgggggaggccaggatgggcagggcaattatgc

SEQ ID NO: 668497 - DNA, 381 bp, Homo sapiens
caaaaaagggagaaagcaaaaagttggaaaaaacagaagtcaaataaatagctagacgaccttggcgccaccacctggccctggtggttaaaatatcaataatattaacccctgaccaaaactattggtgttatctgtaaattccagacattgtatgagaaagcactgtaaaaactttttgttctgttagctgatgtatgtagcccccagtcacgttcctcatgcttacttgatctattgtgactttttcacgtagaacccttagagttgtcagcccttaaaagggctaggaatttctttttcagggagctcggctcttaagacatgagtctgcctacgctcccggtggaataaaaaaacctcttccttctttaaaaaaaa

SEQ ID NO: 668498 - DNA, 384 bp, Homo sapiens
aatcttcctctgaactaggtatgattttcaatgaacgtgatcaggaattgagagacctgggctaccagaagcacgcctttaatatgctcattagtaaccgcttgggataccacagagacgtgccggacaccaggaatgcagagtgtaggaggaagtcctacccgactgacctgccaactgctagcattgtcatctgtttctacaatgaagccttttctgccttactgcggactgtgcacagtgttgtggaccgcacaccggcccaccttcttcatgagatcatccttgtggatgacaagcagtgacttttgatgatttaaaaggagaactggatgagtacatccaaagatacctgcctgcaaaagtcaaggtcataagaaaatt

SEQ ID NO: 668499 - DNA, 864 bp, Homo sapiens
gtctgaatacaggagtagggggggtgtgggctgtgtaaccagagaccgatgagctatgagtggggtgtgcctcgtgtgcgtggattcgtgtgtgtgtgtgtgtccttgtatatgtgtgcgcaagagtgcatcattttcagactctactattaccgtcaagtgttctgtatatgattcttgagaatcatctcaggatcgggagttcgtgttgtaagagtgtttcgtgggccagggatccgggcccctgccctcctctggacctgaccaacactccctactcagggcatagatctgtggcttcccgagagcatcttctgagtatgccgttgcaggagagggctgggtggggcagaggacagggaggggagctggtgtgtcaccgtggacagccgatcgtgggtcagtctcgctcagggcgaccctggacccatatgtctagataggttacggttatgctagctgtgcgcgaggttcgagcgcaagcatgttcgtccttgtctggaggcgtcgatcgggcactagatgggcactgtggtcccaaaggtaaggtcagaaggttgggggtttgctcgacacatcttggggtgcacttgttggggacagatgagtgagactgggctgttcgaagatcatcgccctgccaaggggagctagtggggtagcttcgagagcccatgccgcgggtcgtcaggggccatcgaaggtatgggcgaaagcccgggccgaaagaggctggagagagcgaaacagcccctgggtaccaggggggctgggaacacaactaccagacggaagctcgggcccccggtggcgacccaaacaaccgcggggtggcgagaagcaaacaaaggggagggcatgctc

SEQ ID NO: 668500 - DNA, 384 bp, Homo sapiens
aggcacaagtagagaaacgccccagtcacaacgttgataaacaccacccagaccctgtgcactaccaggcatccgttaccacatcacgtacctggtcagaaagctgtttatgccatcagcccctacctcttttatgataggatatcctcaagggctcctgtttggacctcagatacatccttgcctgaaagcagaagctagacttcttgggctcctgaacaggggccttgctggaatctgtgaaacaaaataagttcttgaccctaggcctctgacggagtacaaagtctatgtgagtgctggggctgcggttgcaaggaaagtgacgcaaccagattccatgtggacatgatcaggcgtgacatgtgaggcaggaagagggag

SEQ ID NO: 668501 - DNA, 983 bp, Homo sapiens
  misc_feature (394)..(394): n is a, c, g, or t
  misc_feature (405)..(405): n is a, c, g, or t
cagaagctgctgaatcaggtgggacttcctgtatctgggaggtcactcgaccacaaactgcacgagctgcgcgtgctgcggcgttgccggctgcagcggtgggaggactacatcggacgacgtataaccgagctgagccgagccagtgcggtgaagcgtgtgcagcggacgtcgcttgtggctgaatcgtgcaccagtaacagcagaccagattcgcgtcgtgcggcgctttcgggctctggtctgaatggtacaagctgtgtatgcgtcgtcgggcattggatgctcctacagctgcggatgcgcatgagagcgtctgcgtagttcagtcagggcgctcgctcctatctgctcgtctgccgcactaccccaccctgtgctcactcagagtcgntgcgcattggncgtcgatggaaccattcagggtcttgctctgtgtgcgcttttgattggaagcaacgcggcgacgtaacagctgtggcgacccatgatgtgtggttgaccgagccctcggacttacacttgtcgatcgctgcgagcatggtagagacgtttcgtacagcttgtgcgtggacatcgtgccagagactcaacgcgtgcacagtgtctaggagtaacaattgacggacgcgcgaaatgacattcgatctgggaagcctagctggatctcccatcgtttgcatggtgtgttcttttacacgatgggaaaactgaggcctgatgctggagattctatgagggtgctctcctcaagggtatcagacggtcgtaggttcttaagaatttgattcatcagtggcaggccatgcatagagccacggggaggtgcgtccttggttttccaggaaatgttcttagaacgttggactacgtgattattaatttgacttgtgccttggggaaacagtgggaagtaacttggtgcagcactggggtaattggttggatttcttgtgttggaaactttgttactgttaaacgga

SEQ ID NO: 668502 - DNA, 233 bp, Homo sapiens
tctagcggatctcaattctgccaccacagcctcccaagtaactggggcacaggcgccgccacacgccggtaattttttgtatttttagtagagacggggtttcaccgtggtctcaaccttctgatctcatgatccgcccgctcggcctcccaaagtgctgggattacaggcttgagcaaccatgcccggcctcctttgttctcttaactgcagaattgcctgtgggtggattg

SEQ ID NO: 668503 - DNA, 632 bp, Homo sapiens
gggtgacgggcagataatggtgcaaaagcattcttcccaggcgaaaagtgtatcatgcatcactgcagatttaagtccttcctttgataatacttcaaaagcatacacagctttgcttactgaattatattagcaaataatacaaggaggggaaacgtaacttgtatactagtgttgtgaagtgaagtataggcgcttgggaacattataaagaaaagactggtcattcagaatagttatcgggctgtgggataatttacgtgaaaagtgagatcagtaagtgagctgtgttgttaaaaaattattatctggtaataataccatgcaatatatgcgttgtataccaagcgttagtgcatttagagtactgtacttaacatatgcgagatacttctaatgcctctctaagacattaaagtattgagataaaaagtataggtttattcaccttgtaggctttccaagtgagatgtgactaatgttgcttcaatcgttacgatagatctttgacccgattagacatgtattacgtagatagattcgtgtaatgccttaggttattatacgtattaatttgtaaggtatacatgggaaattacaagaatggtacattgtggttggtatcccagaag

SEQ ID NO: 668504 - DNA, 978 bp, Homo sapiens
tcctaccaggcttcgcgacataatctcccagtaattgctaaacttacgtactccggaaaacaaaacgaaccagttctgagactacaatacggctattgcgctcctgagcttagtgactatcaactctgcgcttccatagcggctttatcgatgtgagcacaccatactatttacagtaggaatagacgtagacacacgagcatatttcaccgtccgcgtaccataatcatcgctatccccaccggcgtcaaagtatttagctgactcgccacactccacggaagccatatgaaatgatctgctgcagtgcctctgagccctaggattcatctttcttttctcaccgtaggtaggcctgacctggccatcgtattagcaaactcatcactagacatcgtactacacgacacgtactacgttgtagcccacttccactatgtcctatcaagtaggagctgtatatgccatcataggaggcttcaatcactgatttccccgtattctcaggctacaccctagaccaaacctacgccacaatccattgcactatcatattcatcgcgcgtgagagtctagcgtgtgcgttccgcgctatcacgtgttcctcggccctctgccgtgcctgtcctcgaacggttgcctcgggagtagtcccgatgcgtaccccgactctgacccagtgcgactccagtctggttcgggctccgctctccttctctgcgttgatgagcggggcggcgtcctccctgtgcgtctctctccgcagtggatcttctgggcgggcgacgcccctttgcggcgttgctgaaactgtcctgcatctgaggtgccgtttcatttacgtcaggcatgcgatccctgcccttgcgtctttcttcgcctcctcggggccggttgcacttcgatgactcggggctcgtgcccctcccgtgtccccgcttgtctgccgtcgctctttcgcatgtgatggcctggata

SEQ ID NO: 668505 - DNA, 120 bp, Homo sapiens
ctcacaagaccctgtccaattgggaattctgaggggcagaagcaggaagcagttgtgttgtgccaatggtggagaagaaaacttcggttcgctcccaggaccccgggcagaagcaggaag

SEQ ID NO: 668506 - DNA, 251 bp, Homo sapiens
tactccgtacaaaagaaagagagtcatctattcctccatttagaaacggaatttatacaaaacccacaaactcccatattggtgcactacgaacatgagataagattatgagccttcatcacagccccaggggttctgaaggccagctctgttcctgtttcccacaggaagccgcactgtgtgacctttttggggggaaacttggaagaggttgagggtagggcagaatttgcatatataatcatcatttt

SEQ ID NO: 668507 - DNA, 177 bp, Homo sapiens
gacgcttatgtgggtctggagaggcgccttgaggttgccggcctctgcctccctcatggcggctctgcaggccagctgttcctcctggctgcatctctcggccagctcctgcctcccagcaggcaagctcttctggctcagctccctccagcgtttgtagaccccgaagtttctgca

SEQ ID NO: 668508 - DNA, 102 bp, Homo sapiens
accggtgctcatggtgcaccgcgcgcactgcctccacggtcagatgactcacggccttgccccctccctgcctggagcatcggtgggcaagctcggggcata

SEQ ID NO: 668509 - DNA, 827 bp, Homo sapiens
tataaataattccattttaaattctctgtacaaaacttctcaatctatgaaaataaagtttggcaaagggcaaagtagcacaggagcctcaggtcaggaggctaagcacgctgacctacacttatgtacactgtttctctcccacgacggagagagaggcctctggggcaagagccctgtcttgcagtccgggaaagccaatgttgtggcttctccgtcagcacagggaaagtgtaccccttctctttcccgtgttacacaggaggaaaaaagccactaagggtgcctgcaaagcaaggaggggggccccccaaaagtggctcggccccttgaaggtgccccgattgggccaccagaaggctcagccaccattcagtggccgcgcggctctatagggctcaaaactcgggccccttcgggcgcttccaccggaaaggcacacagcagccgacaggctcaaacttggtgggagcgcccaaagctcctctttgccacttgcctttcggcctttcaaaagctttcgaacccgaggacaaaaacgctgcccggggaaccaagaggggcttaaacgaaccaggggtgctgaggccggggaacacggggtccatagcgtggaagtgtgaccggtgggacaggtcagccgcaactcttctttgggcgtccccagccgagccaaatcgcctcagaccccagtggggaacggtgcaaggctcgcgagttcccgcggcattgggcccgcatatggggcgccttggtccccagggcttgctttacactctggtccagtggcctctcgttgccttcaatggaccccttcattgccctca

SEQ ID NO: 668510 - DNA, 174 bp, Homo sapiens
  misc_feature (158)..(158): n is a, c, g, or t
gtggcgctatggctgcactggcgacatcgcgccagtaagttttacattgtcagatgcggcctgaaacgccttatctggcctgacattcctgtttgatcactgtttcatacaacgcgcccgccgttcgtctacgcgcttcgaaaccaggccgtagtcangttgcggggtgaattt

SEQ ID NO: 668511 - DNA, 239 bp, Homo sapiens
ttttttttttttggaagggaaaattggttttatttacaatttatttttattgtccaaaaaactcaaacagtttggttaattctaaaaactatgagaatattatgtattccaaaaaaagtattctgagaaatttcttttctgggggagaaatggacgggtcactattaatctcaaatatgggggatgggtggtatttaaaaacttttggattttggattaataaaaagaaagtgtggaag

SEQ ID NO: 668512 - DNA, 376 bp, Homo sapiens
tcgcccggccagcctcccaaagggctgggatacaggcgtgaaccaggcgccggcctcattggccattcggagcgtaaaatcgaaacctagcaaagtggggcactagtcgccactgagacttgagagaaatctgcttatcctggaattactcttctgggagtgctgcgggaagcacggcagtggggaggtacttggtctaaaaagagcttcatttgcataaaatacattggggatggtttggttggctaaggactcaattgagccctagtaattgggtgaggtcgagtgggtagaaaataaaaagaagcattcctttcttccccaaccttcttttcctcaccacaaccttcaccattacggtgttacttcataacat

SEQ ID NO: 668513 - DNA, 361 bp, Homo sapiens
actagcattccagaggcagagacaaaaagcagcaggcccaataatcctgatgcatgatgcagacaatcaatggagataagacaaactgacattaactaatggcaagtacagcaagttgtatccacattctgttctgactctgcttccactgctaactggtatgcactaattacactctccaagctgaagagcaagctcaaaacgatgctcaggatctgtggatactgtaagagcttgatgatagaagacctgcttttccaaaaagtgtgcaactctggtcctctgttcttatggaatggtaggaaggaccttatcagccatgctaaagtccctccgcatgacagctgtctgatattccagg

SEQ ID NO: 668514 - DNA, 678 bp, Homo sapiens
gggtcgcggttcctgcagtgtcctggacttggccccagactgccggcaggctcgtggccagaacgccggccggtgaccatctgcagcaggcgctcgacagtctccataggatcgctgctggccattgcacgacaatgttcgaacagaacgcggctcccagttcacaccaagttcacgcacacatgatccagtgtagtctctgctagtaatgagccccttgcctttgcttcctgtggcacagagggatttcgggaactgccaaggaagggcacatggcagtcgcatgcacaggacagcaggcatacgccgcagtcggcgatgacgctaaacaacaagggcgttgatccacatccgagtttgtggtgaaccggcctggtggcctagtgatcgcttgtctgccatgcatcggactgatcatgggcggcctgtgaagtgatctcaatcacagacaacaccccaatcccagcactaacggactgccgacccaggaaggctcggaagctgtgatgggagaggaggcctgcacttggacctgacctcaaagcctcagcgtccagtgggaccttgtagaaatgctccctgtcagagctctccagaatatgcttgtttggagatccttcagcgcagtaagggagactttttgcctcctttacacagtggccttttgcttgcacctcc

SEQ ID NO: 668515 - DNA, 145 bp, Homo sapiens
ctagaggatcttccgcactgttgtcgtcagagcgctccacatacgctgccaccaagatctgattgcccaggtcatagacctgcccataggccagcgttccaacggcattggacggaacttggacaggcttgccattgagcgacag

SEQ ID NO: 668516 - DNA, 155 bp, Homo sapiens
acccggttgttcacgttcgccggctccgtctactccggactcttcatcggcctcggctgcatctggcggccgcctgagactggcgccactcgacatacgcgtaccgtcgcgacgcggggaccactgtaccacgacgctcgagcacgtacctacgt

SEQ ID NO: 668517 - DNA, 86 bp, Homo sapiens
ggagagagagagaacaggtacggtcgaatggccagtgagtccaggccgatgcggttgagctgaccaggacttgactcgggtacaga

SEQ ID NO: 668518 - DNA, 815 bp, Homo sapiens
agattactgggcttcctcatcctttaaatggtaactctcctttgctttctgaacacctaggaatttcctgatgttatgttttgtggattccagactttatgtgtttctagtctgcagctgagctctggtgcctgttcttggtccaccccctaatccctaactcttccctcagcatcacagggcttcactgcacacactgtgttcagggcaagatttcatcatttactgactgcatactcgatatgtgttttgtaactttagccaaaagaaagtaacctttagtggcaggcatataaaaaatgctcaggctcacttgcagatattttatttttaaactttttttcttttttcccgggaaaacttcctgtgcagaaaagggtgtatactttagaatacctgaaggcttctgggctcttccactttccttattcctcctcttcctgccactcttttggtcccttcggtcttccggctcatccttatggggtatcagcaggtgtcagttgaggagggactttagcctgaggttaaccctctcttcggggattcgcactcgcacatggagggcccgggaagaatctctgagacctcacaatcaggtgaagctaggaacgatgggcgctctccaggagcagggccagggccctgagtaggaccgtaaccgcctccgtgcgtggcatatggtccctgcatgctgtcgctcggtatagcactaacgatccgctgaggctaagaggcccaggtgccgggctcgtgccctggactcccggatctccgccagcgcactcgaacgcccgccacgggcactcacacgg

SEQ ID NO: 668519 - DNA, 101 bp, Homo sapiens
  misc_feature (88)..(88): n is a, c, g, or t
gcagttggcaggtgcactatcccagatgggccactaatagaaagttccgcaaatgcaccccgttcccctgtgcgagatcgtttgaatnagaccagaaactg

SEQ ID NO: 668520 - DNA, 130 bp, Homo sapiens
gccttggcaaaagcaccagcatgtgatttacagcagtggcgtgccgggtaacgcgtcatcgtgttcttttcccaggccttcagctacaacgcctctggggtcaccgcagctcgcaattcgtcaatccatg

SEQ ID NO: 668521 - DNA, 132 bp, Homo sapiens
gaggctcttccatttagattcagaaaagttgagcatattttattaccaatgaattttgaaaaccagggctttttttttgttctggggggtacttaaaacaccaactccccccccacccaaatttttttaaaa

SEQ ID NO: 668522 - DNA, 849 bp, Homo sapiens
  misc_feature (312)..(312): n is a, c, g, or t
  misc_feature (635)..(635): n is a, c, g, or t
cgcccgcatctgcgttttatttaggttccagcattacacatagtgcccgtgcctgatgtgtctaatctcgcgtgtgttgctgttggcaaatcatggaaatcaagagagatcagcgtatgtaatccccaaggagtgattagagtctccttcatctatgtctctgacagctgggtttaagtgcatgtcataacctacgcttaagtcttgaaagaatctgatagatcattcttttggctggtaagtccacgatcaaggtgctggcggattcactgtctggtgagagcccatttcctggctcatagatgtgtcctnccaaccattggggtaagaaaaggcgctttttctggggggggggggtggccaacccatattagggttattgtatgaattaaaaactattacggtgatcgctgttttgaatgtgagggatgctgtacttactttcttgttgcgctcgttatctttcttatgcgattttacgacagtgagtattagcttatgtagtattgaatacaagcatgcaagaacgcccttttgcatgtttcgttaacattgatacccggtcttctccaaagtcgtgagatttccataggatgttgtagagtgattcagtctgtaaggacgggaggtgtatngagtgggcacaccccgccccgtctcgttcagagccgtcattcattcgccgttgcctctttaatcgtattcgtgcctatgtttactcttcttatttgtgagaacgtgtggatcttgctcctgtattagtgccggatatgttattcccgatttcacgtgtaggtgttccactgatcatcttcatgcctatcacgtccacttatttgtcactcatct

SEQ ID NO: 668523 - DNA, 305 bp, Homo sapiens
gagcggtacccgccacagcttctctaccatcctttggctatagggtattttaaacatacagatttattttccttttctatttacagtttcctttgggtgagaacggagtgagttggttatgaccgggggacctgagtcacaccactttgattaatgccagctccaccacgcactagctgcatgactttggacaaatttcttactttcttgcagttctgtttacccattggaaaactgaaataataaaaagaacaagcttacgtggttggggagaagctgtggcggccgagaagctgtggcggccg

SEQ ID NO: 668524 - DNA, 575 bp, Homo sapiens
ggcagtgtcccatccgggttgtggaaccaaattttgcttgtgaacagaattccaccagtgtaaggcccaaagccgaaaggttcctccccccccctttccgcccccgggtggtgatttggcaaaggtggccctggtggcattcggggaggaaaaggtggcctcatggattgtggtggtcccggtggaatgttcaaaggtggccctggtggaaccaaaggtggcttccgtggtggccggggcatggaccaaggtggctttggtggaggaaaacaaggtggccctggggggccccctggcccttttatggaccaaatgggaggaaaaaaaggaggccgtggaggccctggaaaaatggataaaggcgagccccgtcaggagcgcagagatcggcccttctagatgcaaagaccccccagaggtgccttggctccccgatttttttttttaacccgaaaatgtttttaatttataattccctatttttaatgttggccccccccttttgatttttccttgtttggactttagtatttttccccctttgtgaaaaaacctttaaacaagtttaatggtta

SEQ ID NO: 668525 - DNA, 352 bp, Homo sapiens
ggacccccaaaaccttcttttttgggggtttttgttcgggggaccgggttaaaaaaacttttgggggggaatttccattttccggtttaaaaaatttccccccaccttacccattttttgaaggtcattttttttaaggggttaaacccttttgtggggcttgagggcaggggataaacttccaattgggcctgggctttgggaagcggggggggggggcccttttgggcccaggtgcctgaaaccagccggggaaaaataaaaaatccgcttaaacaaaaaaaattttttacccgggggggctgggagctggtaccccacttccaatggggggggtatgtttaggcctggg

SEQ ID NO: 668526 - DNA, 111 bp, Homo sapiens
tcccatcagattcatattacaagtatattacttgtaccaatcattactttatatacttaaagttacacaatgttatatatcaattatactgatgtggacgaacgactgcgt

SEQ ID NO: 668527 - DNA, 1048 bp, Homo sapiens
cagatttgcaagtgagctattcccaggactgctctgagactttcatctgtggggctatctggctctttcctcagactgtctgaccttaagcaggtctgaacaaacgcaattcagtgtggcttcaaaagtccctgaattaactgcacaaatatagtccagattagcactattcgtctcgtgcagcttaccgttgctgcgcgctagcagaactacaaatactacgaaccaggctaaaaccgctcttcacggctcaacactcacctgcaactagcgcaagacactgggccctctcactctcctcacactcacggtgcctcaactccatggctctcaactgctcaccaccgtactctcagctcacaacctccttaccaacacgggctgctcctgcacttcggctcacactccacggggcctcccattagcacccttacccttggaccgcgcacacaactcctttgaaatccacacctccccactctccccccacacttacccaccccgtggaacgcgtcccactcactccacgctccccttaaccacttagcacaccctggcgcctcgccaaacctctcacccacagcccaaccctggacgcggagcaactactcgcacactcggccccaccctctccccgaccgacaggcaattgcacactttctcacagggggcacccctgggcacggctcgacgcaactcccacccttacgcccgcctctccggccacctaaccctccctccaccgacgtcgctccccaagcgccaccagaccccagccctccgcgggacgcccaaacgcgcgcacctcgagcccccccaaaccaccgcgcctacaccttaaccgtcgcgcaccgtgggcacgccgacgcccccgcatccccatacacaacggcgcaccacgcgggcaaccccgcgctgtccaagccccaccgggccgcagcaggcgcccacccaagccccgccgccgccccaacgcggcaccgggcaacaaacaacaacgaggaggaaccgagccacgacccggcgcgagcccaccgcgcaaagcgca

SEQ ID NO: 668528 - DNA, 606 bp, Homo sapiens
atgacccaccaatcacatgcctatcatatagtaaaagcccagcccatgacccctaacaggggccctctcagccctcctaatgacctccggctagccatgtgatttcacttccactccataacgctcctcatactaggcctagctaaccaagcagcagcataatccatagtaccaagtgatggcgcgatgtaacacgagaaagcacataccaaggccaccacatcgaaccacctgtccaaaaaggccttcgatacgggataatcctatttattacctcagaagttattggtcttcgcaggatttttctgagccttttaccacgtcgcagccgtagtcccctaccccccaagttaggagggcactgggaccccaaagcaggtcattcaccccgctatatatcccctaggaagtccccagctcctagaatgagcatccgtattactgcgcagtcagggagtatcgaatcaccctgaggcgtcaccatagtctaagtagaagaacaagcgaaaagcaatgtaattgcaaggactgctttttacaaagttcactgggtctcgattttaccctcctagaaggctcggagtacttgcgagtctgccctttcac

SEQ ID NO: 668529 - DNA, 172 bp, Homo sapiens
tggtaaatgagagatccaaacaccaagcgctccagggctttgggatgcacatatgccactgtgaggaggtggatgcagctatgaatgcaaggcacacaaggtggatggaggagttgtggaccaagagagctgttccaggagattctaaagccaggtgccactaactgtgaaa

SEQ ID NO: 668530 - DNA, 384 bp, Homo sapiens
ctaatgctgcctatataaccgcttctcatatgctaatgttgcttggatcgatatctgacttctgactcgtggcattactactggattgtgggttatttattcaactgaagccagcactggtaacatgtgtcgcattagtacactcaatgataccacacttcaggtgctaaacacttgcgtataccaagcagttataaaccatctgcttctaacgccttcatggtatgtggggttctgtatgccacccgtactatgaacaccagaacagaagagattttttactattatgacacaaacacagggaaagagggcaaactagacattgtaatgcataagatgcaggagaaagtgcagagcattaactataacccttttgaccagaaa

SEQ ID NO: 668531 - DNA, 166 bp, Homo sapiens
catggcccaggtcaccccccccctggtccccatccctgaggaagtagaaaaaaacaggcccaagatggcgagccttaaaaaattgcccagctgcctggaattaggcctaaaccacaattttctcttcctaataaacagcctcctaaaggcccccttttattcttta

SEQ ID NO: 668532 - DNA, 111 bp, Homo sapiens
gatttggatggcagggaggggccagccttcaccttggcaccgagacaaagaacttcacggcatcgcggtgcccatgaagcatagctgggcctgggccatggagcagtaggg

SEQ ID NO: 668533 - DNA, 231 bp, Homo sapiens
agtcgctgaaactgacgctcacttcagattcagcagtccgccagaagaggctgagcacatactgagcccaggagcaggttcctgtggcggcagaaccccagaatactcgaactataagcaaaagaacaaattcagtcccttctccattaaatggtacacgcagaaatatgaaacctgagcattgttaccacagtgaaagcagaacaagtcgttggccagtttcatctgact

SEQ ID NO: 668534 - DNA, 298 bp, Homo sapiens
catgtgaacgttgtcaagtacaatcgaaggctgcagagaccaatttgaggcacacctgtaaacggctcatggacatggtgagcaaccagcaccccatggtatggcgcacgtaaggaagctcctacgagcgcaacaccgtaggaaatcccagatcagctacctcagttatggccgagccacgcaatcaagggaaaaccagcaatcacggaaacatccatttcaattataagcaaaattaacgacgtccaggcttgactttcagaaaccaggacctttctccctcttgacgctcgtagga

SEQ ID NO: 668535 - DNA, 194 bp, Homo sapiens
ttcactgttgccattgtgtgccactggtttagacactggttgctgccgtggacgacagtacggggacacagagaacaagattactatcactaatgacaagggccgttggaacaaggaatacattgaacgtatggtccaggaagccgagatgaacaaggctgaagatgacaagcagagggacacgggagtcatcc

SEQ ID NO: 668536 - DNA, 1077 bp, Homo sapiens
  misc_feature (268)..(268): n is a, c, g, or t
  misc_feature (365)..(365): n is a, c, g, or t
  misc_feature (562)..(562): n is a, c, g, or t
  misc_feature (581)..(581): n is a, c, g, or t
gaagacacagagggacattcatcaagagggccatatgatgacctctgctagcatgctgtggctagcagaaacactccatcttagcttcgtatcgtgactagctagtcgtatgaccatctcagagtactttgaacgcgctttagtgtgaaggctggtcgcagaacagctcattgccagcaacgtgccgatccttgggaaaaccatacttagagtatcctcttataatcgaaatgtcaagtgtatctgcaacagaaggctgtgttactcntgtgtggatcgttgtgcaggcgagaacatcatacgattaggctagacaggaccagctctccaccatgctgagccatcatgcccaagtgcgtctttgntaactttctgcactggtggacaagtgaagtctggactgccttgggtaatggtggatgtgctcattgttcatactcagtgggattagagagcggaaggaatggaagaggtggaaaggtgcattaatgcagcaaacgcatagtcgtaatgggcaaattcactcgaaagtcgtggcagagtacagtcatccaaaactagnttccttctctcaatctgtnagagagggcacgcgtagacctttaacagtctcgtttgggcaagctggtggtctggctaattcctagagggtaaagaaaatgcgttgtagatacaggaaataaggttgtcaaatgaggaactaagcaacgttcgcactgggttatccgggaagaaggactagtttgcatgaggggtttaaggaaggtgaggttgtggactatactgcaccaggaagctgttggtgcaccgagaactagttgcgctccagtctggaatagcgcttgatcacacaatgggcacgccacggaatacgccatctaagtctgaatcccagcggtcggggctcctgtgccaagctttactcttcactccagggtgcggaatgccacgatgcttacaggaccatggggagcttggtgctagtggaaaacctctggtgcctggtccactaaagaacaagggggaaaacttccccaattgggttgaaaccccttcaactggtggttgtcaacctaa

SEQ ID NO: 668537 - DNA, 371 bp, Homo sapiens
gctcaaatgaatcttctcttcagtttttttgacaagagttgaaggattcgtgttaattcttctttaaacgtttggtagaggccggacatattgcctactcacaatctgtaatcccagcactttgggaggccaaggcaaacaaataacgttgagctcaggagttcaagaccagcctgggcagcatggtaaaaccccatccctaaaaaaaaaaaattaaccaggtgtggttgctcacacaagctactcaggaggctgaggctggaggatagcttgaagtccaggaagcagaggttgcagtgaactgagactgtgcccctacacttcaccctgggcaacagagtgagaccctgcctcaaaaaaaggaaaaaaca

SEQ ID NO: 668538 - DNA, 113 bp, Homo sapiens
atgggcggtgagagagattcatgcaacgaaaggatggcagcatggcagacatgggagattaagcacatatggggattgatcaaagtagtaaatatattaaggataacaaatta

SEQ ID NO: 668539 - DNA, 124 bp, Homo sapiens
gggtttcctctttcacaccttccctgtcatgggcttatcctacggtatacagacgcacacagagcattatgcgtgggcatgagaagcgcgaaaagcgaggggtgaggcggtgggcgactgaggg

SEQ ID NO: 668540 - DNA, 136 bp, Homo sapiens
aatactgtagaatacatgtaggagaatactgtaggagaatactgtaggagaatacatgtaggagaatactgtaggagaatactgtaggagaatacatgtactgtaggagaatacatgtaggagaatactgtaggag

SEQ ID NO: 668541 - DNA, 563 bp, Homo sapiens
ccggctgaagctgctgcccaggctatcctgctccaccccctgccccagcctggcctccgcgtcccgttccccgttctaggggcacacgtggagccatggccctcctccaccaggcatgcgccctccagcctggcgtcaggcgtctctgcttggctcccccaggccccccaaactggctaggggccccgccacacaaagtggggacaccccgtggctggagccctgctgctgctaagaaacagacccccagacccctgcggctgggcaggcctcgagggtggcacgtggacagtagaagaatagatgggccccccactgctagccgcgggtgccccgggccccctgagaccgcagcaccagatgtcgcttcccacagtccatcagaatggtaacattcccacattcatattcctgaggtgcagcggggaggagcagatagagctgggcagtggcaggtgtgggtggagcctgaacctggaggggcactgagctggaggcccctgcaagggtaggggacaaagatgtaggctccagactacccctcagacctcctcatctcatga

SEQ ID NO: 668542 - DNA, 314 bp, Homo sapiens
cattcctgtgctttctgcattatacttggaatctttggatactctcctttgagcttccgggcctccttctgccatattcaccaacaccaccattgttgaggagtaaatgatagctggaaaaagcgtttcatttctctcctgagctgtttcaacacatcatatcaattggacctttcggacacaaaacagccactaaatcatatactgaaatcacaaccatgatgagccacgcagtccattcagggagggacttgattaacaccatagtcatgagggcacttatcataatgagatttgcctgctggaatcaaaat

SEQ ID NO: 668543 - DNA, 132 bp, Homo sapiens
cctcgacaaggaagcggatagtgaagtgttctcgagcccgctgctctgcagggcctgcaggtcctggcgggcagctgggctcagcagctccagattcttcacttccacttcgttcacttaatgccgctagcg

SEQ ID NO: 668544 - DNA, 779 bp, Homo sapiens
tagcacctccgcgccgtcgccatgtctgcggtttttcaccaccgtgttctggacagctgagtcctgagtcgtccttgtcctgtgtggagtgatgctcgtcaccaaacctgtctggagtgcaactatgtgcaaacatgccattgtttgctgctgctgatggattgaagaatgataccaagagatgtttgtcctgcatgtgccaatggacaagatgtgttttgatgtgatgctgaccaaccttgctcctgtgaccatcctgtaattgccattgaagattctgttgattgtcagccaatgttgccttggacagatgttttgatgcttcctgtgtgacaaatggcatactgtgtgcaatgtgcgcaagaatgccatttgttgtgacaacatgcaatgtgttgtaccacccttgtgtatctactatacctgcattccttgtgcttgaccctaagatgtggactcatcattaatttgatgactatgtgtcggaatggcataatgtgacactgtgtgaacgactcgcaatgactagaacaaatgaaacaaattgccaatcggctcttgaagcagcctctgctgtacagcaatgaatcctgagaaaattacgagaccggatgaatattcagaaggtcaccgataatacaccaaagctaacaaaggcatagaaagcgcctggagccatgtccttgctgtgattgcagacttgcttgatggaaacatcgatgcgaggatttcatgacaggtctcttcaagaattgagggattggcggtgatgacgggag

SEQ ID NO: 668545 - DNA, 160 bp, Homo sapiens
cagccgggtaatcgggaatacttgcctcacaggttctactccaaagaccacatcatcgaaaccgcatacatatcatacacagacgcctgagccctatctattactctcatcgctacctccctaacaagcgcctattgcactcgtaataattcttctccac

SEQ ID NO: 668546 - DNA, 202 bp, Homo sapiens
tagtcggtaccctcataatgtgtgccagcatgacaacatggtgaaactaataatacaaaaattagctggccgtggtggcgggtacctgcaatcccagatactcgggaggctgaggcgaggagaatcgcttgaatctgggaggcggaggttgcagtgagccgagatcacgccgttacactccagcctgggcaacattatggag

SEQ ID NO: 668547 - DNA, 121 bp, Homo sapiens
gccggacctactttccacagggattaagtattatctctacctccaattcccccccagctcaagcttcctatttacactttaaaacccaaaaccttaatctgtgggtttaatatggatctaa

SEQ ID NO: 668548 - DNA, 400 bp, Homo sapiens
gtaccccccacccaacccagctcctgctgctgtcccagtcttgagctggggcctggaaagaggaagaggctgcctgaggctggccagcccgctgtgcactttgaccccagttccttgccgcacggctgctaacagactgccactgtgagatgcgttgcaggcactcccagagcagccatggaaggagctggccatcacaccatccacatccacaatacctcatggccagctgcccacaccagtgccaggtgggagagggagcagaacagccagaccccttccaggtggcagtcggaagggttattgttataatttctgttgccattagagtaaatactagtatttttggaaaaaaaataatgtaaagatgatatatataaaaactctgaattaataaaaa

SEQ ID NO: 668549 - DNA, 186 bp, Homo sapiens
  misc_feature (155)..(155): n is a, c, g, or t
ggatttgctggtgcagtacaactaggcttaatagggacatgttttaatttctagctttttatttttgtgtgtttgttgtatgttatttttgatttgaggttaccgtgaggcttgcaaatgatataactcattttaaactgctgacagcggaacantgattggataaacaaacacatgagcaagaga

SEQ ID NO: 668550 - DNA, 1114 bp, Homo sapiens
  misc_feature (290)..(290): n is a, c, g, or t
ctgctcgcatctgctattctgcgagtgccggactcgacgaacaggttgaacagtctaccctcccttagcccgggaactactcccacccctgtgagacctccgtatacctaatctaatcattcatcccttacatacttaggcttgagtaatcctccgatctattctttaagtggggtccatcacattatcaatcagctagacgaatcttaatcacatataaaaaccccctctgccataatccccaatctaccaagaacgccctcgtcttcgccgtcgtagatccaggtccntacatcacaagctacggtccatagcctttctctcgtagtcgtcatcccctgagtataccataagacctcgccatggggccattcgacgtaaataacttgaccttgacacctacgatcactggcagagcgccgtgccaaatcgatcgcgagcccttttcgtttgctggaccacccccggacgcgaggagagcaggtgcaagacgcacgcaattttactaagtaccacctagattcagccctgagtctccctgacttgggttgccgcgatgttcatgccttgcacaccgatgctactaggttggcttctatttgcgctacacaccatgggtgctattccgcgcaaactgaatgttcctacgccaagtaagtatggtcatactctgttttgatcctacgcgtgcccgcggcgaaatacaaagagaggaaaacccatagtttgtggcgcactcacccactttagcacattcatttgttgtctacctcggaacgtccataaacattggatctttactcccaaacggtttgccgacctcttcccccttaaggaagaaggttctctaacttccggttggcgttggactggcccaacagacgttcgaaagtcaccttacctttctagtcgccgagggactaaaggggcaaaactttattgcagcggacttacgcaaaacctaccggaaccagacgcggcaaagttcgttgtgttcctagcccccgtcccccggaccttacacaccaagatatactttccacctctcgccgcttttatttcccctcataacgccgggcactggttctacagcagcctaagttcaagggcctgg

SEQ ID NO: 668551 - DNA, 271 bp, Homo sapiens
  misc_feature (22)..(22): n is a, c, g, or t
  misc_feature (42)..(42): n is a, c, g, or t
  misc_feature (228)..(228): n is a, c, g, or t
aatggcgggctcaaagtttatnaccccagcacttctgggagnccagggtgggaggatcacttgaggccagaaattcgagaccagcctgggcaacatagggagacctcaaatcaatgtttaatgacctgggtgtggtggtgcacacctgcagtcctggctactcaagaggctgaggtgggaggatcccttcagcctggaagctcaaggctgcagtgattatgccaccanactccagcccacatgggtaacagagcaagaccctgtctctaaa

SEQ ID NO: 668552 - DNA, 580 bp, Homo sapiens
ggacgtgctcatactgggcacgcgtccttctggccacgctccttctggccacgctccgatctggccacgctccttctggccacgctccttctggccaccccccctgcatcgcctgcaagaccgttattcgttgcgctgcgcgccacatgtgctcggtgtattggcggacagcctgaactggctgcgctcgtccatcgagatcgaactgaacagcgccaacgacaacccgatcatcgacgccgaagaagaacgtgtgcctgcatggcgggcacttctacggcgggcatatcgccttcgccatggacagcctcaaggaccctggtcgccaacgttgccgacctgctcgaccgccagctcgcactgttggtggacgtgcgctacaaaccatggcctgccgagcaacctctcaggcgcccccggttgaccgcgccatgatcaaccacggcttcaaggccgtgcagaatcggcgccaggcgcttgaaccgccgaagcgctgaaaaacaccatgccggccagcgtgtactcgcgctccaccgagtgccataaccaggacaggtgagcatgcgtgccagaaggggta

SEQ ID NO: 668553 - DNA, 100 bp, Homo sapiens
ttctctgggcacagtcctgttcagctaccttgcttcgacagcatctggtttggctgccctgatgggatcatagtgagtgctttgctatcggtgttcgaga

SEQ ID NO: 668554 - DNA, 657 bp, Homo sapiens
tagggacaaataatcatttgctcggcatgttaaatcaagctataaaaagtattgagaaaataaactagtgctgtgtatagctaataggttaaagaagtctagtatctagtagataaatataccagttttataaaaacagatgctagatgtgcctcatatcatcgcagtacattaattatctcatgtaaaaaacagatagctactacaaatttgtactcaagcctaatatggtaacctgaagtttatatcatggcatagaattcattataggtgatacaccatatgtagaattcagacacatttaagagacagtattctaccattcagtaattatggttaatagatttaaaacacttctcagtgtatttaattacaaattagttttattcattggttatatgctgctattgtaaggacagatgtgtatttgaatgtaccattataagaagaattctatgtatcttaaactatgatcttctaaaattttattaccgtaagtacttctgtggcctaaagtattttttaaaaggctcaactgtaaagcctcttagccagttggataaatatttggggtcccctaggcattgaaagcagaaagcagagtgacacgctatcacttcaagagccatgaaaacattctcaacaggaaatcctctt

SEQ ID NO: 668555 - DNA, 1155 bp, Homo sapiens
acatgacaaaacctcgtctctacaaaaaatataaaaattagctgggcatggtggctcatgcctgtattcccagctatttggaggcctgaggtaggaggataacttgatcctgggaagtggaggttgccgtgagctgagatgccaccaccgcactccagcctgggcaactgagcaagaccctgtctcaaaaaaaaaagaaaaagaaaaaaacgtttttgaacccggcacagagagctaaatgcctgatagctctcagcattttggggagacataccttggagggatttcgtttgagcccaaagaggttttgagaccagcctgtggggcagacttgggcagaaacttcacactctctacaaaattttccaaaaatttagccaggcattggtggtgcattgcctgatgttcccagcatactcattgaggctgacggcagaaaaattcgctttgagcccgtgggtatggttcaacgggcttgctgtggcaacccgagtatcaacacccagggcaacttgtttgccccagggttatactgtagttggaaaacccccattttcaagatatgataaaacacacataaaagaacaacaccgcgggcgaatgtggtggtgagtggagtcacccagtgtggtggtcaccccaagttgtgttcacggagacacattacgtggttgggcagaggattttgcgtttttaaccccccccagggagtttttttagaccccccagtgcttgtgggcgcacaattattgtgggtagagaggacccccccgtatttatttcttaccgacaagaagaaactatacaatcactacagacatcactctgccacgacaacaatatcataagacagaatagcgaagaataaggataagaatcgaagagaaagaaccacaactagaaaacaaaacaaacagtccgacagaaaaacaaaacaaaaggaaggcgggcgagcccaataaaacataatgagcggcggaggagcaagcacaaaagacaggcacaaccagcctaaacagaggagaggggggcactaagggagacgcgcacaatatacaacgcgggcgcgccggcggacaatcagaaccgcagggtgagaggagcgaaagcacagcgcgagcacaactgagcgaggaacaccatacctggaaggag

SEQ ID NO: 668556 - DNA, 361 bp, Homo sapiens
ggatgttctacaccttttcaaggggtgagatgccattttccctcatgtagatactctatgggagaaacatgcaagagaaaaaagaaaccttcatgttgggctttctttttgctgacaataagatcatgcaacaatatcctatttgcatgaaaatgtagccatcttacaacaggaactatacattcataagcatacttttgaatggaccatttggaaaactttttaggcacaatcgaatttatgcagtatcaagagatacaactataaatggcctgatttttgagtctaggtacgttttgggattaaacactgttcctaaacactggaagaggagaaaagtaaagtttaaagagagcaatta

SEQ ID NO: 668557 - DNA, 262 bp, Homo sapiens
gatcaggtgaccatagatcttcaaatgtgttatgtgaccctacttagaagtctggggctgagaatcacttcgctaagcatgcgcctctcaaggttcactacgcatacatatcattgggtatgctgggccccctctaagtaatgtgattctgcaggtagggaaagtttccatgaacgggcttcttaaacaaggtccccggatcaaggctgactgtggctcctcctagacccccttactcaattacgcacctcagactagacgg

SEQ ID NO: 668558 - DNA, 277 bp, Homo sapiens
aggcattggtgtaacgcctgtaatcccaacactttgggagaccaaggcgggcagatcacttgaggtcgggagtttgagaccagccaggccaacatggtgaaacttcatctctactaaaaatacaaaaactagccaggtgtggttctccatgcctctgatcccggctactcgggaggctgcggcacgagaatcacacgaccccgggaggcaaaggtcgcagcgacctgacatcgtacccccgtcctccagcctgggcgaccgcgcctgcctctctctc

SEQ ID NO: 668559 - DNA, 930 bp, Homo sapiens
ccgcgcggctggtgctcaagcccccatctcccctttgtgttgcgcgaggggactacctctccgttggtcgcctgtctggagatgttctcctccccccgggtgtcgctctttttggggtaatctacggcgacttcggggaattctcccttgggcctgtcttccaaatagtttgtgctccgccagacacctgtattgcctcctcggtatgggggcccacggcccgccgctgctcgtccaacgaattgggctgtgcgacgaccccacgatggggcgcgcaaaacgctttttctcccccccccccgccgctggtgacaggggcgaccccaccttccgccacagaccaccttgttcggggtgccctcaaaaagccctccggtgccccacaaaaggggccctctctgggccctcccccgccgctgtcctaggtattaaaagggtcctcttttcccgccctctgtcaggagggcgctcgcactgtgacacccgctcgtgtcgcggtaacgctattagtgggaaaaatctggtctctgtaattgggcgccgcagttgtacttcttgttgccatgggcggttttcctcactgtgaaagggctgtgagttgctgcccgctctccgctgtgaacaagggaacaatgtttgtctctcataacactggtaagggaacacgcgtcaatcttcttttctcgggcgccgactacaagatggttcttctactcccatgtctgtgcactttccgccccatatgagtggttcccgctagatcacccagtcttgctagataacacccaaacgcgttcgccccttatctacaatagttcgtccgccaagatactaagaatatcaactcgcggatgcatagtcctcttaataatccgcagattaaggatgttacccctctgcccaaaaacgaccactgcggcccacaaaaca

SEQ ID NO: 668560 - DNA, 132 bp, Homo sapiens
acctccagggttcatgccattctctggcctcagcctcttgaattgctgacattatgggcgtgagcgcccactcccagcctttgcccattttaaaatcgtggtatttgtcttcctattgaccatgagagccct

SEQ ID NO: 668561 - DNA, 103 bp, Homo sapiens
  misc_feature (73)..(73): n is a, c, g, or t
ctgggtgcatgcattggtctccctggaggacgtcggctggctgactcgcagtggaagaacaagcacatcaggnacccatggaaacagcgaggtgggctgcgat

SEQ ID NO: 668562 - DNA, 220 bp, Homo sapiens
ggggggggttaaaacctgaaaaggggacctttttttttttaggggtaaggccccccccaaaaaaagggaaaaaaaaaggtttaggggttgggtttccaaccctgggagggggttaggtaaccttaggggccttaaatttgaaaaggttttttttaggtcctggcccccttcccggccctttttggggggggggggggaaaaaaagccttttttaaagcca

SEQ ID NO: 668563 - DNA, 243 bp, Homo sapiens
aaatcccaactattcagctctcctcatgagaaggacctgctgtttaaggactctgcccacgagttttcaaaagttccccccaggataaacgccaagacgcacctgagctatgagtataccactgccatccggaatttacgggaaggcacatgcacagaagccccaacaaataaatgaaagcatatgaagtggagtgtgttgacccaccacgagcgaccaacgagtcatggacgaagtgtcaac

SEQ ID NO: 668564 - DNA, 385 bp, Homo sapiens
gatgaagctactatacatctacaatcgggttatagttggggcttcgtactcttctctccctctaccatatactgctgggttccaggcccattcctctagcgacctgtacagccacagggcctgcactccctagccagagcgctcagtacgcatgttacttaccatcaatggaagcacctcatggtttgctggtggaacggcaggattagcttcataagctatgccaccaccagctcctagaggtggaaatttctggcctcctgaaccatagggatctcccatgttcattgctcctccggcacccattacgcatgtctctattccccgtggatccatgtatgcccattcggctgtaactttcctctctttggcgcctcattttttc

SEQ ID NO: 668565 - DNA, 793 bp, Homo sapiens
  misc_feature (75)..(75): n is a, c, g, or t
ccggtgccatcgactactgcaaatccaaagcgtcaaccttcgccttcatggagagcctgaccctggggctgctgnactgtccgggagtcagcgccaccacagtgctgcccttccacaccagcaccgagatgttccagggcatgagagtcaggtttcccaacctctttcccccactgaagccggagacggtggcccggaggacagtggaagctgtgcagctcaaccaggccctcctcctcctcccatggacaatgcatgccctcgttatcttgaaaagcatacttccacaggctgcactcgaggagatccacaaattctcaggaacctacacctgcatgaacactttcaaagggcggacatagagacaggatgaagacatgcttgaggagccacggagtttgggggccacagcacctgggcacacacccgagcacctgtccattggcatgcttctgctgggtgagcaggacagctcctgtccccagcgaagaatccggctgcccctgggccagtcccaggacctttgcacaggactgatgggtataactgacccccacagggaggcaggaaaacagccagaagccaccttgacacttttgaacatttccagttctgtagagtttattgtcaattgcttctcaagtctaaccagcctcagcagtgtgcatagaccatttccaggagggtctgtccccagatgctctgcctcccgttccaaaacccactcatcctcagcttgcacaaactggttgaacggcaggaatgaaaaatagtcgacgcggccgcgaattta

SEQ ID NO: 668566 - DNA, 150 bp, Homo sapiens
taattgtattgagagaagacatttccattatgcacagtatggatggatggacattgctattcgccatttcttgacttagcgacacctaggaaggcgtttgaacatactttttacaaacaaagaattggtatctgtgcactacaacagtgg

SEQ ID NO: 668567 - DNA, 303 bp, Homo sapiens
  misc_feature (52)..(52): n is a, c, g, or t
gcaggagcaagggggcggcccagccacgcggcatgctgactcccacgggccnttctgtttcggcttctttctcaaaaatccattccgttttctgggggcaatcttatgggcttcttggggttgcagctgggttcagccttggggttacaggttagggtcttaaaaagcaggcagaagccttgggttagaatccaaacccagcccgagtcaccaatcaggctttcataagacctttcactctgattacgggcaactgggcttcaggcagtttcccacagagcagcagactgaggaaagagacgg

SEQ ID NO: 668568 - DNA, 459 bp, Homo sapiens
gcggccgcctactactactactgctcgaattcaagcttctaacgatgtacggggacatgcttctgctgggtgagcaggacagctcctgtccccagcgaagaatccggctgcccctgggccagtcccaggacctttgcacaggactgatgggtataactgacccccacagggaggcaggaaaacagccagaagccaccttgacacttttgaacatttccagttctgtagagtttattgtcaattgcttctcaagtctaaccagcctcagcagtgtgcatagaccatttccaggagggtctgtccccagatgctctgcctcccgttccaaaacccactcatcctcagcttgcacaaactggttgaacggcaggaatgaaaaataaagagagatggcttttgtgatttcctttgttcaaatcttccgtgggcagttgggagggagccagtcccaaccataaa

SEQ ID NO: 668569 - DNA, 1247 bp, Homo sapiens
  misc_feature (881)..(881): n is a, c, g, or t
  misc_feature (890)..(890): n is a, c, g, or t
  misc_feature (896)..(896): n is a, c, g, or t
  misc_feature (928)..(928): n is a, c, g, or t
  misc_feature (931)..(931): n is a, c, g, or t
  misc_feature (937)..(937): n is a, c, g, or t
  misc_feature (941)..(941): n is a, c, g, or t
  misc_feature (1035)..(1035): n is a, c, g, or t
  misc_feature (1051)..(1051): n is a, c, g, or t
  misc_feature (1072)..(1072): n is a, c, g, or t
  misc_feature (1094)..(1094): n is a, c, g, or t
  misc_feature (1133)..(1133): n is a, c, g, or t
  misc_feature (1139)..(1139): n is a, c, g, or t
  misc_feature (1147)..(1147): n is a, c, g, or t
  misc_feature (1170)..(1170): n is a, c, g, or t
  misc_feature (1173)..(1173): n is a, c, g, or t
  misc_feature (1192)..(1192): n is a, c, g, or t
  misc_feature (1216)..(1216): n is a, c, g, or t
gcccgcgagcggacgcggcagcgcctctgtctcgctttttcttatttttcccccctttcccctttcttttttttttttccttttcttttctcccctcccccccttaacatttgccctgcgaaggggcttccccgggaaggggcaaagggggcatacccgagttgaacatctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaaactacgatagcccttatgaaacttaagggtcgaaggtggatttagcagtaaactgagagtagagtgcttagttgaacagggccctgaagcgcgtacacaccgcccgtcaccctcctcaagtatacttcaaaggacatttaactaaaacccctacgcntttatatanaggagncaagtcgtaacatggtaagtgtactggaaagngcncttggncganccagagtgtagcttaacacaaagcacccaacttacacttaggagattcaacttaacttgaccgctctgagctaaacctagccccaaacccactncaccttactaccaggnaaaccttagccaaaccatttnccccaataaaagtataggcggnaggaattggaacctgggcgcaataggatatagttccgcnaggggnaaggtggnaaatttttaccccaagcctaatnttngcaaggggttaaccccctntacccttctgggataatgggtttnccttgggaattacttttcccaagggggggcc

SEQ ID NO: 668570 - DNA, 1256 bp, Homo sapiens
  misc_feature (890)..(890): n is a, c, g, or t
  misc_feature (899)..(899): n is a, c, g, or t
  misc_feature (905)..(905): n is a, c, g, or t
  misc_feature (937)..(937): n is a, c, g, or t
  misc_feature (940)..(940): n is a, c, g, or t
  misc_feature (946)..(946): n is a, c, g, or t
  misc_feature (950)..(950): n is a, c, g, or t
  misc_feature (1044)..(1044): n is a, c, g, or t
  misc_feature (1060)..(1060): n is a, c, g, or t
  misc_feature (1081)..(1081): n is a, c, g, or t
  misc_feature (1103)..(1103): n is a, c, g, or t
  misc_feature (1142)..(1142): n is a, c, g, or t
  misc_feature (1148)..(1148): n is a, c, g, or t
  misc_feature (1156)..(1156): n is a, c, g, or t
  misc_feature (1179)..(1179): n is a, c, g, or t
  misc_feature (1182)..(1182): n is a, c, g, or t
  misc_feature (1201)..(1201): n is a, c, g, or t
  misc_feature (1225)..(1225): n is a, c, g, or t
gacttcgagcctgcactttttactcgggcctatgcatttacccatgcgagcgggcaaagaccggagagatggacttgtagatgaccacgatctagaggggcacgcgtggcgcagcgcagcagtgccggtcacgacgcttaacctagccacgcctgcacggaccatagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaaactacgatagcccttatgaaacttaagggtcgaaggtggatttagcagtaaactgagagtagagtgcttagttgaacagggccctgaagcgcgtacacaccgcccgtcaccctcctcaagtatacttcaaaggacatttaactaaaacccctacgcntttatatanaggagncaagtcgtaacatggtaagtgtactggaaagngcncttggncganccagagtgtagcttaacacaaagcacccaacttacacttaggagattcaacttaacttgaccgctctgagctaaacctagccccaaacccactncaccttactaccaggnaaaccttagccaaaccatttnccccaataaaagtataggcggnaggaattggaacctgggcgcaataggatatagttccgcnaggggnaaggtggnaaatttttaccccaagcctaatnttngcaaggggttaaccccctntacccttctgggataatgggtttnccttgggaattacttttcccaagggggggcc

SEQ ID NO: 668571 - DNA, 116 bp, Homo sapiens
cgaggcgtacgtaggctacctataggactcccggcaggcaggctctgctggacgagaagaactaaggatgtgctgctgcaggtggatgacgagcggaggaacgcgagcagtacaag

SEQ ID NO: 668572 - DNA, 983 bp, Homo sapiens
  misc_feature (75)..(75): n is a, c, g, or t
ccggtgccatcgactactgcaaatccaaagcgtcaaccttcgccttcatggagagcctgaccctggggctgctgnactgtccgggagtcagcgccaccacagtgctgcccttccacaccagcaccgagatgttccagggcatgagagtcaggtttcccaacctctttcccccactgaagccggagacggtggcccggaggacagtggaagctgtgcagctcaaccaggccctcctcctcctcccatggacaatgcatgccctcgttatcttgaaaagcatacttccacaggctgcactcgaggagatccacaaattctcaggaacctacacctgcatgaacactttcaaagggcggacatagagacaggatgaagacatgcttgaggagccacggagtttgggggccacagcacctgggcacacacccgagcacctgtccattggcatgcttctgctgggtgagcaggacagctcctgtccccagcgaagaatccggctgcccctgggccagtcccaggacctttgcacaggactgatgggtataactgacccccacagggaggcaggaaaacagccagaagccaccttgacacttttgaacatttccagttctgtagagtttattgtcaattgcttctcaagtctaaccagcctcagcagtgtgcatagaccatttccaggagggtctgtccccagatgctctgcctccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaacactctttacgccggcttctattgacttgggttaatcgtgtgaccgcggtggctgggtcgagcggccgcgaatttagtagtagtagtagtcgc

SEQ ID NO: 668573 - DNA, 892 bp, Homo sapiens
agcgggtcctgggtcgagtcaggtcgctccctgtcgctgccggagagtctctgcttcccccttcctacgcgctccggtgtggtagctcgggctctccggaggagtggggcgacggagaaaaggagaggctgacttcattaaagtttcctgaaactaatcgaactaccaccgatagaaggcccaaggtgggcgggagacctccccattttcctccgacccctctcactagagcctgaggtgaccgttgcaagagtggtagccggcagctggtgggaccccgggtttgcgggcagtgcatgacgttgccccggcgagggaagccgtccaagggtcctgcactcgcttccggtttcgcggacatccttcgggtggtggcgggacggcaagacttggctgccctgtgggcgggttccatcctgatctaacctggcacctcacgtccgcgtcgacggctcatccccggctcttagaccacggcaagacgcgcgaggggtgcggcctgttgaggacccgctcggcacagtgagatgcggtcgtacgggccccggtcggcacgtggtgatcgctgtgttgaggcatggtgggcttcgtttccggcggttctagccgacccgggcggagggacctcctatgtgggggaaaagcccgcacaagttcagggagcgcactaagtgggcccgggggttttccccgcgcagcaagttgggttcccacggtgagaatgttgcttaagctaccccagaggtgaggggcaccccagaagggggcgggcaggtcaacaaacagggccaaagggcttggtccccacaggcagggcccggccggggacataggccgtccccattttccctttcgcggaacgtcagcagaccagagcgcagtccctaaaaag

SEQ ID NO: 668574 - DNA, 997 bp, Homo sapiens
  misc_feature (631)..(631): n is a, c, g, or t
  misc_feature (640)..(640): n is a, c, g, or t
  misc_feature (646)..(646): n is a, c, g, or t
  misc_feature (678)..(678): n is a, c, g, or t
  misc_feature (681)..(681): n is a, c, g, or t
  misc_feature (687)..(687): n is a, c, g, or t
  misc_feature (691)..(691): n is a, c, g, or t
  misc_feature (785)..(785): n is a, c, g, or t
  misc_feature (801)..(801): n is a, c, g, or t
  misc_feature (822)..(822): n is a, c, g, or t
  misc_feature (844)..(844): n is a, c, g, or t
  misc_feature (883)..(883): n is a, c, g, or t
  misc_feature (889)..(889): n is a, c, g, or t
  misc_feature (897)..(897): n is a, c, g, or t
  misc_feature (920)..(920): n is a, c, g, or t
  misc_feature (923)..(923): n is a, c, g, or t
  misc_feature (942)..(942): n is a, c, g, or t
  misc_feature (966)..(966): n is a, c, g, or t
ctcgaccggatcgtcgaattagaagcgggtaagagtgtctagatcataccctccccaataaagctaaaactcacctgagttgtaaaaaactccagttgacacaaaatagactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaaactacgatagcccttatgaaacttaagggtcgaaggtggatttagcagtaaactgagagtagagtgcttagttgaacagggccctgaagcgcgtacacaccgcccgtcaccctcctcaagtatacttcaaaggacatttaactaaaacccctacgcntttatatanaggagncaagtcgtaacatggtaagtgtactggaaagngcncttggncganccagagtgtagcttaacacaaagcacccaacttacacttaggagattcaacttaacttgaccgctctgagctaaacctagccccaaacccactncaccttactaccaggnaaaccttagccaaaccatttnccccaataaaagtataggcggnaggaattggaacctgggcgcaataggatatagttccgcnaggggnaaggtggnaaatttttaccccaagcctaatnttngcaaggggttaaccccctntacccttctgggataatgggtttnccttgggaattacttttcccaagggggggcc

SEQ ID NO: 668575 - DNA, 979 bp, Homo sapiens
  misc_feature (613)..(613): n is a, c, g, or t
  misc_feature (622)..(622): n is a, c, g, or t
  misc_feature (628)..(628): n is a, c, g, or t
  misc_feature (660)..(660): n is a, c, g, or t
  misc_feature (663)..(663): n is a, c, g, or t
  misc_feature (669)..(669): n is a, c, g, or t
  misc_feature (673)..(673): n is a, c, g, or t
  misc_feature (767)..(767): n is a, c, g, or t
  misc_feature (783)..(783): n is a, c, g, or t
  misc_feature (804)..(804): n is a, c, g, or t
  misc_feature (826)..(826): n is a, c, g, or t
  misc_feature (865)..(865): n is a, c, g, or t
  misc_feature (871)..(871): n is a, c, g, or t
  misc_feature (879)..(879): n is a, c, g, or t
  misc_feature (902)..(902): n is a, c, g, or t
  misc_feature (905)..(905): n is a, c, g, or t
  misc_feature (924)..(924): n is a, c, g, or t
  misc_feature (948)..(948): n is a, c, g, or t
ggtacgagagagttataaatcaccactacatctgcaattataggataatacacatctgagtagggagacactaccagttgacacaaaatagactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaaactacgatagcccttatgaaacttaagggtcgaaggtggatttagcagtaaactgagagtagagtgcttagttgaacagggccctgaagcgcgtacacaccgcccgtcaccctcctcaagtatacttcaaaggacatttaactaaaacccctacgcntttatatanaggagncaagtcgtaacatggtaagtgtactggaaagngcncttggncganccagagtgtagcttaacacaaagcacccaacttacacttaggagattcaacttaacttgaccgctctgagctaaacctagccccaaacccactncaccttactaccaggnaaaccttagccaaaccatttnccccaataaaagtataggcggnaggaattggaacctgggcgcaataggatatagttccgcnaggggnaaggtggnaaatttttaccccaagcctaatnttngcaaggggttaaccccctntacccttctgggataatgggtttnccttgggaattacttttcccaagggggggcc

SEQ ID NO: 668576 - DNA, 136 bp, Homo sapiens
taggttttattaattaggtggaaaatcgtatgtatcaatctgtatgcatcttgcttaatagtattaccataaaggaggtcaggtttatagggtttggttacctattaaacatcattgactatggaaatacttacta

SEQ ID NO: 668577 - DNA, 412 bp, Homo sapiens
  misc_feature (378)..(378): n is a, c, g, or t
aaaaggttgctcccggagcgcgggaattaataaagaaattcgatgaaacgctttttaatattcgtgatatgaatgcttatcatcgtggtatggtgacgttagcgtgtattccgaccgcagtattttattttttaccgctggcaatcggtaaatttaatgagctgtatcccaatattaaagtgcggattctgggaacaaggcacgaataattgcatgggaatcggtgctgtgtaacggaatcagactttgggcataaacatggaacaacgtcacaaattcatccattggattttaccccactgggtccaacggaggccgttcgtgctgggcctgtcggaggggggggggcccggttaccccaatttcggccctatagtngaggtcgtatttacaatttcactgggccgtcgtt

SEQ ID NO: 668578 - DNA, 579 bp, Homo sapiens
  misc_feature (34)..(34): n is a, c, g, or t
  misc_feature (77)..(77): n is a, c, g, or t
  misc_feature (100)..(100): n is a, c, g, or t
  misc_feature (113)..(113): n is a, c, g, or t
  misc_feature (127)..(127): n is a, c, g, or t
  misc_feature (145)..(145): n is a, c, g, or t
  misc_feature (169)..(169): n is a, c, g, or t
  misc_feature (175)..(175): n is a, c, g, or t
  misc_feature (181)..(181): n is a, c, g, or t
  misc_feature (223)..(223): n is a, c, g, or t
  misc_feature (226)..(226): n is a, c, g, or t
  misc_feature (230)..(230): n is a, c, g, or t
  misc_feature (238)..(238): n is a, c, g, or t
  misc_feature (251)..(251): n is a, c, g, or t
  misc_feature (262)..(262): n is a, c, g, or t
  misc_feature (279)..(281): n is a, c, g, or t
  misc_feature (295)..(296): n is a, c, g, or t
atataaacctgcaaagaccctgccagaagaaaangagtaccccaagaataaagtatgtcaatagggaagccccaccnaatgtcgcgaaacctgctgatgnaagtctaggctcntctataaccacggnccttcaatttcaaaagcncaaattttaattcaaatgcgatgngccatncaggancagcctgcgcatctcagcagaagcgaaaatcaccgctggaancancaanagccctancgaaatccaaagngcatacctttncagcccgagaaagcatnnntaaactcactcatnnaataatcagccagaagccaccttgacacttttgaacatttccagttctgtagagtttattgtcaattgcttctcaagtctaaccagcctcagcagtgtgcatagaccatttccaggagggtctgtccccagatgctctgcctcccgttccaaaacccactcatcctcagcttgcacaaactggttgaacggcaggaatgaaaaataaagagagatggcttttgtgatttcctttgttcaaatcttccgtgggcagttgggagggagccagtcccaaccataaa

SEQ ID NO: 668579 - DNA, 494 bp, Homo sapiens
  misc_feature (113)..(113): n is a, c, g, or t
  misc_feature (124)..(124): n is a, c, g, or t
  misc_feature (131)..(132): n is a, c, g, or t
  misc_feature (140)..(141): n is a, c, g, or t
  misc_feature (181)..(181): n is a, c, g, or t
  misc_feature (227)..(227): n is a, c, g, or t
  misc_feature (291)..(291): n is a, c, g, or t
  misc_feature (366)..(366): n is a, c, g, or t
gaaaaatgtttagacgggctcacatcaccccaataaacaaaataaggtttggtcctagcctttctattagctcttagtaagattacacatgcaagcatccccgttccagtgantgacgttcacncctctannaatcaccnnacggaattccaaggaaacggggaccaaaggccattccaanggccaacggccaggccaattggccaggcttccaagagaacgggctnttaaggccttttaaggccccacgaaacccgcgcgaacgggggggaaaaaaccaaggccaaggtnggaattttacaacgcccttttttagggccagatttagagagcgggaaaaaaaggtctattccgttaagcttactnaacccagggttggtcatttcgtgccagccacgcggtcacacctgtaatcccagcactttgggcggcggccggcggatcacctgaggtcaggagttcgagaccagcctggccagcatggcgcccctctg

SEQ ID NO: 668580 - DNA, 192 bp, Homo sapiens
gaaaaatgtttagacgggctcacatcaccccaataaacaaaataaggtttggtcctagcctttctattagctcttagtaagattacacatgcaagcatccccgttccagtgaagatacaggacattctcatcaccacagggatccccaggatgcccacttccctccacccccacaccacagccatttaggta

SEQ ID NO: 668581 - DNA, 106 bp, Homo sapiens
  misc_feature (11)..(11): n is a, c, g, or t
  misc_feature (101)..(101): n is a, c, g, or t
tcatgattggngcagaccggtgagggactaaggggatatgagaagtgagggggtgtcaaggacaagcggtgacggagatgatgctggccactggggtggtngccca

SEQ ID NO: 668582 - DNA, 227 bp, Homo sapiens
ggcacgagcatctactctaccatctttgcaggcacactcatcacagcgctaagctcgcactgatttttttaccttagttaggccttagagattaaacattgcttagcttttattccagttctaacgctaaaaaaataaaccctccgttccacagaagcttgccattcaagtatttcctcacgcagcaaccccatccatatcctctaatagctatcgcgcttcaacaa

SEQ ID NO: 668583 - DNA, 613 bp, Homo sapiens
tttttgcttgagcccccgggcccttggccgcggggcggacggcctacttctcccccctgggacgcagggcggtgatataggagcccccgcttgatgtagagagggcgctgggggtgtatgtaccccccccgggttgatgagcgtctcccctgctctcactcccactagacccgctcaccgccgataggggccgccgccaacgatctccgccggcgcaacccgctgctgggtgtagagagggatagatagagagaagatcgctccggatgaggagacgcacaccccagagcgcctagagtctccgcccggcgaaccttcctcaccacccagccatcctcacaagaggaggccggatacgtcccgataccccgggggcccccccccatatttcccccgcgggaccaggatgttgcggccgtggagcaccgaacccccgcgggcgccccgcggcgaacaccagcttctcccccccgagcatgcaccaccccggaggcgaaaaaatttctcccggacaacacaacaaaaggggggcccccggccccctccccccctcggggggggccaccttttccctggggggggtggtttttaaaaaggaaaccaattttttgga

SEQ ID NO: 668584 - DNA, 339 bp, Homo sapiens
ccagaggacatcacccatggaaaaacgcactccagcacctgagcctgagccttgtgagggtactgagctgccagcaaagagattgaggagctcagaagagcccacagagaaggaacctccaggtcagttacaggtgaaggcccagacgcttgcccggatgacagtaccgaaacagacactgacaccatacctgctgcctgaggacctggaagcccaatttttgccacgattacagccacgggtcctgtaagatacaggaccaagtgcactcacagaatcagacgacggataccactccacaaacaaccagggagcagccaacgctgcagaaacaggagc

SEQ ID NO: 668585 - DNA, 187 bp, Homo sapiens
tgagtcggtacctaatttacaggtgtgcctgtaatcccagctacttgcgaggtgagcagaagaatcactaaaacccaggaggtagaggtttcagtgagataagatggtgtcactgcactccagcctgggcaacagagagagaccctgacctcaagtgattgttccccgctaagtgattgttcccgct

SEQ ID NO: 668586 - DNA, 204 bp, Homo sapiens
tgttacttaaccgctggtggcctcagccattcatcgtataaatagggatatagtacctgctctccacaaggtggttgtgagaatattgtgagtctacacatacaaaagtgctgaggtcatgccaggtccagtaacatatacagtgaaggtgagctgctggcgttgttcaatctaactcatacaagcagatagtcagcagcaggg

SEQ ID NO: 668587 - DNA, 207 bp, Homo sapiens
ggcaccaggcgcacttctccttacctcttacaagctgtgcacatgagcgagtcactctccctcagtttcttcacaggaaagaggctagaactaaatataccaaaatgcctggcacacagtaggagctcaataaatgttagctagtataagcagcataggtaagagtgttggcaatacctactattttaatttcattggctctattga

SEQ ID NO: 668588 - DNA, 110 bp, Homo sapiens
agcagcgagagtttgctgttgcccccgcactcgatggggtaacagcggcagcttcacgatgtggaagtcttcccctcccccccagcactgcctcgatagcgggagattcc

SEQ ID NO: 668589 - DNA, 153 bp, Homo sapiens
agagtgcaatgagtgttctgctctgttgcccatgcttggactatcagtggcacgaatcgagctcattgcagccttgaactcctgggctcaacctatccatccacctcagccttccaagtagctgggataacatggtagaagccatcacatgta

SEQ ID NO: 668590 - DNA, 115 bp, Homo sapiens
agtgctcataataacgatataatggaggtcagcacgatagctcacgtgtacgactgaacttgtacagggaggcatagcaccagaatgatacaatacacgtacgaccatggagacc

SEQ ID NO: 668591 - DNA, 178 bp, Homo sapiens
catggatttgctggtgcagtacaactaggcttaatagggacatgtggcggaggttgcagtaagccaggatcgcgccgctgcgctccaccctgggcgacagagcgagaatatgtctcaaagaaagagagaaagagagagaaggagaggagggagagaggaaagagaaagagaaagaaaa

SEQ ID NO: 668592 - DNA, 219 bp, Homo sapiens
  misc_feature (157)..(157): n is a, c, g, or t
  misc_feature (187)..(187): n is a, c, g, or t
  misc_feature (211)..(212): n is a, c, g, or t
catacgcaaattaatcaatgtcatacacgacattcacaaaagaaaagtcaaaaatcatatgatcatctcaatagatgcagaaaaagcatttgacaaagtccaacatccattcatgatcaacgaccctctgcccaaagtgggtatacgagggaacacntccttgacacatgatcactagtacacttcnaggacaaacccccacatcaaaganntaatcac

SEQ ID NO: 668593 - DNA, 941 bp, Homo sapiens
gaagtgagatacttcggcggacattgcctcccaacgtgccatcggctaaacccgagtatcctataggctatccgtggaccgtgctgctggtggcctcccggggtccgttagatgggatcccaggtgtctagcattggctgaaaacttctgtgtctgccattttatgacttactgggcgacatgctagcaagcgtgcccagtaggatgagcaattctggtctcagaacgtctacgccgagaaacaagcctgaatggcctaagctactgcgaatcgctcgcgtgcacacacttgcgctgacgtcgattcgcaatatatgccggtagttgagagcctacaggttcgagccagagtacactcttcggcgatgtacccactcctatgattgcaaaaagagtgcgttctttctttctggtagtgagcctttcccatctggacttgtagagagcagggcgagataatgctcgaatgaccctacaatggcaatgaagcaggaaagagcacatggctatgacttttcctgtagactttgaaattcacgtctagtaccctagaactacttctgactggattccgtaacggcaattcagcaggaacggcttgatttcatcccaatgtagtgtgcccgttgcactatccacggagggacgttgcaaaccgtcccaaaaagtagccccatgtaaagatgacttcacccggggaacccttgatcccgtcgatcatgatcgattagttgacaaagggctttgagtaattcctgcctgcaaagtcttaccttgcacatcatagaagcgacgccacaactcaattagaagtacctaccacggaaagaacgggggatccacttccgccatcagatgctatcccagaacccgcggattgtcagttgttctggtaagcattcctatgctaagccttttcttctcaaaaagcaacaatgtac

SEQ ID NO: 668594 - DNA, 896 bp, Homo sapiens
ccccaacattctgtcttggaggctgacagcaaagaaattatctgacctaccttgtctgattggaggtcataagacccccatttcagaaggcatcctgccctgtacttgggaggaaagaagttgcacagagaggccaagaagactctgaacagagaggccttgcgtaggtttccccactcagtctgttagcattaggtcctactttgtccaatcatatttctacccggttgtccatgcttcagtcgtgacggtccagtgaagtcctggaccgggtacagagagcttccagatagctgaacacgtggagggtcctggagggtggtgcacccagggagggtatgagagctctgcaccccttcccacatgccttgttctgtgcacctcttcatctgcattctttgtgctattctttataataaaccagtacacgtgttttcctgagttctgggcacagctttagcaaattaatcaaacctaagaagggggtcatgggaacactgacttgaagctggttggccagaagttctggatgaggcctggccttacaactagtgtctgaagtgggggcagaccttgtgagactgagccctctctcagcctgtgggatctaatgctatctccaggtagatagcatgagaattgaattggattagcaagggtgctcagctggtggtatcttctgcagaactgattgcttcttgataggtggaggagaaagtccccacacaattaggtacacaagaaagtctactggtgttgactgatggtgagagtacgaagcatggtgaacaacgccaattggaatgaatactacacccaagggtgaacgagcaatgtacatggcatcacactaaatgacttaacctttcactaggaagggtatcaactgctcaaga

SEQ ID NO: 668595 - DNA, 414 bp, Homo sapiens
gcagatgctgtgggcaggaactaggcatgctttctggcaaggcactcagcagacaagaatcccttgatgtaaatcgcatgttaatttattgagtttcggtcagaagggcagcatttgcgtgacagaatgtatgtagagagttggggtgtgtggtaggcagaacgcaaggcagttgggatagttggattaagaggctagacgaggcatagaatagtatgggtatgtgtgcaatggcgggagtattaaatgatgtttcgaagtccagtgtggcagtcccgcattcagatttcatttgctgttgcgttatacgttgcgtacccaaggacattgcctcagggttgcaaactctttaaagggagatttatccatatatccgtgtattatatagaagaatgaagattgagtgtacttcga

SEQ ID NO: 668596 - DNA, 112 bp, Homo sapiens
tagaattgagctcggtacctatactattgcccctcccggcatttcatgccgggcgctactgcgctaagctcggaaaatgacctgtttaccgccccggcgctcaaaactgccg

SEQ ID NO: 668597 - DNA, 116 bp, Homo sapiens
gtcgcagctcggtagtggcaggagcgacagccatcagcagagtgagtcatccttcccaggttctcccctgggagactccctttgcaccaaggccccaccagggcctctgaccaccg

SEQ ID NO: 668598 - DNA, 295 bp, Homo sapiens
gacagacaaggtctcactatgttgcccaggctggtcttaaactcctgtactcaagcaatcctcccgcttcagcctcccaaagtgctgagattacaggtgtgagccactgtacctggcccactggatctttatttcttcatggaatcaaacgtaggttgaaaatcatctttcctaatacttgtcagtgcctcaagattgttaggataaatataaaacttccaaccaaaggatactggttgacatccagaattttaagaaaagttgtgaaataaaatatccagcttctgggtcgacg

SEQ ID NO: 668599 - DNA, 119 bp, Homo sapiens
tacttttccacaggatacagacagcaatagaattctctgtctcctacaggacaatcttcagcgagattaatagaacaacagtaacgtgccacgtctggagggatagacttaggacacat

SEQ ID NO: 668600 - DNA, 296 bp, Homo sapiens
cccgactagcccgacagggccgggtgacttgggcacctcaagattcaccactatgtcgtccacattggccaaccggtgaaacgtttatggcttcagttatatcccttcggaggacacatgacttggatggtctggaccttttcttcttatatccgggactaagaggcagccccatgcatgaccgggggacttttctcttcttaatggaagagctccggttcgccttccggaaggaggcacggctcaccatgcgcccgaggctgctgctgtcgggctagtcgggggggtaccgagct

SEQ ID NO: 668601 - DNA, 138 bp, Homo sapiens
tctgtaaagagtttagggtttgattttataaaatcccaaatgagccttttattgaatccagttttttatgtcaccagttctccagttttcatcctatgcctcaaccttgacatccttgccgggttttcctcttaaaaa

SEQ ID NO: 668602 - DNA, 130 bp, Homo sapiens
ggacttccgacgagttgtccgagttacctggtcactgttttactggtcctacattaaaatgtagatgcgtttgtctaattccactttaagatgctttaatggagcttctataactatcaactataaaatt

SEQ ID NO: 668603 - DNA, 954 bp, Homo sapiens
  misc_feature (558)..(558): n is a, c, g, or t
caccgggttctcgtgttttccccaaggttcctaaagcctgctttaacgccacgtgggtctatacccggcccggtccgtccctgtgcgccgtgcgccgcgattgcgacaaaggccctttcccagctcaaagccccttctcccacatattctaaggctccagttagatgtatgtcagtgagcggccccgataattttctctggtgaggggccttcttatatttggtgaatcttatggcgcgcccacaaggaggtgccctcggtccccccccgcccctcgggggtatgcttgtccccccacactgtggtgggaactttttcttcccactgcggatcgaaacccatcctgggtcctgtgactcccccctttaccccctttagtgggcgcccccattgggccccaaatgccccccggccgtccacgaatgtacccccaccttttttttgtcccgaagattaatataaaggcaccaatttcctcgtctccacgacgagttagtaactttaattgtctctcgcccatgaggtggaggggacacacaacaaatcggcgtgggtccnaaatggctgtattaaaccacgcgccacgtctccgcaacagctattgctcgtgacaacaaattatctccgcccgatatagtagaaacatgtcaccccccctgtattatatcatccaacagggtcccgtctctttattcgaccaccgtaaaatatctgtgtaaccattgtttcccccaaggttcagctttcagtgacccacccccgggtttttaacaagtgtattctagttttccacccacaaaatttttaaaccacattccgtgttattcctcttctcccacatcattatgtcaatggtaacatgcaaacccagatcagccccccccttttttcaaaatgggagaaaaaaaaaataattttttttaaaccacataacaaaaaaaacgaacaaaaaaa

SEQ ID NO: 668604 - DNA, 438 bp, Homo sapiens
  misc_feature (57)..(57): n is a, c, g, or t
gttttttcctaatcccccccaaagacattttaaacccccaaaaaaattgtttatggnctatatgtatatacataaccaaaacataagcaaaacatttgggggattaaaattaaaaaaaatccaattatgtttcccccaaaaaaacctgtttttgctttttgggagcaaaattgcccctgtgagactgcatgctataaggtaaggttgggcttgttaaaaacccaaaacatgattgggttccccagtttccaaaggaagagggggggctagtctgtttttattattattttaaaattgaaaaattggggtcttttttaaagttcaaaaaagggaaagcttacttttttttaattgtttatttagttgtaaacttggggattgttttttgatccccattgggggggtttttcaaaaaaatttttcatttttgcaatttta

SEQ ID NO: 668605 - DNA, 703 bp, Homo sapiens
  misc_feature (369)..(369): n is a, c, g, or t
  misc_feature (398)..(398): n is a, c, g, or t
  misc_feature (703)..(703): n is a, c, g, or t
ctcgactgtctcctgtgcctgcgttcatagagctgaggcggatgctgtgcccttctgtgtcagcacgagtgtctatgcttcagtggtctatagtatttactcctaattatgggaaaggtcctttttaatccattatttttaactctttcctaaattaatcccgacctaaagaatcttttgaagagcctgtaatggcactagaaaaaagcttactggagtcatggatgaccgtgactgcaagcaggccagctggtgtgcccgcgaccctccgtgtgactatgagagaaacactgagtcatatgaagcaccggtgggcactcggaagaccgggttccccttgtgtttcacttgcaccactcagaagagttntctcgaaaactgaccaaatcattcagganaagatgccgcctcagacttttagactagacactgataccctcatatgggtgaatgtggcgaggtaactaagaatagcttggaccaagcaaggcatgtttctgctgcgattgtggcaatgaccacaactactgggatagggccgcgcaggttcgcacaatatatcgtgcagctgtgggctctgggggaagcacactatcgctggcgggttaattatgcgttttatttttacatttgctcaggacatatggaaccttgaaagtggggtcggcctaaatatgtgacctattagcagtgcttctctgcn

SEQ ID NO: 668606 - DNA, 91 bp, Homo sapiens
  misc_feature (27)..(27): n is a, c, g, or t
  misc_feature (38)..(38): n is a, c, g, or t
  misc_feature (58)..(58): n is a, c, g, or t
ggatttgctggtgcagtacaactaggncttaatagggnacatgccacctacactcagncctgggcaacagagtgtgaccctgtctcaaaga

SEQ ID NO: 668607 - DNA, 890 bp, Homo sapiens
  misc_feature (458)..(458): n is a, c, g, or t
  misc_feature (513)..(513): n is a, c, g, or t
ttttcttggggtccccttttagtttttttggtaacaaaacaaccgtggttccccttttataaggttttaaaacgtggaccctctcatctttctcctattctccgagtgtgaacacaaacaagaaacaattaagacaaataacacgaggaacacaaaattcacaatagaagaaagtggtcaatctaccaaatagagaactccctacgaggtctctcgtggcgtgaatttctctccccgatatgtggagtgtggccgacgggccctctcaagagtctctatctctattatgaggagagaagaaacatatatatttttatacacagagtgtgtgtcatctcttatagacagcgtggcagaggagagtgtctctgtgtgcgtcaacatatatctccaacaattatacaacactgatgtgcgcccaaagagagtagacaacgcccgaagtgtgtgtgtcgtcnaaaaagagtgccgcccacttatacaacgcggcaccccagagagcgctttctctcnacaacgcccaaccctgtgtggtgtgtgaacgcttttctatatatacaaccccccaaatattttctctataacgtgttgtcattattctctctgtaatatatattataaaaccaagagagagacaaagatgtgtacgcccagcgacgaatcatcccatgtgctgtgggggccaacacatggggggcataacagccgggggctcccacattatatctccacacatatgagaagagagaacccacacggagcggtggagtaacacctccctctgagtaggagcgccccccaataatatttcaccgacgaaacaccaacggggcgaggcggaacaacaacaacgcggcattaagaaaatttttgcttaatgtggccccgat

SEQ ID NO: 668608 - DNA, 166 bp, Homo sapiens
ggcttccggtgtccgtcaccgtgctggcctggctttgcagttagctggcttccacaatgactctaaagggcaactacatgtcttactcaaatatttcttctttcctctggcaattattaattacaatgagtatttttcggggccagcagagtgtactggcgttgag

SEQ ID NO: 668609 - DNA, 993 bp, Homo sapiens
  misc_feature (166)..(166): n is a, c, g, or t
tctagtatatatactatgatgcaaaaaccaaagattccaatatagcacagagaccagtatataacaaggtcatgagacaatggtgtgggacatgcaggaggtgatgtacaaactggtgggtcagatcgtctcctctaacatgacgctacactgtcgctgaggaacncatttaataagcacttcagaactgaactgaaacgtgagaagacatgacaacttccaggcatgccttcaagcatctccctcaggagggattcgcaacacccctagactacagtgtggggaggcttacaattcttggaagcaataacaaagttacacactattgaaatcttcacagaagaatttaaaggccaaaacatagtgggttcatattctcttcacttccagggacaatctgatgctttcctcaaaccacattaagactagccagtacaaatcccaagccaaacagtgacactcctgcacgaagtccagcccaacgaagaaaagctcgataaagtccaataggactaccggtcgaagggcctgagataacccagtccaccacaggcaggcatatcaactaagcagagagagaagttacaaccaaccagggagtactaagcagaacagcaaacaagggagacgataccacacaggcgcccaagacaagggtgaaagggcagagcgaaccaacatcagttcaccgatccggcaaaacagaaagcgtcacactctcacgagggaccaagggcacacccataaatcagggaagagcctaagcaagacggacgacaaggatagacaaaacgaccctcacacacatacggccaacgggacgcggcacggacataaaaccaaacacacaacacaaggagaagacaggagccaccaaggggaacaacaaacacacaaacaacggacacacgagacgaagagaaagaaaacgagcacgcacgaaaacaagagacacgagcaagagacaacgaacacaaaacacaaacagcacaa

SEQ ID NO: 668610 - DNA, 711 bp, Homo sapiens
  misc_feature (6)..(6): n is a, c, g, or t
  misc_feature (70)..(70): n is a, c, g, or t
  misc_feature (76)..(76): n is a, c, g, or t
  misc_feature (80)..(80): n is a, c, g, or t
  misc_feature (82)..(82): n is a, c, g, or t
  misc_feature (89)..(89): n is a, c, g, or t
  misc_feature (92)..(92): n is a, c, g, or t
  misc_feature (102)..(102): n is a, c, g, or t
  misc_feature (120)..(120): n is a, c, g, or t
  misc_feature (147)..(147): n is a, c, g, or t
  misc_feature (161)..(161): n is a, c, g, or t
  misc_feature (165)..(165): n is a, c, g, or t
  misc_feature (180)..(180): n is a, c, g, or t
  misc_feature (185)..(185): n is a, c, g, or t
  misc_feature (217)..(217): n is a, c, g, or t
  misc_feature (221)..(221): n is a, c, g, or t
  misc_feature (241)..(242): n is a, c, g, or t
  misc_feature (244)..(244): n is a, c, g, or t
  misc_feature (284)..(284): n is a, c, g, or t
  misc_feature (309)..(310): n is a, c, g, or t
  misc_feature (312)..(312): n is a, c, g, or t
  misc_feature (337)..(337): n is a, c, g, or t
  misc_feature (398)..(398): n is a, c, g, or t
  misc_feature (401)..(403): n is a, c, g, or t
  misc_feature (412)..(412): n is a, c, g, or t
  misc_feature (423)..(423): n is a, c, g, or t
  misc_feature (447)..(447): n is a, c, g, or t
  misc_feature (465)..(465): n is a, c, g, or t
  misc_feature (495)..(495): n is a, c, g, or t
  misc_feature (510)..(510): n is a, c, g, or t
  misc_feature (529)..(529): n is a, c, g, or t
  misc_feature (559)..(559): n is a, c, g, or t
  misc_feature (635)..(635): n is a, c, g, or t
  misc_feature (695)..(695): n is a, c, g, or t
tggcantggctctggctctgtttttggtactggtactggcaccagtgctggctctgccgctctcttgggntttggntttngnttctgcnggngcctgggtcngggctttggcccagggtncgatatcagcttctgtgcccggtttgnggtggcccggcagngttntccgggccgggcccnttgcncattcgtgctctattctcggccctggccttgncttntgcgtgctgcctcagctgcnncnttgctaagatgccgtcgttccaatcgcgctctcgcgtatntgaggctgtcccaattccttgtggnntnctttctctttgatacctctgcaggncaaacttgaaggtacttttcatcttggctggctctcatagataagagcgcaggcccccagnagnnnctcatattnaggggggattnctattgggggactctggcatagtncaggtacttctgcttcanaaactcatcagtgatgagcttcttcacgtncccaaagagtgaatnatgtatcccagggcgcacncaaactttgcgcacaccctccccagatganagcctcactgggaccgatttccattcatgaagatgatgctaagaagcaccatgagcagacccagcttgggtgagtncttagtcgttccccagtatgcctgcatcagtgggctctaaggtgctgagaagaatgtacnagtggtcattcttatc

SEQ ID NO: 668611 - DNA, 428 bp, Homo sapiens
ttacagaggaatttcgtagattttacgcaataatgatttcttcatttgttgcctgccgtttcgacaattttcaggtaaattaaatggttgttatttttacaattatcatgagttaggattttttttttcttggaatgggtacactgagctcctcacactgcctttctggaagtggaactctgtcagaggttccttaaaaaagtgactcaatggcttctgccagtatctctctggccagctttatgacagatggccactcctgtctgcaaagaaggcttggatatgagcagtttaattagacacataagcaccccaagtagggatagtggaaaatggagtttaactagcatattgcccacagaaagactgagtgcttagcggtttttaaaaagcatgtgcatccattagtttgataaaagttaattgta

SEQ ID NO: 668612 - DNA, 175 bp, Homo sapiens
  misc_feature (104)..(104): n is a, c, g, or t
ctgatatggtactgatcgtgacttcagacagcataaatatgtgtgcatctcatgtgcatccttatagacccagcttggttcttctccaatgtctccttttgagntgtacctgattttatttccagttttcatccgaatccactggggaatgggacgatttggcttttgtttcttg

SEQ ID NO: 668613 - DNA, 132 bp, Homo sapiens
cactgcatactcatgattgacgtcgagggatagcagaacgactctctggtgggggactatgtactgctgtgtgcctatatgagctccctgtgacttgggcttgtaccgggacccaaagaaaccacaagcagt

SEQ ID NO: 668614 - DNA, 1197 bp, Homo sapiens
ccctctgtgaatgtccctgtacccattgctaagacattcagacactggacctgtaggcaggaaggcgcggacagagcgcacgcgagtcctggtcgcgcgaggagttggcaggcggacagaaacgaagcgaggaatggagcacgtcgggtgcgagtgctgtagcgagagtctccccgtgctcctaggagagacgcggtccaggtaggagctccaggtgacgcttgcgacaatggactgacggagatagccatgctgaaaggtacaaaggaagtgcccatgcttgggcctgctgtgtgcctgtttcctgcatgacctccaactgtcccacaactgtctgttgagttgactgtgcctagactcctgtgatgttgcatgctcgtgcccctggtgccccctttgtgatgcttggaccttgatctggtgctgaccatggacgatgctttcaatgacatgcacgtctgttcttgttagcatttgaaccgtgaagtgagttagttgcgatcgttacactgtgactcacaaacacactcatctgttatcccctgtgtgtctaacccctagacaaaatcgataaggttgtccctgggccactcgaaatagtaccaatcccaaagacacttacaggttaccacggtgacacaagtgcagttccaaatgaactttgaatcgacagcacctagaacctaccaattgtgattacgctgcaaagccttaaattgttgtgcccccactgtggagccccagtacgctgcacgataaccagaacatttcccatttgatcacgcccgcggattggtgcacgtggtaggtgcaacccccaatatagggtgagttacttgaccatgagaccccctgcgagttcccacgcctaaccatgcatacttccaaatgttcccccggcttttcaatcaatgtaaccgtaacctgaaacatactactggaatcccaggtaacctcaaaccacgatttgttcccccttcgcgtcggaagactatggaaaactttccttcccatccccgaccttccagatccgaatacatctgaacctttgcgttcgaaactctgcgatccttcgagacggactccctaaatacgcccaatagaaacgaggcatgaatgtgactatctagaggccacatcgaaatcattgggacctgatgaaactagtggaacccaaacacggtcgaccatagagcc

SEQ ID NO: 668615 - DNA, 671 bp, Homo sapiens
cctgcagccgcgtgctctgatcaacatgattcacaagattcggagtggcatctagaatggtgaatcctctccggaagatttgcaatagacttggtccagatctatcagaggaatcactatctagtggtagctatagcctgacaaaagtgtgttacttaaaaagtaagacttgaaagtagcaatgactccttgatccctgggctgtgcaatagatggtgtgtttagcaggcctgaaaacaacataaatcttgtacatcttgtacatctccatcttaggtgaccaggtgtattgtccatgagcaataatattttgaaaggaatattttgctctgagcagtaggtcaaaacaatgggcttaaaatatccagtaaattatgctgcaaacagacgtgctgtcacccagactttgttatttcatttctagagcacaggcagagtagatttagcataattcttaagggccctagaattttcagaatggtaaatggccattggttcaccttaaagttaccagctgcattagcccctaacaagagcattagcctgtcctttgaagtgttgaagccagacattgacttctgtctagctgtgaaagtcctagatggcatcttcttccaatgtaaggctgtttatctacattaaacgctgtgtgtatgtagcaccttatcatg

SEQ ID NO: 668616 - DNA, 83 bp, Homo sapiens
ccacgcgtccgtctagaatcgcggagcgcctctcctgcccctcgccggtacctcagcaaggtgccactagaagcgccaggctg

SEQ ID NO: 668617 - DNA, 131 bp, Homo sapiens
agagagtcctcctctttgatcctactgagcgttttcttcctgaagaagagaaacttactgaacaagagagatcaaaaagatttgaaaaggttatactcataaccgctattactcagtccaagctaaccagc

SEQ ID NO: 668618 - DNA, 949 bp, Homo sapiens
  misc_feature (268)..(268): n is a, c, g, or t
agatcgaatgacctcttcctagagtctaccgagatcctactgatgtgaaagccctaaaggtagagcatttatccatgggcaataggaagaatcgctggtccagaggatgttagagaaacctatatagttcaccatttacgaccggaagtgtgactacgggaccaaaggcatagattcttgggccatgaatgttgtaacacgttgcctctattgcattggtttctcttcgcgaaaagatatcattagtaggtggggaaaggcatagctngccatatgggtcgaaaccctcaagtcttcgggaaatatgcgtctcttgtccaatcggttttagacttgcgcgaaattagtttcggaaggctgtggtgattagacgggagtcaatgcaaggatcggatatcgtagaatttctacagtctagtaggaatgttgtctcatccatggactcgtaggggcatgtcgtggggtggacaaataatactttctatcagatgggtcgtgtcacgaagggaaaccgatgctgggatacgacattattccatgtccatgtctggaaggccgtccggtacctttctgtccccattcgtcagttcgagtagagcaataatccagagagaagtacctgtatttagagaggcattcatgcctcagcaggtgtgtgggatactttagaatgatggaaaaatgtgatgggtcatacttgggagattgaaggtagtaaatttaggtccattgtatcttgataatcatcactgtagcatgaattgcggtagtctggtaaatacttctcagtagaggaaactttccctggtgtgaacatcagttcaatatggaattataacttgcactttttttcacctttattaacgtcggtaaagagttgtggtaaaccttgttttttttagaatggtattgtagtcgggatttctggaaaaaactcttgaaaaatggg

SEQ ID NO: 668619 - DNA, 266 bp, Homo sapiens
gcttaagcccaaagtgctgggattacaggcgttagcaccggctggcagcatttcatttttcctttgggaaaggcgtttctgtagtatgtaccagtttcctctgaaataccaaatccatccacaacataccggcacagtacttgtcacttttttcagtgtaggtagcacaggtaagtttattgaattattctgaagccagaatttatttctacagtaatttctgggcaggttctaaaaaagtcatctgtgactttaggactgaagtg

SEQ ID NO: 668620 - DNA, 323 bp, Homo sapiens
ggtagtgttctggaaaacaagatcagccacatagacagcagtatgtaaagggcagcaccttgtcaacacccatctcttaatctactttatgtgtcagtgatcacggaaggcccacggtaacacatacagtatacttcacgcaaccatcatccactcaacacaagtgtctggcaaaaagtacaggcagcgagaatggaaccattcgcaaatgtgaaaaccacatatatcagcgacacatatgcagttctcaatgcagttacctaggaaatgagttttgaaatgatctgattctcatattatctctggtgtattattccagttgt

SEQ ID NO: 668621 - DNA, 1092 bp, Homo sapiens
  misc_feature (26)..(26): n is a, c, g, or t
  misc_feature (41)..(41): n is a, c, g, or t
  misc_feature (69)..(69): n is a, c, g, or t
  misc_feature (73)..(73): n is a, c, g, or t
  misc_feature (86)..(86): n is a, c, g, or t
  misc_feature (92)..(92): n is a, c, g, or t
  misc_feature (97)..(97): n is a, c, g, or t
  misc_feature (110)..(110): n is a, c, g, or t
  misc_feature (130)..(130): n is a, c, g, or t
  misc_feature (175)..(175): n is a, c, g, or t
  misc_feature (181)..(181): n is a, c, g, or t
  misc_feature (191)..(191): n is a, c, g, or t
  misc_feature (261)..(261): n is a, c, g, or t
gccagattttcagtgcccctccccanacagggatttttttntcatagagtaattatatgaacagttttnatgncctccttttggtntgaaanacttntgaacagaatttnttttttttaaaaaaaaacanagatggggtcttactatgttgcccaggctggtgtcgaactcctgngctcangcgatccttntgccttggcctcccgaagtgctgggattgcaggcataagctaccatgctgggcctgaacataatttcaanaggaggatttataaaaccattttctgtaatcaaatgattggggtcattttcccatttgccaatgtagtctcacttaaaaaaaaaaaaagaaaaagacaagtgataagtttcatctacgtggcctttactgtggggttaagtggtgattcttaaacaccttcatcagtggaactctcagagtggggtccgtttcgggtttcctgggtgggcggggtttggaaagcataagggaaagcacatttggagcatgtctggggtaccatgggtgcggatgctggggaaccagaacggtttcagaggaattctaaagctcgtgatttagatttccagagacacagctgggtgctaaaaccatgcgaagacatgacttctaggactcaagcagcaagccaggattctaggtaggctgcagggtcaccttggaagtcaagaccaaagctgggctcgaccttcacagggtcctcggaaggacaaatacttcacgaatccgggcaacccactgtgacaatactaacctacgtccgcacacaccaacacctagaaccttcgagccgaacaatcgggactatcgcgccgaaacccgacacgccgggaaaccatctggatcccccatttcactctgcaagttctgggacacaataccagcaaatcatcaattctgggaaccagaattatgggaccccacattaagaacctcgggggcggaaccagagcatcttggaaaaactaaagccagagggggacaacccggcggaaaaaacaccacaacaacaacaaacacgcggagccgccaaaaaaaaacccccaaagggcccacacacacgccgaccc

SEQ ID NO: 668622 - DNA, 186 bp, Homo sapiens
catttccacccatgtgtcggcacctccctggatgtccagccttaccaagccttcagaggacttcagccacaaatcttatcttattacatccttgtgagaccctcataaagatccaattagctgagcccaatcaacctatggaactgatagaaataaattgatgtgatgtattgtgccgctgaggga

SEQ ID NO: 668623 - DNA, 576 bp, Homo sapiens
tgttattctgaatccacacacactacacacacttgcacacagacaaaggaacacatgcacatgtatgcactcacacactcgtgtgcacagacacgtcctgcctgtgtatgccatagaggagatagcgcaaagatgcacctgccagtgatcacagagctctatctcaggggtgatgtcagctcatgaataggtcccagttcactctaattgattcatcgatgggcgtaaactctgagggtgatgggggcatcaggttacagagatgaagtcagtttagtgccatttcctatccatgggctccccagaagtaagagagaaaggaaggaaggccttttaaaagtccacattggagccagtgacttgtggctttcccttgcagaaaagaaactttggcaacagctagtagtcatcttctcctgagcccgccaatctcacagccccctccacacacacacacacacacacacacacacacacacacagagctgcagctgcagctgtgtctagctggcccccaaacagtgtagcgctgaacagaccagagatggagacactatgtgtgatcatcataaccag

SEQ ID NO: 668624 - DNA, 318 bp, Homo sapiens
  misc_feature (200)..(200): n is a, c, g, or t
gatccgtggtgcaatgtgggctttgtgtactacacgagaggaaggacctcattggagatcagggtacatgttcgcgtggcacaccatccggtgtcgctagcctgcatgcccgtgatgtgtctgccatggctcccgatgatgaatgatcatctgatgccctaggctctcatgaagctactcggtcatcggtgagctccgantagagacctgcgctttgacctacggctatctaagtattcacgcagataaatatctcacaagggggcgaccaccttgaacattcctggaggttgatgtggcatgggtgtattcaaggag

SEQ ID NO: 668625 - DNA, 1559 bp, Homo sapiens
caggagtggggcagagctggcaaggagaactccccactgaatgtttcataaaggaagcactgttggacgctactgcaaatgctactattgcacctgtgcaccgcagaacttttacagcacggatagaactacactggaaacgcaaactgagctattgtcggcagcatgacacgaccctggcagttcaaaaagactcttgcatatgacctgcttattaccacttagcacttctggctttctgacactcagccacttagctcactttgaaactgtaacgcaactggctactacaacccacattccaagctctttaacttctcttaaccaccactggccacccttttgcacactaacactgcctcttagcacttactactacttccgacacctcccaggcagctaacccaggctcgctcccaacgccaacacaaccaacactgggcaacaactgctctctaacaacacactcctggcgtggcacctctcttgcacacaagccattctttcctaacaaacacaacacacagaccctccgacaaacaagcgagacacacatggcaacccgcgctgcgccccacagagaccggcccagtggcccacacaacaccagtacattccaccgcgcctaccacagtgacaacccccctcgcgaacacaccccgcggcagccccaccacacacaccacacctgccgccacgtcgacccacatacagccaccaatcccacgcaaacatcaaaccgccggcagcaactcaccccacgagcgtcgccccacacacaacatcaaccacacacacccaccacaccgccccaaacacacacaccgccgcgaaactcctcccaacaaccacccacaccgacagccgcgcgcagctcccacaccacactctctgcgaaccaccggccgcgccacccatgaggaacgactcccacacggaaccaccccggcggagtgagataccaccaccaccaactcgttatggcaaccatgcccccaaaacgaggcggcccacatcacacaatcgatagccgccgcggacgaaagaacaccacacacacactgcgtgccctccacagcccgacgacacaacgcccctccctagcgccgcggccagccacaccaacaaccccccagtccgccacgacaccccacacgcgccgacgaccacacaaacgagcggcacgaccaaccacaacgggcagaccccacccaacaacacccagcgccgaacacacacaccagcaaggcaccaacaacatgaatcactcagacaacgagaacacatccatgggccccacaacacacacgagcgcagagacccccagtataatcgaatgaccaaccgccaccgaaccccctccacaccgcgcgccaaacccccacgcgacccacaacccacaacacctacagccacacgccgaacaccactcagcgccccgtcctgaagacccgcaccgaaacacaaccagcgcacacagcccgcagcgacagacttccaaccaagccaccaccaccagcatgagtaccaagcaccactaacgtacaccacacacaagc

SEQ ID NO: 668626 - DNA, 100 bp, Homo sapiens
ctgcgtgtgtctattagaacaccacctctcacaatttcaggcagaagctgatatcccagaaagactatatattagtttatttcaattattttttatttat

SEQ ID NO: 668627 - DNA, 188 bp, Homo sapiens
ccagcctgggcaaaaaaaaaaaattttgttttgttttttaaaaaaaaaaaaggccaaacccggtggtgggcacctgtagtcccaacaacttgggaggtttaaatgggaggattgctttagcccaggagtttaaaactgcagtgagcccctgcacttcagggtggacaacagagggagtccctgtgtca

SEQ ID NO: 668628 - DNA, 377 bp, Homo sapiens
tttgacggacggtcacggacgacacggactgtgtacggacgtgtactgatgggcccaacttcagaagcagaggttggaagagggagtgattctggccgttgggaccgagtgtgtgttgttcgatggggctctcctggtccccccaaaacacgtacccactccagcccatatgtctggaggtcagcacccaatgcaatgctggacctccgcctcgccccggagccggtgctcaatgccaacacagtgtgcctaacattgacatgtgcctgagcctgtcggcagattgaggtgtgtgtgcgttcacccttgaatgtggttggctcagccatacagtgcatccagatcgccatccacgacaatggcaatgaccaattcag

SEQ ID NO: 668629 - DNA, 174 bp, Homo sapiens
ctaccatcttctccttacaccgtaggcatgtgtttcctctatcgttaggggccatcaagtttcatcacaacaattatcaatataacaagcccccgtgtccataacccaaatgggtgatcctcctaagagtcgagcctgtcaggcactgcagagcttgcggcactgcgccagtcg

SEQ ID NO: 668630 - DNA, 382 bp, Homo sapiens
cccgtctcagctccccatgtactgggattattgacaattagccactgttctggctattataatggtcttaaaaataggaagtctctattccttttttcttttttcccattttttggaaacgggcccagcgttttccgccaaggtgagtgcagtggtgtagatctcggccctttgtaccctctgcatagtgtgtacaagagattctccctcctcagcatatttattattttctgttctctggaaaactttaataagctgtggtgtggttccccccgtaattgaaagaatacactagtgaaaccgtctttacttgagattttcttaagggaaagatttttaataatacatcccatttctttattggcttggggagctgaggagg

SEQ ID NO: 668631 - DNA, 206 bp, Homo sapiens
gggggaaaaccccccccgggggggtttttcccaaaaaaaattttttttggtttaaggggttttcccccaaagggggttaaggggttttcccccccgggggggtttttttttttgggggggggggctttcccaaaaaaaaaaaagggttttccccccctttgggggttttcccctttttttttttttttttataaatttttgcccca

SEQ ID NO: 668632 - DNA, 342 bp, Homo sapiens
acaaagagatttattttcactcacagtttcttcaggctgtacaagaagcatagggccgggcatctgatttgggtgaggcctcaggaagcttccaatcatggtagaaggagaagggagagcaggtgtatcacatggcaagagagggatcaagagagttgccaagctcttttctttttttgagatggaggtcttgctctgtcacccaggctggagtgcagtggtatgatctctgctcacttcaacctccacttcctgggctcaagtgatcctcctgcctcagcctcccgagtagctgggactataggtgcatgccatcatgcctggctaatttttggtcgacgc

SEQ ID NO: 668633 - DNA, 241 bp, Homo sapiens
  misc_feature (93)..(93): n is a, c, g, or t
  misc_feature (105)..(105): n is a, c, g, or t
  misc_feature (216)..(216): n is a, c, g, or t
aaaaaatgtaattagccaggcattggtggtgcatgcctgtaatcccagctactcgggaggctgatgcaggagaatctcttgacctggtgaggnggaggttgcagngagctgagatcatgccattgttttctagcctaggcaacaggagcaaaactccatctcaaaaaataaataattaaataaagtatggccaggcgtggcggctcctgcctgtantccctgcactttgggaggccaaagc

SEQ ID NO: 668634 - DNA, 179 bp, Homo sapiens
  misc_feature (21)..(21): n is a, c, g, or t
  misc_feature (152)..(152): n is a, c, g, or t
  misc_feature (160)..(160): n is a, c, g, or t
cgggatcctggacggctgcancaacggccgctgcgtgcgcgtccccgaagcttcacctgccgttgcttcgacggctaccgctggacatgacccgcatggcctgcgttgacatcaacgagtgtgatgaggccgaggctgcctccccgctgtgntgcaacgngcgttgcctcaacacggat

SEQ ID NO: 668635 - DNA, 930 bp, Homo sapiens
tgctcggtggagtgaagtgcctcgttgcagagacggtctcattcggtgtttttgggaagagagtcgtgtgtggcccagtgtatcgtagcggcgacacgcgagagacgggcggtgtgacagccttaccactacctgcacgagtgtattggtactgtactgctatcagctatgccgctgacccgtatgcgctgcagacccgcttggccaagagaggcatcctcaaacactcttggacgcctgaaccagacggacacgacgactcatttgccgaggaactactgaccgactgactcctggtggacctaccgacggccaccaggattggacgggcctaaccaccaagctggtacaacggtgttcgaccccatatcctgcggggcatccccatatacctactggacatgcagacacagaccctagatatcctggctctcccccacattgaacccaagctccgcagggttacccaacatcggccaagaacgctcaggaagcagtaatgcacagatgctgacagagaacgttcggaccggaggccatgacaagtcgggcacaggggccctgacaagtcggcaccgcagcccatgagcaacctcagaccagagggccacgacccaggtcccgacccgggggccacgcacaagttctgaccaggggatcgacgaccggtggcataatacacaagtcagccaccgcgagcagaggaaaacaggaacggccacccggaccacggactcacacagactaaaccaggaacacgtgaaaacgcaccgggacacacataaccagagacggcacatggcccccatttccctatacgaccacgcgccatacgcagcgatgattcaagatagaccaattaaccaaaaataatatccaagccccacaggaagtattattaaacgtctccactatctattttaccaaaga

SEQ ID NO: 668636 - DNA, 910 bp, Homo sapiens
ccggggtacaagggagagatggctttcctggacgggcgggtcgccccgggatgaacggattgaagggagagaaaggggagccgggagatgccagccttgtgatttggcatgagggcgaatgcccggtcccccaggatctccagggcccccaggccctccagggtactcctgtgtacgacagtcgagtgtgtcttgctggggtccagccggcccgggcctccaggagttgccagggaatcagggccctccaggacccaagggcgcctgaaggagaagtgggcccccgccggagcgaacagggacagtctctcgcgtatagagcttacctcgcagattcggagggctcgcagatgaacgggaggagaaggggagacccgaggctgattgcaggacgagacacaggcgagaagtgggggggagcccctgcggtgtgctggacgggtgctctttcgcgcttcgcatgccctgtcccgagtcccacccgaggtgcccctcggaggaccccgagtgggctcgcacgcgtgggactccccgaggttgacaaccgcaaggcatagagcgtaccagagggtaggggcgccgtgggccacgcacatggagacctcggccaagggagagcccaaccgcgagcaccctgggcaacacaaaagcacggcgaaacaaggaagacccccaagaataccacggagctaacacccttaccaaaacccaaacaggcgaaaccccaaccccaaagacccaaggggaaatcaccaacgggggcaaacgaatcatagctacgggactcaaccatgaagccaacacgtgaccttggaaacacaacacggcaacatgcgaggcaagaagcaaggcaccgcccggaacgcaaggaaggccaccaccgaggcacaaagccaacggggggaggacc

SEQ ID NO: 668637 - DNA, 1202 bp, Homo sapiens
agcggagtgtgccggaggaactgtgctctttgagcgccgacgctagcgggcccggaaggggaaactgcgaggccgaaggtgaccgcgggaccgacgcatttcagactctgctcggctagacctggctgcaccaccacccatgttggctgcaaggctggtgtgtctccggacactacccttctagggctccccacccagctttcacccaaggcctccccctgttgttgacagaatcccatcaccgaaaggacatccacatgggcccgtccaaaccacccccaagccaggggccaatcatgccccccgcacaccccagacactcggcgaccccggcgctggcccagcaactgcccacgaaactccaacagaccgccagccctgccaacccatcgcatgcgccaacccactatcctacccactttgccctcaggcatcggccaagcatgggtcccgctcagcgtgcgcggcgcgctcgccttgcttgggcctctgcgcaccaattgctgcctcacctcattggcccctgggcacctcgtttcaactggacgactctggacgcccttattcgcaccacaggcctgctccatttcgggccctccagcaatttgtcccacagcgaattaccacattttcatctccaaacagctcactcattgtcaactttccaaccagcgcgcagctctatcacggtttgtaaaccgacgcccttgcagccgttgcccatccacccacactcccagcccagacacccggccattggtccctcccatcgaaccctctcccattgcactccatccagcggctccctttgcgccgtgaaacacacattgggccgtcgcacccttcgccacgcccactggccccggccagcccggcaattgccatcggcaaccagatccaacatacccactatcgcacccaggacaccccaaggccccaacaccccatcctggcctgaggcagcccaacaattcctgcggctgcgcaacgggcgcaggacggaagagcactactctgacaacgcaacctacgcggcgccaacttcccaacactcgagggacacggacgaggaacaaacgccgtggaacttgcacggagaggcccacctaacacgacgagccacgagtacccgaccgcaaacacactccctgcccacacggcagaagcccacgacgagacaccacacaagaccacctgaccct

SEQ ID NO: 668638 - DNA, 1168 bp, Homo sapiens
ctcctgatcattgcctcactataacctatgtacctcctgtgctcacccggatccttcgccagcatgtggtctccgtgatgttaccatgggcgtaactacaagtgacacatgccgtaactgacaccgcaacattatatttatctgttagttcgctacgaagtcccgaggttctctacctaatgcttagtcccgaaacttgtgatcttcgaagactcattgggacctgcaatgccaagttcctcgcatgtcctcagtacttcctcaaaggctgaccagggcatttaaccacgagtagtcgtaagcgcacacaacattcccaatgttccaaataatacgatgaattctatctcctagattcacaattacgtatatccttccttatcacttatcatataaacgttgtgcatacttggctcgttatcgcgagaagatgtttcactcgcttatttcatctttagtcttacccccagtttacctttgtacgcgacgactgtgttatcttctcataatttacttttagattcgtgggttgcgagtgtcgattatggttttacgtcattaccatggtaggataatttagattgtctaccattattctctttgcactatgtagttcaaagtcccatgttagggattccacccaatcaaagacgttatctttcttgatactcctttaaaacaccattgctttttcttcctgtttaattgtgccactgggtgctggtaatggactctcatttatttctgtgagcaaaccagttttctgtatccaatgggtgacaaatttcggttcttccccacgtcacgcattagaaacctccgggacagaggacttgtctgaaatttctcactctcttaaaagtgcggcagaaaattcacctgacttattagccacaaggctttggcacgttcccttctgtgattgtaagcgcgaaagcggattggtttccccttaggcggctacacattaaggttggccccctgtggcctttttttaaggggcgtccttttccttcctaagtgcggcacaaggaattattggcgcaaaacaggaacaatttaccaaaagaattctattagttcattatcgggtttattcccaccacgcatttaagtaaacctccctattttccttcatagttttacacaccccgtggagccaacatag

SEQ ID NO: 668639 - DNA, 986 bp, Homo sapiens
  misc_feature (399)..(399): n is a, c, g, or t
agcggagtgaggggagcggtgctaagagcaggacgatgccgccggcgtcgaccaccaccgacagagatacacctctcgatcctacagggccgacggccgtgggcacttggctgcgcaggcaaggctatcggaccccgtcaggctctggacgttggctgactggtctccaggtttcttctaacctccgaggaagaagaagaataattggtcccgcttgaattctgggaagttcactctgacatgatgtctagaaatttagtggaccttatttacaatatattggacatggtctgagtctgatggcgcaatcaatgaaccgaacggagaccaaaagtacgggtacaactaatacattatgaccacgatatcaaaacctacgctatctgtctggtgcacgangtccgacttgttggactataatcatatgcataagtgcttctggtttagtgaacatggacagatttctaagttgaagtttcaacgagacgtaaccaattaggcgtgctggcatttgtctaacgcacaaactgtaattgtcgtgtgattcgacacgtcacaagtaacagtttctgacagttatggggataccatgctgcgttcaacgaacagattaccataagccatatcaacccaaaatggatacttatctacgcagggaagcgggctatagcaagatcgactatgatcgttcattatgaatatccacaacactgagggaagttccctttttggcaaaggagcttgacaagaattgcggtttaaataagaaagctatccacgcagtgcccagcgagaggtgcgctgataccacttagtaatattgaagctgttgatccgggggaaaaacctaaggggcggcatccatcaggccatacatttactaacgcaccccagttaggaattctccccagggcacagccctagaatccctgattgtcaggcaattgaccaaattcaggtcttatttatttcccatggggcggaac

SEQ ID NO: 668640 - DNA, 112 bp, Homo sapiens
atagccaacaaagaaacaaattcagaattagtctgccaagtaccctggtataagcttggaagtggattcttcccagattcttccaataagagccctgtgggtccttatcgag

SEQ ID NO: 668641 - DNA, 197 bp, Homo sapiens
tgggctcacaacctttcctccacctctgctgctgtctctcccgcccactcatgttgttcgcctctacatcccccacaacccacttgtgggtgtcgaaaccgcccgccctgatacaggcccttttgctaaaaatggtttgagctaatttctcggatgtgtcccactcctttttatgagggtcactcaatcatatacaa

SEQ ID NO: 668642 - DNA, 373 bp, Homo sapiens
agcgacgagatgtaaggcagtgttgatatatttgcagcaaacctgcatcagcatttcatgcatggcatggatttaggatataagagaaagacagaaccccgaaaaaacttcagagcctctggtctgagcacattagaagaatggacgtacttttcaccaaaattaagagcagtagattttagccggacagtccaagcaatttttcatttgatcacattttagtttgcaatatcaactagaccagcctaatagaggcatatcacatctagggctctcaagaagtaaacatggcaatcgttgctacagagatggcatttactctaaagagactggattggactgataacattgtgtgtgaaatgggaaggtggga

SEQ ID NO: 668643 - DNA, 239 bp, Homo sapiens
gatccccttatagggttgtggcaggctggtctggaactgctgaactcaggtgatcctcctgcttcagcctcccagagtgctgggattgcaggcataaccactacgctaggccaggaatttttgttattgttgtttttgtttttgtttttgagacacagtcttgctctgtgcccagaccggagtgcagtggagcaatctcggctcactgcaacctccgcctcttggattcaagtgattca

SEQ ID NO: 668644 - DNA, 153 bp, Homo sapiens
tcttggcgtgtacggaggctgtaggacggcgtgtacggaccgtgtaatacgtgttaggaggcgctcgttacggagacgcctccataacgacgcctccgtaacacgcctccgtaacgagcgcctccgtaacagccctatactccctctacatat

SEQ ID NO: 668645 - DNA, 462 bp, Homo sapiens
tacttctcgcagttataataaacagtaagggtaatttcatgatgctcaaagatgtgcctacttgcagacggaatgaagagctatgacactattgttgttttacccatttattatacctacttatgaattccagaagtgtagctctataagcttaccaatagaaaggtatttcataaataaatgaacatggaacatgaacctacatagaaaaataaaataaaatgggaaatggctaatatttgatgtcctgtattttgttctattctctcttatgaactcccaaaaccagaagcaaataagtttattaagatgccttgaaggaaacatttaggatttggaaggttaaaagaaatggcatttcaagtcaggttttggtagttccttctttagagccctttcagacaatgtttctgtattctccatgataaggagagagaaagtaagaaatcaggtagctgcttc

SEQ ID NO: 668646 - DNA, 298 bp, Homo sapiens
tacatgcctcgacctctcacaaccccgatgatcactattcatacgatggcgtcctcttccaggcccaccagcctaccccccagcatgctggtatatgcagcttgtttcccttgcaccaagctaatatgaagccaggcatccgtcctcccaaacaagcagaagctcagtaggtctcaccaggggccctagaatctttccaggaggcaaacgaggtcaacatttatagcagactccaagatatggccgtatcagcattccctcgtgccccacgtctggctactctgcgcacacacgcaga

SEQ ID NO: 668647 - DNA, 188 bp, Homo sapiens
agccgaacagtgtttattaaaaagagttaccaagtgacacaaggtgacatctgagatttgaacatgtaaatttataacagcacctatttgtggttctgttgatttttttttccaatagctcttagctgccttggtacagcaagacattcagctagtgtggggatgggctggatgagtacaaagaaaag

SEQ ID NO: 668648 - DNA, 159 bp, Homo sapiens
ttccagcccagcctgcaaggagaacagtctctagtggtcttgatggaataggggctgagggaacaatggtgaccctgaaaggggtccaggttctgtgagaagcagcattggctgtctgagggtgggtagctgagagacacacatagacgtgggtgatgg

SEQ ID NO: 668649 - DNA, 351 bp, Homo sapiens
ggtcgactactaaaaatacaaaaattagctgggcatggtggcgtgcgcctgtggtaccagctactcaggaggctgagacaggagaatcgttcaggtggtggatgttgcagtgaggcaagattgcaccactgtactccagcctgggtgacagagttagactccgtctcaaaatcctactttttcatgctcacaaaaagtgataaacaatctgttatacatctccttgtgcacatgtgggtgtctttgggatatatcccaatcaggaaacttctagaatatggtatgtgtgtgtctcgacatctctaacactgtcacattactctctggggtggttttaccagtcacctctca

SEQ ID NO: 668650 - DNA, 376 bp, Homo sapiens
ttctgattggttacctagggcaatttcaagcattatagtctaaaacttcttttactggggtcaaacctttttcccctgtgcccaaaattacgtgggtgagtcctcccaaaccccttatttcccaattttacccctcatcagggggctatggaggaattttaatttgtcccctaatcaactcccaaccaattgagcaaatagttaaggtggtcctgaaactactctccagtcccgggggcatttggaatgcatttttactttttttttgaaacccatagacctcatccttcccaagcaaacaaaatgggtccatgggccccaacctttgttttcattcagtaaaaagcacaataaaagtcccttttttgccctttta

SEQ ID NO: 668651 - DNA, 1212 bp, Homo sapiens
tctcattctggaccaagccatttaaatttggtaacttaaatggtggcaatatgaagtcagataatccttgaaaattctcaccgtggctctggttacagagtgtgaggctgagttctacacctttcagtcttcatcatcaggagggataccataattctctcatcgtgtccacgtgggaaggatcaggatacggaaaggtgacccagcaccctcttcgtgagctcagtgccaaaagcgccagaaaaactccaaaaccacagtgagctccgcgtgaaaaaacctcgcctcgggaaacaccgtgggactcgggctcagcggggggaacgggtctataccggggcccaagtggtgcacaccaccacgcggcattgagcggactccaccattctccagcagttccggtgcgcagccgcttcgtgaaaaagggggcctcacaagcgcaagcgaaagaacgccagccgagttcagaaggggacatactcgcactcccgtccgccccgggggtgggcccgggcgtggtgaaaccagggcggaaatgtggcgggcgaaggcatatataattccacaccggaatccgactgggggggtcgggggagcaagggattggtgtgtttgcaaccgggtgtggcggcaagggaggggcccggccacccaggtgtgggccagcgggatgccttggaggccggttgggttttggctgaccacttcttcccattcctcaggggaacactggggccctccgggacatccgagtcttgtcccgaaggttaacctgcgacgcggcaagggcaaggcttgtaggtccacaggggggagccccatgtgggaaccttgcacattgtcggtctgcggaattattccctcttgcatggcgaaaaactcagagggaaaaacggcaatcacaatctacggccggaaacgggtccgaggtatacaggcgccaggagagataaacgcataatcagacggcccattttaccccagtgcgcagagaacccgaacccgcacaaatcttatggagcagtgagtcacaaacgagaaaatcccacagacgggagacaacatagtggaggcactcgtgacgacagattatggctcgcgaaaacccgcaacaaagagggattcctaccgctctcttctcgcgtccctcctccgctcgcgcggccctcttcctacacaaccacagagagagagaacagcacaaaagaaaga

SEQ ID NO: 668652 - DNA, 365 bp, Homo sapiens
cgcttggggctttcgaggtgccatgggaaccagaactgcatttgaaggccaaagcaggtgtggcctctgattttgggaaagaaactgcattctttgaggctcgtggccttaccaaaataactttctcccctctccctcatgccttccgttgccttcaggcctttctactacagacaggagacggaaagcaccaagacctcaagtacatctcaccagagacgatggcggccctattgacgggcaagttcagcaacatcgaggataagattgtgattgtagactgccgatacccctatgaatatgaaggcgggcacatcaagactgcggcgaacttgcccctggaacgcaactcgaaagcccaagcg

SEQ ID NO: 668653 - DNA, 228 bp, Homo sapiens
agctctctcggttgggggacgctctccggtaccgctctctcggtggggacctctctctgtgggggaccgctctctcgggtgaccgctctctcgtgtgggggacctctctcgtgtgggggaccgctctctcgggttgaccgctctctcgtgtgggggacctctctcgtgtgggggacctgacggtgcctggaccttcagacggcgaccaggacgggtacgtgacggttt

SEQ ID NO: 668654 - DNA, 696 bp, Homo sapiens
ctctatcatagaagagcttatcaccttttatgatcacgccctctataatcattttccattatctgcattcgctatgtcctgtatgcccttttcctaacactcacaacaaaactaacataatactaacatctcagacgctcaggaaatagaaagcgtctgaactatcctgccgcgtcatcatcctagtccgtcgatctgccctctcacatcgcctacgctatcctttacataatcgaggactgaggtcaagctgatctccatcccattaccaatctaaatctagattggcatccaatggtactgaacctatcgtagatacaccagatcgtacgtgcaggactcaatctatcaactctcatacatgacttccccacattattcctagaaaccaggcgatctgcgtactcctgcatagtagtacaatcgagtagtactcccgattgaagcccccattcgtataataattacatcacaagacgtcttgcactcatgagctgtccccacattaggcttaaataacagatgcaattcccggacgtctaaaccaaatcactttcagccgctacactgaccgggggtatactacggtcaatgctctgaaatctgtggagcaaaccacagtttcatgcccatcgtcctagaattaattcccctaaaaatcttcgacatagggcccgtatttaccctatagcaccc

SEQ ID NO: 668655 - DNA, 226 bp, Homo sapiens
tcactctagactgcgtgacagagcgagactccatctctaaaccacaaaacgagagagacaacaaacaaaaaacacatggccgtctactgctgctagactcagaatgctccccaccacggtcagcagaggaggaagaggcagacatctgccagcccatccatcgccaagcccatttcaggttgagacctcctctgagttcaggggctaagaatcccgctccatggcg

SEQ ID NO: 668656 - DNA, 208 bp, Homo sapiens
aggtagcccagggtgctccacccactcccaggtagaccacaagccttcatacatctcaagtcgggggacaagaaagggcggagggggggggcacgaaggctcatcattcaaagataaaacaacataaaaaagtattaaggcgacgattaaaaaaaattttgcattacataatttacacgaaagcaatgctcatcacctccccggtgtg

SEQ ID NO: 668657 - DNA, 955 bp, Homo sapiens
gggagtaattctcttatctttgttttacccagaggactagcttctaatttgtccaaaagccacacagagttgtgtaaaaactgatcctgggagggaacctgaaaaagtccatgatgcgcagggccaatgttgcctctaaaagttctccagcaagcccaggatgcgctattgagcacgattctcccggaactccgggctccggccgtaccccgatgtatctctgagatactccttgatagataatgcctgacaattttgataggagcttccttcgcattgtttaggaatctggtagaaccctctgtggcgaactctgggggacacttggcatttgcagattcttcggccagtgatgtaccaaattgtgctggacgaacaaagagccccgtattccaggcgccggaggtagaacctcctcctcgggtgatcatgtgtcagagtagatctctcctcgcccggaccattgtcggtgataaccccgtttcaatcttctgtggccgccaccgtgaattgtgcacccagatttttaaaattgcaacttccattagatcgtgtacaaccttctacacgtgtcattatacaggtgaaactatattcagaaatgccggggatccgatgtgatagcccctcaacagagttcacgcagatagtggacagcccaggactcgaaccagaacagtgctcgtcaagtgtccctatcctacaggggtgtccccaatgttgcatgtaaaacttcccgtggggaagaacttcccaataacaaggagcgggcaaacaggcagggggcagcgacaagcccaacagaaaagtgctcccagcacacacataaaagggccaaagtgcactggggcccaaacgggggcccaaccacgcatggccagtggcgccgcacaaccacttcacggggccaccggcccccgagggagaacatgccaacccccgcgagaccccacgc

SEQ ID NO: 668658 - DNA, 909 bp, Homo sapiens
  misc_feature (8)..(8): n is a, c, g, or t
  misc_feature (129)..(129): n is a, c, g, or t
  misc_feature (137)..(137): n is a, c, g, or t
  misc_feature (198)..(199): n is a, c, g, or t
  misc_feature (228)..(228): n is a, c, g, or t
  misc_feature (232)..(233): n is a, c, g, or t
  misc_feature (244)..(245): n is a, c, g, or t
  misc_feature (263)..(263): n is a, c, g, or t
  misc_feature (267)..(268): n is a, c, g, or t
  misc_feature (277)..(277): n is a, c, g, or t
  misc_feature (286)..(286): n is a, c, g, or t
  misc_feature (292)..(292): n is a, c, g, or t
  misc_feature (303)..(303): n is a, c, g, or t
  misc_feature (308)..(308): n is a, c, g, or t
  misc_feature (338)..(338): n is a, c, g, or t
  misc_feature (361)..(361): n is a, c, g, or t
  misc_feature (374)..(374): n is a, c, g, or t
  misc_feature (378)..(379): n is a, c, g, or t
  misc_feature (383)..(383): n is a, c, g, or t
  misc_feature (402)..(402): n is a, c, g, or t
  misc_feature (419)..(419): n is a, c, g, or t
  misc_feature (436)..(436): n is a, c, g, or t
  misc_feature (467)..(467): n is a, c, g, or t
  misc_feature (496)..(496): n is a, c, g, or t
  misc_feature (503)..(503): n is a, c, g, or t
  misc_feature (557)..(557): n is a, c, g, or t
  misc_feature (566)..(566): n is a, c, g, or t
  misc_feature (587)..(587): n is a, c, g, or t
  misc_feature (595)..(595): n is a, c, g, or t
cttctctnttatgaaggggcatggcagaaaatgaaggctattgtgactaaaaggaagctctgcgagattaacaacatataactataaccttgtctccaagggagatctaagagtgcccccacaagaatntgagagantgtaataggatatgaagagaacagctgaggaccctcatttttatttatttatttatatttnnttttttttgagatatcagtgttaattggnaagnntctcatttttnntttttaacgagttattangttnntttttactnttgtttttnaatttntacaccaaganaactntgtattttgagtatatgagttaagtatggnaaaaagtaaagtaccttaaaaanttttattttagtncttnntggnccatgctaaaacttatatntagaaatacggcaaaanaaaatgaaacagatctntccttgtacataaaatagctaaaaatttggnctctttattgatcttatgttatgtatttnggttganaaaaaaacaacaacaaaacaaacagttacaagggttaaacaaactaaatttttnttctaaatntctaaatgctcatagatagcnaacttgcnggggatacacagtgccttgagagtcggtcccacagaaaatacttatgtaaatgaaacaagaaggatgctatttgtttttcattacataaacattacctgaacttaactaatcaatccacttatttgataaaaatcatctaggaccaaaagcactatcaagtttgctggctgccattttcactctaatcatacccaaaaggcttagaaataattcaaaactagaaagaggcccaagtagtaaggctacctatggctcttgctacaaaacagttgccagtctgatgtgtgtgtgtctagaaagaatgatagaaaat

SEQ ID NO: 668659 - DNA, 304 bp, Homo sapiens
cgatgagagctatgaatggagagtccctggatgggcgccaaatccgagttgatcatgcaggaaagtctgccaggggatccagagggggtgcctttggtgggcgtggtcgcagttactctagaggtggtggagaccagggatatggaagtggaagatatgacagtcgtcctggaggatatggatatgggtatgggcggtctagagactacagtggcagaagccagggtggctatgaccgctactcaggaggaaattacagagacaattatgacaacttgagattggggcatgcacacaaaatata

SEQ ID NO: 668660 - DNA, 490 bp, Homo sapiens
tgcatgatgtactgcggtgacagaacctaaatcgtatctagagtctgagttgcaagaaagtttggaaatgtcatttttagctttccagcctctgcagtagaggaacgcacacttaatggaggttgtagagtagattggctcacttatctgatgcacataatctttgctaacacaaagcttaaaattggattgtgaagccaagagtaacatgtgaaatagcaaataagagtttagcccatgaatctgaaaggagcctgtatcagtgagttgttcaaagatagattggactgccggagatcaagttatttcccatcactgaaggtattgaagtgtggaaggtggttacctggtcaggaggctctagcaaggacttctgtcccaaatatgtggtctgtcttttaagttttcttctattatgagtgtctgggtcagatactcataacaattttgtcagatttatttattaggtttttatttttccatttcaaga

SEQ ID NO: 668661 - DNA, 446 bp, Homo sapiens
  misc_feature (13)..(13): n is a, c, g, or t
  misc_feature (54)..(54): n is a, c, g, or t
  misc_feature (113)..(113): n is a, c, g, or t
  misc_feature (244)..(244): n is a, c, g, or t
  misc_feature (349)..(349): n is a, c, g, or t
  misc_feature (367)..(367): n is a, c, g, or t
  misc_feature (415)..(415): n is a, c, g, or t
tagttaatgagcnacaagagtcaaatagtcctgtgaatggagcccccatcacanaacagtgcccaggaggatggctcctcaagctaaccatgcccagcgccataaagcagcancagatgttttggaattggggtgaaacacccacagggcagcctgctagcagcagtgaatttgacttctggtcttaaagagtccctcacttcagccccaggagatattggtgggtttaagcagttttgtcttnaccgtttttagttctccttgattatttgtttttttttttttcccaataaggtttggtatgtgttgtttaaaacccatggttcctcaagtttcctttttaaacatntgcatttgctggacaaangcaattttttttaaaaaattcccctacccatgtttaaagctgaaaaanacatttggttcatgtgcaatgtttacaagag

SEQ ID NO: 668662 - DNA, 296 bp, Homo sapiens
gtagccggtctagaggatccctgcagcccatgttcagcaagcacagcattctcttgtttagatacagattctcactctgtcacacaagactagggtgcgagtgatcatccatcttggctcactacaacctccttctactaatgttaaaaccattctcctgccgttggccttccaagtagctgggactacatgtgcatgccaccacacatggataatttttatatttttcagtacaagatgaggtttcaccagtgtttggcctaggctgtatctcaagacatcctggtccgtcaagc

SEQ ID NO: 668663 - DNA, 306 bp, Homo sapiens
gacacgctggctcgtctgccggtgcgttgacttggacaaccctgtggggcccatcttccctctccccaccctttagactagcccaacatggtacagaacacaatgaaagtcttaagggccatagaggggacaagaaacaaaacaagagaaccagcacataacaaagcgaccatcccccaaatccatacctaggaacgggccctcagggacggagggtgcatcgagaggaggacgcggaatgggatgtaagaaccaggtatttacaagaacagctcgagagcgcaacaggaacgcgggcaagaccaa

SEQ ID NO: 668664 - DNA, 1632 bp, Homo sapiens
  misc_feature (562)..(562): n is a, c, g, or t
  misc_feature (987)..(987): n is a, c, g, or t
  misc_feature (1530)..(1530): n is a, c, g, or t
gattagttggggtggatgtctcactggaacagttgctccgatcgcagacatggctccctcggcttcctgccttcggaaggcgcaggaccgaacggcatagagccgcaaggtgaagcacgcgttccctacagggagtgaccgcgtgcgaagcgcgggtgccagctcacgagaccttgcctggggatagcagagggctggcgatgcagcgtccaatgatcagtgccgggcagacgctcagactgagtgcgggcatccacaggtgtacacaacggagggcagtctggtgagaccgctgtgcaccactatgtcagagacatcctatccacaatgcgtggaggatgtgaggttcactaggtgaggtcctacgcatggaaaaaccccatcgaagggacccatccgcgagaaccgtatcgtgcaacatgctacgtttatggcatggacgccgagcaaatgcaggatggagtgaaacctgtcagaagcacgtgccagtgggtcagtcacttaaaagaacactctggtggcattcgacagtaccataacttctagagggaagagcgccccntttttataaacccaacagtttcatcgttgggggccacattgaaaaactgagggcaatgggtacatgcaagggggcacttcgggtcgcgaaagtagcaaggccgaaagcctttgtggaagacaaaaggggaacacgtctttcgagcagccacgtttccactgggcagaagagaataggctccatcctagttggcaaaatgtttacatcggccgaagggttccgagttttgggcccccgaggagacagcgaagtttaatgagcgggacacggttgcctattgccgcggtcgtgttgggtcgccaagttagaccgtaggagtgccccgcaacctcttctcaatgtgagcaacgtcacttccaccaagggtgcttgcaccagcgggggaacaggggcagaatcgttgcctagagggcgccaggagaggncacacagagccgatagcggcaatcttcgatgtgtacgcaccgggccgcaaagacgagggtcctcctggcagggcccaagctaccaagagggtgaatcgctttgccttagacaacgcacaatatgcgtagattggacgtggcgaccacggtcaacttcggagggcaattcagacgtccacggagaccgttccaactaccgggcagaggatagaaccccaagagggggggcgaaagaaaggagctttacacaaaaagggggggatcaaacccacggtccggttatggaggagacaggcccagaaagaaaatagccattgacacccaagaagaaatgaaaccccccaaacccggaatgggccacttgcgagccacaagggtcttggcccttgtagcattacggcgagcagttgtgcacttccttggactgcggtaggtagagccctgtacatacttgagtggagaactggcgcattgggacagcaaaaggagtaaacacaatcaacaccgcaagttcgagcgaattccacaccagagaaagcgatntacattaagcgaattttggcgccaaagggggttaacccgctaatacacagtgacagagtggacaggcttggagtcacagacaaccacatgagcccatcacag

SEQ ID NO: 668665 - DNA, 165 bp, Homo sapiens
tggcttgtcgctcagcctcccaaagtactgaaattacaggcgtgaggccaccacatccagccttggttgattggtggtcctaatggttaattggttgggtagttttataagtcgctcatgacatgtttcctgctcgtgtatggatgctcgtgctgggtaccgagc

SEQ ID NO: 668666 - DNA, 405 bp, Homo sapiens
agacgcttgggggtcaggggttgaggtcttggagattgttttacgggggttaccaatggaggtaggattgttcctgtgggtaaaaaagtttaatggggtggtggttgtggtaaactttattagggtaggaagctgattatttattgaaggaaaggggtcagggttgattcggaaggatcctattgttgcggggcctttgattaattatgggcgttgattattagtagttactggttgaccattgttggtgggggtatatattgtatttagaattgttcgggggaataggttatgtgattaggattagggttaggatgattggaaaaaaaaaagaaaggaattaaagtttaattatccctttttgggttgaggtaataatggaggtgagaatttggcgctggaact

SEQ ID NO: 668667 - DNA, 261 bp, Homo sapiens
atgtccccctaaaatacactgtagttcatgtataaggtaacttgaggctttcaaaatggaagatgtatttttcacctgaggacattcttggctataagtggttattagggaaaatgatttcagacttcagataatgccagcaagctaaatcctcctgctctactcggatggcctgtggtattctgtctaatggtggaatacaaagatggccaaaccaatgttctgatgactgttttgattcaggcattggaagaagttatg

SEQ ID NO: 668668 - DNA, 319 bp, Homo sapiens
gttaaatatgttagatgtaataataaattgcaaagaaatgcacatactgacttttgactacaagcgtgcagactaagtacgatgactttagaaggctacagtatgtacaaatccatgagtgcaataagctttcaaatacattaggtatatatccgtttaaataaatagtagaatacttgatttgacatatgtgatagtcatactgattacaccaaaaatgttttacaaaatatagccaaaaatggaacgttatacattttgatatacaactctttaaatactttatatattcattacttacttcaaattatagtgtaca

SEQ ID NO: 668669 - DNA, 748 bp, Homo sapiens
  misc_feature (6)..(6): n is a, c, g, or t
  misc_feature (20)..(20): n is a, c, g, or t
  misc_feature (204)..(204): n is a, c, g, or t
  misc_feature (312)..(312): n is a, c, g, or t
  misc_feature (473)..(473): n is a, c, g, or t
  misc_feature (527)..(527): n is a, c, g, or t
  misc_feature (553)..(553): n is a, c, g, or t
  misc_feature (578)..(578): n is a, c, g, or t
  misc_feature (603)..(603): n is a, c, g, or t
  misc_feature (609)..(609): n is a, c, g, or t
  misc_feature (613)..(613): n is a, c, g, or t
  misc_feature (616)..(617): n is a, c, g, or t
  misc_feature (620)..(620): n is a, c, g, or t
  misc_feature (629)..(629): n is a, c, g, or t
  misc_feature (635)..(635): n is a, c, g, or t
  misc_feature (637)..(638): n is a, c, g, or t
  misc_feature (646)..(646): n is a, c, g, or t
  misc_feature (660)..(660): n is a, c, g, or t
  misc_feature (680)..(680): n is a, c, g, or t
  misc_feature (688)..(688): n is a, c, g, or t
  misc_feature (729)..(729): n is a, c, g, or t
attttnatgaactaactcanggctacatcagtacaaaatagtttaaattagtaaaataaagtagtttcaaagggaaatcattgacgacttcaggataagtgccaccaccatttgggaacagaggatagaaggtagccatgtggttattccatgatgcaggaatcaggtcggcaggtggactgtcattgctgtcttgcggcagcnggcctctgccttcagggtaccaccgtctccaggacacaaatgggcagcagaaaaatgtcaccttgttgatactcagcagctcatctattgggacaaaacttccatctnggccaagggaaatactctgttgagtgaccagcggggcccagcccccagccctatttatctcatcaatatggttcagggaagataaaaaagagtgttctatgggatagaaaggtgggaataagaaaaaactaagtggctgggcatggtgagtcacgcctgtnatcccaacactttgggaggccaaggtgggcggatcacgaggtcgagattgagancatcctggccaacacagggaaacccncgtctctacgaaaaatacaaaaatnagccgggcgtggtggtgcacacctntagtancagntanncangaggctganacaggngnntcgcttgnatacgggaggcggnggctgcagtgagccgagacngtgctgcngtgagccgagatggcaccactgcactccagcctggcgacanagggagactctgcctccag

SEQ ID NO: 668670 - DNA, 146 bp, Homo sapiens
tctcatttaacttttttaatgggttaaaattctgtgacaaaatttttggtcaagtgtttccattaaaaagtactgatttaaaactaataaccttaaactgcacaccgcaaaagaaaccaagtgtcacaaacagcgcgcgaatcgaa

SEQ ID NO: 668671 - DNA, 934 bp, Homo sapiens
ggcagttacgagaggatcccgctgggtctgctctctctgcttcaagcagtgtaagagacggaacagatccggggaaatctcatatccaggctctcgacctgacctccgatttcctctccgactatgaaaccctccggggaccaatctgcatcggccatcatccatgacttactgagggacctgccaagagagccgataacgggtgggtatcagcatccttcttgcccaaaccaaacacagtgaggctcccaaggaatgcggctcgagacaatgtgattcacaaccgacacagtgggcacaggccagcccacgtcaaaatcagccctggggtccaacattgtggtaaccctggcagggaccctccctaagcacctaaacctacttctcttgggagctttccttattttcggacccagacgactagcattgttgggccttcaatgcgtaaagtgcctggttgcagccccactttcatatcccggcgaaacttcgggcccggaagagaaatcaaagtcgcgtcaaggagcaaacgcacaacggtcatcccgtggacgcggcaatgacaaacacaccccaagacagaggggcagggcgacccgggacgcccacaccacgctctcaccaggggcaccaatatcaaaacgaaacaacgcccaaggcctggcacgcgcaagcgcaggatgagagagaaaaaccaacgcccgccgacggaacgggccccaacggaacaacagacgaggggcacaaagtgggcacccattgtgcagcaacacataaggcgtggaactacccagggcacccttttaggggcacttcttatcaattgccccctgtgtgaatctatgcaccagacagaatggacgcccccacaatcaatcaggatgcacataccctgggacaaaacataattttccttagcattgcaggcacgtcg

SEQ ID NO: 668672 - DNA, 381 bp, Homo sapiens
catgctaatgttaacacacaaccacacagtcatgttaacacacaaccacagtcatgttaacacacaaccacacagtcatgttaacacacacacacagtcatgttaacacacaaccacacagtcatgttaacacacaaacacagtcagactggtactgtatatttgtcactgctcaactaaatcaatctcagtcgaccaacaactgtgtgtgtagtggggtcagccctacaacacacagtcatattaacacacatccagacacacagtcatgttaacacacatccagacacacagtcaaggtatggagaaatgtgtctgtaccttttctgctgtcaggaagtactctttaacgagatcctccaccctcagaccctcagttga

SEQ ID NO: 668673 - DNA, 99 bp, Homo sapiens
tccactagtgtaggtatgtgtgtagtgcgtggtgtgtagtatgtgtggtgtgtagagtgtagtgtggcgtgcatttaatgactcgtacacactgtgatg

SEQ ID NO: 668674 - DNA, 117 bp, Homo sapiens
ggacgaacaacagaggtatttctcctatctaattgtaactttgtaccattgactaacctctcatattcccttccctccttctctctctcatctttgtaattgctgttcgttccattt

SEQ ID NO: 668675 - DNA, 1003 bp, Homo sapiens
cggccggatggctcgagctcgggcggtggctggcggtggccggaggcggcggtgccatcctcctctctcgccccggcgccggcgtgtgatccgagcgagctggccggagccctccgatgagactgctgtgcgggctggctgtgtcctgagcctggctgtccgtgtggctggcgcggaggatgtggacgctgcggagcccgctcacccgttccctgtacgtgaacatgattagtcggcccggggtgtggctcggctggggctcgagaggcggtgcagggaaggagaagcaccaggtggtagtgtgtgcgaaactagagcagaaattatgcagaatcactccaggtctgtctttggttcagagttaccttgatcaaggaaccagagatcttcttaaaccaacgagcattgagaaatcgggctgggtatttatccaattatatcattctttgtgtcagtcgtgttttagcctgttaatgtctagaagatctatcaatgggttgtaggaagaggtcaatgtttgtgttttcaccagatcaggtttcagagaggtgcttaggaattatgtccagagctgaaaaagccaaaagagttcttgatttaggtgctggagatggagaagtcaaaaaatcatgagccctcattttgaagagatctatgcagtgagctttctgaaacctatgatatgggaggttcgaacaatgaaatagagagtcgtgggtataagatgaatggggaactacggggttccaggtatgaatgtcatcagctgctgaattgctggaccgtgtgaatagcccctgactttgttaacggatattcgaagtgtcttggagccacatagaggcggggcatctcgccttttctccccttatccattgggacgttggggaggtgggaaaccctcaatttggatcaggcggccgggggaacacggaattgccaggtcagagcggtgtttagctccgaacacccggttggggggtaaaaccgggcggtgtcacca

SEQ ID NO: 668676 - DNA, 138 bp, Homo sapiens
  misc_feature (18)..(18): n is a, c, g, or t
  misc_feature (34)..(34): n is a, c, g, or t
  misc_feature (37)..(37): n is a, c, g, or t
  misc_feature (99)..(99): n is a, c, g, or t
gacgagaaagcgactaanagcagagggacaccanagnagtttttcttcaactctgcacactattgactctattattttctgaagcaaaaagctgtttgntagaatggaaacagaaaaacattaaaaagttcattcctt

SEQ ID NO: 668677 - DNA, 110 bp, Homo sapiens
atgggagtgcgcctagtctcgaggcgggagagccagccgccctgcagccggccgtcggccccgcagccacagaagccgagcaccgctgcggagctcccggcggcccagcc

SEQ ID NO: 668678 - DNA, 1101 bp, Homo sapiens
gctgacacggggtgcccgaggtgtctgtacactctccccagtctgcgtgcgcctcaaactcagtagcaaccagatcacggagctgtccctgtgcatagaccagtgggtgctcgtggaaactctgaacctgtcccgaaatcagctcacctcgacatgccctcagccattttgcacagctgagcaagactgaagaagctgtaccatgacttccaacgaagctggacttgtagaccgggcgtgccctctaggcattaggacaagcatcaaccgaaccttggaatgagattcatgggcgtgccaacaaagcgaaccttggagtctggatcccgtgaatcagtcctcttgctagtgtgccacaatgagctgacggaaactttgtccgtgatactacaggaacaacacctggtgacccatcgcacagatatgctcgatccaatttacgcttgtaccgggagaatcggaggttcctgagcatgatgcagggaagtacacctccaatatgcatggttcaatcgtcgcgtcccaaaagaccccagacaccgaagcgcagtgtcgcgagtgaagatgtgatacagacgattctgaaccttcgtcgacttgtcaggaaaacatgcatgtcgggcctagacggggatgcctcttccgtgctaactgtggcttagcatgtctgcagctgggatggtgggcccatagggaccctagtggcatcgcacagatgcagacgtgcgtgacgagcgcaaatggatttcacgcgccagggatgacccatggtcaaggcatggtgctgcacgggcatagtcaggatagtttgcccgaggagaacgaaccaccaaaagcaggcacgacgagcgcagattgcccgggcccacagcgggaaagggtgcggcgtagggaccaagggcctggagaaagccccgcttgactactcccgagttcttcacgggaggacgttgggccaagtgcccggactgaccatcttgggcagcattgagaacttcgtgccttttataggtggaaggaaagccttccacggaaagttctaccaaggctgactggtaccttggtgccaaaacttcctgggatacacgggggtccctcaag

SEQ ID NO: 668679 - DNA, 738 bp, Homo sapiens
cgagaacgtatctcgcggccgtggatatccactttgaaaaacaggagactattaactccatctaaaaataccgaatcaggaactggggggacccataggaaaatcctccacctctaacagagcgaagtatactggctttcggctgtgccccaagaatcccaaggcttgatgttgggaaggaattcatctgtcctctcacccttacttccccagtatcacttccaagcacataagtttcacacactatctggaagaaatgggttctgcccttgctgaacagcgtagaatgggacagctcaagtgcagtgggcagaacacaggcagccatcaactcttagaacaaaaacatgcactcaaggcaccacgctgccgttgccacgttgtgggcgccattcccacgtgcatggttgggactctgtggtctgctcagtggatgctagccaagaaccgcattaacaacgactgcggctgcccatagcgaagcccacccagccagcctgttgctaccacgcttcatgctttctgtagtcctaattatacacatcatcagccaaagcccttggtcagaaacagccctaagaggcctccttatcaagcccccatgacgagagaaaggcaacactcaatagatactcgccatctatccacactctgaaatgtaagcctctgacacgtgtgatcatcatgggaaagaatgtaagccacaattggggccttgtcatcataccattgcgtccc

SEQ ID NO: 668680 - DNA, 312 bp, Homo sapiens
caggatccagaatccccggggtttggagcataaggtttatttcaagtttcaattgaactgcctcctcttgtcaggcagggacaactgggaggatgagccccaaaagcctcaagaacccaacaaggtgcccctaaaagacccaaagacaaatgaactttgggcatccttggaggcagctgccaagcggaagctttcgggtttggagcagccccaaggagctttccaaacgagacggaaaaaaaaaaagcggcctgggtcccccagcccctgacgcccctgggccccctttgtaaataaactgttgaaccccca

SEQ ID NO: 668681 - DNA, 206 bp, Homo sapiens
gatcgagctcggtacctgttatcgatgcacgatgaacgtctttgacagacacattcttgacattgaagcccacattgtccccaggaagagcttcactcaaagcttcatggtgtatatcgatgccacttcctgatagcccctatcatcatggaagtggtagatatcagttaatcctgagttctggaaaaatacaacaaaaagggacc

SEQ ID NO: 668682 - DNA, 100 bp, Homo sapiens
atttaatggtattgtaaacagaattgtttttttaatttaatttttggtttgttaattgatagtttttagaaataaacatgatttttgcatattaattttg

SEQ ID NO: 668683 - DNA, 236 bp, Homo sapiens
  misc_feature (32)..(32): n is a, c, g, or t
tttttcccccctttttggcaaaatgggggttnacggttcattcctttatcaaagaaaaggatttacttcctttttagaataaggggaatgggtttcccccttggccctttacttgaacgggggttttgattttttttttgcctcatcagagaaggaatttggattccccatcccccccccgggataaaagtcctgccctttgtttttttgggggaataaaaggtggtttatcctta

SEQ ID NO: 668684 - DNA, 447 bp, Homo sapiens
  misc_feature (90)..(90): n is a, c, g, or t
  misc_feature (124)..(124): n is a, c, g, or t
  misc_feature (145)..(145): n is a, c, g, or t
  misc_feature (239)..(239): n is a, c, g, or t
  misc_feature (290)..(290): n is a, c, g, or t
  misc_feature (359)..(359): n is a, c, g, or t
ggatgaactttatttttatattgttgtataatttattggtaaacttaaaaaaatataaatatatgatttgattgttgttctagaaaaganttttgttacattgttagctgtttcctttagtgtntcttgctcttgttagtaattntgtatgtaactgtaataatttgtgtgacttgagaaaggtgtgttaagggtgtctttacagtgagaagggattaggtagatatttgggggccttnggcttcttcttgcttccctttctaggggatgtgatgacaggaccctgaagntgtggctctgacaggtgggatctttaaaggggacagtcccatgaaagacacacggggacaccagctcantgggagcttttgctttcccaaacaagatgtgggcagcatgactccagcctctggaacccaacaatgtatcttccacaaacttttgata

SEQ ID NO: 668685 - DNA, 343 bp, Homo sapiens
cacgtttataactcagtagtgacactctcttaccagcaggctcctgggtaatacagattcaagccttgtgattctgatgattatctttgggtcattgatggttggtgaattctccatagactgtggtcttgcagttacaaccttctgaatgagaatgcagcccattaattggaaaagaaccagaagtcattggctgatgtgtatcactcttttgatacatatgggcttgaggttgattgatgaaaaagcgaaggcttactgtattgagaaggcttagggtcactctgaaactcttctgtgtcccctgcatcttccattccatttatcaatctgtccagattct

SEQ ID NO: 668686 - DNA, 906 bp, Homo sapiens
taaggatattcaaataggaagagatgaagtcaaatgtcttgttgtagatgacatgatcctatatctagagaaccccatcgtctaggcccaaacgctgcttgagctgataagcaacttcaatagtgtctctggatataaaataaatgtacaaaaatcaccagcattcctatacaccaacgacagggaagcagagagccaagtcatgaattaactcccactcataattgctacaaggggaataaaatgcctaggaatatggctaacaagggacatgaaggacctcttcaaggagaacttacaaaccactgctcaaggaaatgagagaggacacaaacaaatggagaaacattccatgctcatggataggaagagtcaatatcttgaaaatggccttgtgccccaaggtaatttatagagtcaatgctattctcgttaaactgcactgacattcttaaacagaatggggaaaaaaattttaaaaaattccatgtggaagcaaaaaaaaaaaaaaaaaaaaaaaacaaaattgggaaagataattcctaaacatatttgaacccaccgtgtgggcggctaagggtaaccccgaatttcaacgcgtgctaccaagggtggggggttaaccaaaacacgcttggttgtgctcccagagcccgcacctttgctcatgggcacgacttgggattcgcactatattgtgcccttaacctttggtttttgcaacttggcaaacctcgctggaaatactcccattaggaaaaggggcggcggtattaaccaattggaattgaaatggcccttgttcaccataaaatatgcagatagagtaagggcggggtaaccccacaaagtggtcgtgggggtctgtcaccacccacacatgttgtttctgccaagacagagctt

SEQ ID NO: 668687 - DNA, 1175 bp, Homo sapiens
  misc_feature (344)..(344): n is a, c, g, or t
tccacggcgtaaaatattctcaagtttcccaaacagtgcaaggtgaggcagtcatcttcaaaagttcagcttctccagaagccgtggaggcaaacaaggcctcacatgtggattaggctccccgaggtctcacagtttagaggcagaagtgggtgcgtgagggggttgtgctcccgtgcagaagaaccgagaggtgacaagaggctccttctctttcacatctgctttgtagaagcctctctcacaaaaagctctctcatcacttgtgatgcgcatataacgcaattctcaagttctcacacacaacttccatcatcagataaattcgccaaatataggagacncacactatataaagagaagaacactacacgccatatcaaccaggggaatgtgtctataaccaatatctccacgagcgcctttgtgtgcactacatatctattatgtgtgaggacaaaaatctctatgtgacacaaccaccgagagaagtgagagcgcccaatctactcggagagcagacgagtggtcctcccgactgtgtgatatcaacaatatcttctttttacaaaagagcaggcgtacaaagaagatcattactccaacgacaactgtgttttctaatcataataaaagaccaaagagcaaccccccaagcgacttctattcatgtgtagtgacggtctagtcgtcttaaaactgatctatataaaacagagaaaggagaaagagacggtctcctattaaaatgatgctgtagagaagaaatatcgatgtagcgcacaggaggaaacatatttgggcgtataacatgggcgccggcacacaaagagaaaaattaaaacacagataggtgaagaaagaaacattcatggcgatagggtcaaaaatacagcagggaagaatatctacacggcgagagaacaaacagaagcagcaacatataataaacacaacaaacacacagcagtattcaacgaaacgaactcagtgggcggacagtgaggctacacgaccagcaagcggtgggactaacaaaaaaaggaatggagcaataacggacacagaaaacatctcatcacaaagactagaacgagaggccataccaccaacgcacaactaccgagcagcccccaaaagacgaatcaccattatccgaagatgcaacccacagt

SEQ ID NO: 668688 - DNA, 860 bp, Homo sapiens
ggtggactaggatctctacattcagatctgaagcttgtactgtgccataagccaaagattagtctaaatgaaattgtgcacctaccctgtcgtgatgctccatatatatttcttgtgtttctttttatatgtccccaacactttcgcgtcgccccgtgtcctatagtgttttcggtctgtaattcggcatgggtgtcgtgcggatggaaagttgatttctgtgcaatgcttgtgagcaggtctgttccctgccgtgctcttgtttgtcgcttcgatatgatgtatctggatcgagcccttgtcggtgctcattgtttttggtggaagtactacttccgttgtcttttgcttatttgttggtgccttgtgtgttctccgacttttccgaatcccactatttgactatggtgcactatagtacgttctgggcgtttccccgggattccttaagtacttgtttagtttggagttggcaatgttgtgtacattctgttacgattgtatgtccttacatcgatctagtggatctgttgttgaagtgttcttggtcgctattgctttggtttgagtgacgatgttgcatcattatatgtagcgtgctttttgcggaaagctcttggttaacgctttgctcaggcctcacgcctctctgttggtgcgggagtactgtcatcgggtgacgtgaggggacttattattcatatgtccgggcgcgaatggtccgttgtgcacccacagtttgcgcccggtgatgctgtgccgtctcgtttcccccctttggggcccctcgctctgtgccttttttacaggggtttgtacccccttttcggggtgtggggttgcccgccggggggggtttc

SEQ ID NO: 668689 - DNA, 846 bp, Homo sapiens
ctaggccaccgctggtttggcccccaaccctgtccccggcagggtgtccccccccccccccgttcttcctcccgccggggttttggtcttccactttctccgcaacgcccttttggttgcctgtctcctttacacaggggggctatgtaaaattactgggcattgttgggaaaagtgcttgtgtttcagttaagttcgccgctggggaccacctagtgcaagtgctccctgcttggacaaagtggcatacttcatggccagagcatttcctgcggggtggttaaccccggcgcgtggctttaccattcccataggagcaatacgttctcgacagtgcctccttcataaattgaaccaccgccacggtcctttggtttagggacattaaggttggcccactgatgccataaaacatgtgccagttgcaagcttcgaccacaaaagaggcgcccctttatgtattgtgaaaggttatgatacataaccacaggcgtgcgcgtgacaaagactctgcagtgaatcaatggcgattggcaaggttgactttgtctcaccttggatccccctcgaaacactggtctacttgattaacaagccctaaactaaacaaagctggccacaactgttgtaacaacaagaccccctcgtccgcctcccaaacaacaaaaatttttcacccatccccccccaacaagaggaaaggaacataaatattgtctccaccctacctgcttttagacaaccaccaccgcacccactttcattttataccttcttccatgggttcatcattacaactgcggggggcaccaaaaacaacaaaaaaaatggcgccaacataacacg

SEQ ID NO: 668690 - DNA, 208 bp, Homo sapiens
tgttggtgcatgtttggtcttctcaacataaaaaaagtcctaagagacagcaacattaaagaaaaaatgaaacaaaaccaacaaagggtataaatcatgagaaaaataatttatggttttgagtatgacttacagacaagaattagaggaagggtggtagttcctgtggtggctcagcagcaacaaacctgactagtatccagcggta

SEQ ID NO: 668691 - DNA, 1192 bp, Homo sapiens
  misc_feature (287)..(287): n is a, c, g, or t
  misc_feature (877)..(877): n is a, c, g, or t
gccttccggggcctctgaacgtgctatgtcgccgtcctatgattcactgtgccctgtcaaaaaccatgagaaaagtccagtaacgtataaaaacatctcaagagtagatgagaaaggtcagagtctccaccgagagatgtatgataatgttcgtcctcgactccacagaagtagcagtagcgatttttagcattgcagtccgcgacaagtctacgtctcatgtcatatcgaagattatggttaacactaggcacgacactcttgctacaaccttgctactgcccttntaatacaaactgcgcgaattcacggcattgatgtatatgcatcatgtatgatatcactatggagcatcgccatgccaggacttcgtatagaagtgaatgtggtcgtagcgtacgtgctgttggccatgtcgggacatcttggcacaagtgatgtggcgcatagcagcggttatgaaagctgatatgtgacatagtcgagaatggtgagacatggatgtcaggcttattgggacattcatgtgtcaatgtctggaagatgcatggaaacgtgatgttaagtaactctgacattcacatatgatatgtcacaaatgcgcttttctattgtctatcattgattgcggcatgtcctattatccttcatggaaacacactgttcccccacgtgtcggaggtgctgcatgcaaagctaagacttgatcgaacactcacgctcccgctttctaaggtgtagctgccccaaactttcatcacccatgggaactgggaatcaatgcgacttttgccattatccccgaaccgtgccatgggggcatatatgtgcgcaaaacgataataaaagcaacggttagtaattgctccgttgctancaggaatccgggcgatgttcatgaggaggaactcctcggttcgctggtccaagaattaatagttttgccgcggacatttgtgttataagagcttcggatagcataacgtatggacttaattaaaggggagggatgacgtgctctccatttcctctgacctcttcttgggcgaaagaccccttctttaataaaaacgttttcccccaattaacctagggtatcagagtcccaacgtttagggatcgcgcttcgacgacaagtataggcgcccgccataggtgttgactgcgctttggcgcccatttctattataaa

SEQ ID NO: 668692 - DNA, 402 bp, Homo sapiens
cgacgaagtatcaaacaaggagtgtgcagtgtgtgtaggaataaacacccagtcgcttgtgacatttgccccataatctacaatggatattaaaaccaacaaaagccgcacacgctggcccagaggtcgctcctttgttatcccatgctattctaattccagtcgcactgactagctatggtcacacttttttagtcaacagtaaaaaatcactggcgcccactggacatgcatgatatgcgattatcagaaaaggtaccactcccgtgtatctcagtctctgaatatagtctgttcacagacccacaagggcatgggtacaccaatacacgaagtggctgggactaaaccattgcgccttagaggctctcaataacaactacgaacccttaaaatcagcaa

SEQ ID NO: 668693 - DNA, 310 bp, Homo sapiens
  misc_feature (204)..(204): n is a, c, g, or t
  misc_feature (221)..(221): n is a, c, g, or t
  misc_feature (245)..(245): n is a, c, g, or t
  misc_feature (253)..(253): n is a, c, g, or t
  misc_feature (281)..(281): n is a, c, g, or t
  misc_feature (286)..(286): n is a, c, g, or t
taaaaatataaaatagtaggggcgaatgtgcttttagagattccaatcaaattttaggccaggagcggtggctcacacctgtgatcctaatcccagcactttgggaggccaaggtgggcggatcacttgaggtcaggagatcaacaccagccctgcggcccaacatgggtaaaaccttcaccttaaactaaaattttaaaattnggctgggcttggtggcncatgccccttaggttcccggttancccgatangggtttagggcacaggggtttgcttttnaaccnggggggagtttggggagtttttca

SEQ ID NO: 668694 - DNA, 577 bp, Homo sapiens
aatagaggatagagtggtgtcactaaatatcccacagtgacactggacagctcccatgtgacagtgttatccaacagagaagtgtcagtagtgtgcttaagtgaggaaatcctgattttatcctctgcagttttccagattattttctcatccatctcaacatcacaggggtctattgaactgaggggacaaaactgatatctaggagcaaagtgaatattctgtgcaggtgctactggccgtcattataaaaagttacggggttggaggggtggacaggtggttgaggaagaaacagtagctatatgacttctgtggcaggcagtggtgcatggttgttccgaacaagactttgggccgggcgcggtggctcacgcctccaatcccagcaccttgggaggccgaggcaggcggttcacgaggtcaagagttcgagaccagcctggccaacacggtggaaccctgcctctactaagaatacaaaaattagctgggtgtggtggtgcgtgcctgtagaatcgctcgaacccaggaggcagaagtttgcagtgagccaagatcgccccactgaactcct

SEQ ID NO: 668695 - DNA, 314 bp, Homo sapiens
  misc_feature (13)..(13): n is a, c, g, or t
  misc_feature (156)..(157): n is a, c, g, or t
cggcctgactganggttctcttacatttggattttttcatgacacccatgactatgctttggagagagtggctgcccccacgaccctggctgggaccaagaccatcagcacttctccatcaccatggctgagcccaggatgagcgtgggctggtcnngcagtaggtgaaaagggggccaaatgatactcagaatgaaagccacacgaagccacacccagtgaggctgctgcctgggccagaaggcccatgaatacctctcctaaaatggaaaaaaacgcaaacgcacacaggcggatcaatggtccaggggcag

SEQ ID NO: 668696 - DNA, 474 bp, Homo sapiens
ctccagagccatccaactaaggcaaggcatgtgacaaaggagtccagggaagatccagggctttgacctgtcacaacctcctcaccatttctttccccagtttggatgagcagccactggaagattttgctcaccacctcaactcaacaataaccccactgacccatttcataacttgtataaaaagagtaaaaagtaactctttttaagaagtcagaatataatcatttcacggtcactatcacatgattctttaaatgtttagttttttaaactatttcactttgttttgctaacaattttgcagattacatgtttgatgttgttctacatttgcaaatttaatgactggtaacatgtttatacattgtgtatttaaaatgtatcaagtatttgattttactgttttccatttttactgaatgaatgtggaatacttttaaataaaacaacgcggttaggtcagtattactc

SEQ ID NO: 668697 - DNA, 601 bp, Homo sapiens
gagtcggacagaggccgatccggaactggttgaaccatatctgatcgtctgccacgggcttcagcatcgcctcgaccatgcttcggccggccttgccgcgctgtggctgatcgatcaggtaggtagcgaaacgacgacgcaggaacaggttctggaagccctcacgcccatcggcctgtcgtctcccagctcttcgaggactggcccgcaccgtgcaacatcacgatgggcaacgtgcgcgcgttcaccggcttctggtagaaggcatagacgtgatcgccgtgatagctctggccatccggattggagggattcaacggatcgaacgtgccagactccttcttggtcgtgcccccagcgaggaagctgccttgcgaatcgatctgcagtggctcgttggccatggcggttgtggcgcagagggaaaccgctatccagagcagtgtggaggggaagctgggcacaagagtgcgaaggcgcgtacgagtctgcatgggtcactccgtgactgattgtcaggaaaatctaccctccgggccatcctggaagaggcgcgggggtgcatatgaccaatgcatggaggatatatatatgcatgtct

SEQ ID NO: 668698 - DNA, 167 bp, Homo sapiens
gaaggaagggttgggggaagggcaaactttatgggaccttggtcctggccctggcctttcactccaattttgggtgaggcaggaactgggaggggtggggagggggagggggaaagtgtctgcctttatgtccttttttttgaaataaaagtaaaagcatttttgga

SEQ ID NO: 668699 - DNA, 121 bp, Homo sapiens
ctctagacgatctttcgctgtggaggagctgagcgagtcagagttaaggctcattggtggtgctgcccttggcgctgggcagctgcacagctggggaaggagtcagcctcggggtaggtga

SEQ ID NO: 668700 - DNA, 386 bp, Homo sapiens
cccacgcccacgatcacaaccgtaacaggccactgcctactaattgccaatatttgcccctcccctttaatacaacgttttaagaagtcacattattgtgaaacttaacttcaacatatgtcctactctagctcttctgatagttctcctgagatgactgaatattaaccaaagctgcactgtgctgtacttttcagcttcaactgggaatactcttccaaggatgaaagcagctccagtccctgatggtgttcgtgccaacagcacagcggtacactccttctctaacccagtttgtcaatagtactatcgcatctgtggaaaatcttagaaaaaaacattttctcccccaccctctctcttccctgttaagaccatcccaaaat

SEQ ID NO: 668701 - DNA, 289 bp, Homo sapiens
cgagttgagttttgacgcggttacgcccccgcgagtgtctatcgttgttgcagcgctgcgagacggtgcgccggcggctgccggcggtcgagcatccgctgatcaacgcgctggcccgcgacgccagcccggcggagttgggtggccggctttcgcatgcgatcgccgaggccaccctgatcagccgcgccgaggccgcccggcgggtccacaccgccgccgacctgggcccccgcgtcgggctgaccggcgagccgatcgccccggcactggcggccaccgcggccgc

SEQ ID NO: 668702 - DNA, 220 bp, Homo sapiens
gtgatgctgaggtcgatctagagtgatcccattcagacaggtcccgcgaggtgtagaaattgcatcccaatctgtaggctgagtgaccggaaggttggacggactgccgaagtccagaaagcttcagcagtttccttagtgtcaggatctacttcaataatctcctgatccagggctgagacctcaggaacataattgtctctcctttcgctcgcctctt

SEQ ID NO: 668703 - DNA, 535 bp, Homo sapiens
gctacccaggctggagtgcattggcacaatctcagctcaccgggcctgcggctcccaggttcaagagattctcctgcctcagcctcccaagtagctgggattacaggtgccttccatcacacccggctaacttttttatttttactacagacaaggtttcaccatgttgatcaggctggtctcatctcctgacctcaggcgatccacacccccttggcctcccaaagtgctgggattatgggcgtgagctgccacgcccagcctctgtcctgcttttaagcaaacagagagaaagcagagaactcttctgcatcttaattgactttagctcaaccatcttttatattttggagaggtatatcctggtctctcacaccataaacaaccctaatgtccatcagtaaatggaacaacaaactgtggtacatccatacaatggaatactgctatgcagtgaagaggaatgaattcctgatacccacaacagcatggatgaaactcaaaataattattgccaggaaaaataatctatacc

SEQ ID NO: 668704 - DNA, 213 bp, Homo sapiens
  misc_feature (85)..(85): n is a, c, g, or t
tgcaaagctctacatgatgtgacaggttagtaaaacacacactttggtgcatatagatctattactgcttagtcagaggagatgntttcacttgtgactcctcccagtgaatgagttatacatttaacaaactaacacagtttcagtttattaagttacaatctgtaaccaccctaatgtagctcaagtgtatgggtggatactcagatataa

SEQ ID NO: 668705 - DNA, 309 bp, Homo sapiens
aaataaaaatttttaaatagaaaatgctttttctttgtaaggtaaaagaggatccatatgcttaaatgtgctcgtttttaaaattttaaagggtgatataatcagctcatgaatgcccagctatgccttttgtgatagattggacataacctcagccgttgaaaggtaaaaccattgcttttttttttttttgcctttgttaagtgactatgggactttgtgattccttaatctataaatgagtcagctccccccctgagtctctttttaaagggaaatcagtaataaagctgttaaataaggaaggga

SEQ ID NO: 668706 - DNA, 411 bp, Homo sapiens
  misc_feature (116)..(116): n is a, c, g, or t
  misc_feature (162)..(162): n is a, c, g, or t
  misc_feature (164)..(164): n is a, c, g, or t
ccgcaggaccctttggtttccgtctagtgcagcgtttaccggcctgatttcaaacgaacctattcttcaatgttcgaccacgatactgtgacagaacccatctaccactgtaatgncgcagactccaagtggtgaccacagctttcaagaatatgactaatncnttatggatgggcaaaaaggccaatgctccagcgaattggtaaaatgcaccctggacattccagtttcagtgatctttggcgcccgatcctgcatagatggcaattctggcaccagcatccagtccttacgaccacattcatatgtgaagacaattagctattcttggggcaggacattatgtatatgcagatcaaccagaagaatttcaaccagaaagtaaaggagatttggcggacactgtgggac

SEQ ID NO: 668707 - DNA, 163 bp, Homo sapiens
gaggtagtagctggtggggtctgtgaggctctgatgccgggtgatgggaggaaacgctcgagaggcgagcggtggtggtggctggctgcgccaggctgcgagagcgacaggtggaactgagtgagtatgtttgggcacccccaggccatggggctccgccacc

SEQ ID NO: 668708 - DNA, 347 bp, Homo sapiens
tctcagagaggatattcagggatgcacgattgacactgagcgaggctttactatgtctcgactgtgcaagcggtctatagatgagccagctgccaagcatgtggcgaatcagaacagattccgggaatagacatacagctgaatagtaagtatcacaccacacgtaagctttctactaccaaagattcctcacagcctgttgaggagaaggttggagctttcacagagataatagaagccatggcattcacgggacctttgaaatacagtaaatggtagattaagattgcggccctgcgcatgtatactagctgagtggagagaactgacttcgaggaattctttct

SEQ ID NO: 668709 - DNA, 809 bp, Homo sapiens
cgcttccatccacctaccacacccacattcctgacccctcccgccgatctgttgctgtggaacaggactcacagagccgcacccacttcccaagacccagccccatccctccctctctactgcctgatccccgcctggccaatctcaagtcccgccgcagttactagactctagtgccacgtaccggcagacatttggtctgagttccctacaccatatccctatacaataacgtgtgtgttgataagggcagttccagtgagctgcgaggctacatatcgctctgtctcgaccccatcaccatgcctcaactacttatacagcgtttttgcagattcgcacgcagcatttccctccccttactcttcccacggcctggcgctttaccccgcgcatgagcgtctggtcttgcgggatggtgaaagacggttgtccctgtgtggtaattgaaggagtgagtttcggggctgctgggggtacggtagctgccaggatcgatgtgctgtgtcctgtctagcatgcaggtaggatgggtgcaacgtctcagccattcgcttgcctgaaagcaccagagcccttgggcccggcggaccagatccgagctgggtccatcagcagccggagcccgactgttggagagagctcggacgaggagccggtggagtccagggcccagcggctgcggcgcaccggattgcagaaggtacagagcctccgaagggccctttcgggccggaaaggccctgcaagagccaccgtccacccggtcaaagccgctcgccttggggctggccggagcgcagaagcca

SEQ ID NO: 668710 - DNA, 350 bp, Homo sapiens
cacgagcctgcggccgcgcttttacaccaccgtgatctcgtgaaggggccccccgactggcccccgccctgaacatgcagtcgcacactgccgaggagggggatctgcgcgtgttggactacgaggaggcagcggcggcggcagaagccctggtgacctccagccccaggcccccgggccagcgctgggtttggatgaacttcgagtcgccctcgcactccccggggctgcgaagcctggcaagtaacctcttcaactggacgctctcctaccgggcggactcggacgtctttgtgccttatggctacctctaccccagaagccaccccggcgacccgccctcaggcctg

SEQ ID NO: 668711 - DNA, 126 bp, Homo sapiens
gactagaggttccagaataatagtgtacagattttaaaaaatcaatcacagcaagtgacttggttctctttgagctcctggatcacgtatgtcttgtcactctggcagtctgcgtcttcacaaaca

SEQ ID NO: 668712 - DNA, 339 bp, Homo sapiens
tgagcatgtgatctcaactctggggcaggccatggacaggtggatcatgagacaggaggttggagaccagcctgaccaacatgtgtgaacccctgtctaagcaaaaatacaaaaattagccaggcgtggtggcacacgcctataatcccagctacttgggaggctgaggcaggagaatcgcttgaacccaggaggcagagtgttgcagtgagttgagatagcactactgcactccagcctgggctgacagagtgagactctgtctcaaaaaaaacaaaagagagagggtaaccacttcttcccctaagtggcctcaggtgatctgagaaaatggtttgc

SEQ ID NO: 668713 - DNA, 200 bp, Homo sapiens
gagcggagctgctccccccggccgggcgccgcgcgccgtgctccgcgctcgtgccctcggctgctgctccgccggcgctgcctccctcgccccgtgtgtcccccttgcaacttggcgggcctcctcccttttgtccggcccggcccggccgcgccacctccgcgcccggagccgagctcccgggtctccgggccggtggc

SEQ ID NO: 668714 - DNA, 118 bp, Homo sapiens
ccacatggcacacgtggtgtctccagagctggtgacgatctgattgtatccaggaatcggcagcaggacaggtaacctgtgtgtctgccagctcacgactcacgcgcacgttcccctc

SEQ ID NO: 668715 - DNA, 476 bp, Homo sapiens
tcctgcaaagtcgatctctagaggatacccctgtgacacaggatctgatggttttatcaggagtttccgcttttgcatcttcctcattttctcttgccaccaccatgtaagaagtgacttttgactcctgccatgattctgaggcctcccaagccatgtggaactgtaagttcaattaaacttctttttcttcccagtctcgggtatgtctgtatcagcagcatgaaaacggactaataacagtaaattggtaccaggagtgagatgttgctgaaatgagacccaaaaatgtggaagcaactttggaactgggtatcaggcagaggctggaagagtttggagggctcagaagaagacaggaaaatgtaggacagtttggaaccacctagagacttgttgaatggctttggcaaaaaagctgatagtgatatgaacaataaggttcagactgaggtggtctcagatggacatgagga

SEQ ID NO: 668716 - DNA, 223 bp, Homo sapiens
ccgcaggtcaccgtctctacacagaaattttacaaatcgggcggacgtgatggcgggcgcctgtgtgtccagctgccggggaggctgaggtgggaggatcgcttgatagcccgggaagttgacggtgcagagatccctccactgaactccaggccgggtgacagcagggcgagatcctgtctcaaaaaaaaacataaccgacatccagaagtgcgcctgggta

SEQ ID NO: 668717 - DNA, 159 bp, Homo sapiens
gataaagctgtgaggcaggatagtctgagtctgcctctaaaggagtagccaagactcctgggtctctgcatttttctttttcttgagacagggtctcgctctctcacccaggttggagtgcagtggcacgatcctagctcactgcagcttcaagcctcc

SEQ ID NO: 668718 - DNA, 138 bp, Homo sapiens
aatggctggcccgcctagcatataggacattggaaacagtataattgacaaagaaaaatgatacttctcttttttgctgttccaccaaatacaattcgatgcttttgttttatttttttaccaattccaatttcaaaa

SEQ ID NO: 668719 - DNA, 326 bp, Homo sapiens
tgtatcatcaataaggaagggtccccagcgttggggacgagccccaagttgaaaatagtaagtgaacaattgttgtactgaaccacttagttacatactgctagatcataaacaacctgtgtgtaatatgtattcccctacaaacgtagcacccttcagcaggaccctataaaactttcctccagcccttgcctctttgcaggtagccccttctccgctgagctgcccactgcaacatattttcacattttctctaataaatctgcccttctttacctacaactatcttggtaaatggctttaccacctgcaaaactgaccctagg

SEQ ID NO: 668720 - DNA, 612 bp, Homo sapiens
  misc_feature (89)..(90): n is a, c, g, or t
  misc_feature (93)..(94): n is a, c, g, or t
ctctctggtcggtttgttgtgtcctcgttctcttcgacgggttggctgccgctctctctgagggggtggcgtgctgctctctccgaggnntgnnatgcgcgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagccgcttcagcttctagcatgttaaacggccaaggacgggccacacgtggctgcggcctcgttccatggcggcacgtccttgggcgtctctaatgttgcagctaagggctggcacttttttaaatataataaatgggtgttatttttatttttttattgtgaaagaagctttggtcttcatgtggacacatgccaagtgatcatcgtgatgcgctgtctcgatcaatagatcaggcctctacaagcaggcacgactatcctcactagacggg

SEQ ID NO: 668721 - DNA, 237 bp, Homo sapiens
ctctggtattttagtagagacggggttctccagtgtgggtcagcgtcttgactcctgacctcaggtgatccacccgcctcagtctcccaaagtgctgggattacagggtgtgagccagcacaccctgctggaaagcattctttttggctgtatctgttgtttttaaactagttttgaacattataaaagttacacatatacattataaaaatatcttcaagaggcacagattgcagt

SEQ ID NO: 668722 - DNA, 648 bp, Homo sapiens
taaaagacggttaaaaaggtttttaaaaaggggggagggggttttagggcccctttttacaaaaaaacctccacaattttttaaaccaaattaaacccctagttaacccaaaaaaaaaaaaaaaaaaaaaaaaagggggggcgcgccgccacaaatacccccctggggcgcgccgaagttatgtactgctcacccagctttgtttggcacaaaagggggcgcccctaaaggggacgtctaatctaatatacagcacaaggagagcggcggggcgcggcaattaacaacaaggcgtcggcgagcgtggagaacaaacgtcatacgctgggagacctcggcgagagaaaagagacaacccctactctcgcgggggggggagcaccatagtgtgccaacaacaccacccaccaggagagaattaaaaacccaacaccgggaggaaaaaattaacaaccttgtcaacaggcggcaaatagggggggtaacccaaacacggcgtaaacaaagactcgggaggagcaacaaaaaattgtggacaacaaggagagataacattatagacgaaaaactattcatcaacccacggagcatcttagtagtaacaaactagacgagaacacaacacaataaccacaagaaacaaaacag

SEQ ID NO: 668723 - DNA, 146 bp, Homo sapiens
agaatcttgcatgtcacctaaatcgaaagccaatcctgagatcatagaagcatagactggctgccagaacttcaaagaaagaaagaacactgattaccttaaatatataattgtatacagtatgtagcacaccttttggctaggtg

SEQ ID NO: 668724 - DNA, 130 bp, Homo sapiens
atctagaggaccccagcgctcgcagtagtacaggtctgtgccagtgccctcccaggatgaccccttgcatcctctcaataagcttcagtgaggcagtggaggagtattcactacccacctgagactgcaa

SEQ ID NO: 668725 - DNA, 1035 bp, Homo sapiens
cactatcccacatcaattggcttacccgttgctgtcataccatctattgctctgacacagttctccaaatgatccgtcagggaaatgatcgatgaagaggagttgctgctctggggggaatcctgaccagcctggtgaggccctgttgcaggaagtgtatatgctcccaacatatcagttataccttgatgtctcttgcttcacccagtgagtgcttggctcgctctgtgaactgataatgaaaaggctgaagtctagctatggtgtctagtatatggctatggcaaggggctagaatgaatagactagatccacatcgaatgcacctgggggagtgctcgatgttcgcgttctataggagacgattgacgtgtcacgatttcagcttctccagttgtgcgcatctcgccgtctaagctagttggagcttacaatctggtaccctgcttgcctgtacttagcatggcaagtgtctattgcgcacctctgtgtattcaatgctgggtgtcactcgtgtaggtgtccacaataggtgtgtggtgacgtccggagcaccacgtcatatcctcacgcgctgcatcaaccgcgtccttgagcattcatctcctctgtggcaacttcttgaaaaggtctcccatttccctgctgccctctgtacgcacccatgttgtccctccctcaggggattggggtattgatgccgatatggctccaagtggccacggacgctgcagaacttgcctgctctcccaagacgcccgggagtggagtcgtcatgttgtctcgtgccgtactgaatagggtggcccaatccgatgctctcctatccctggcacagttactggctgccttgccgcgacgagtttgatggccggcgcacgggcgttcctggcgatggccccgtttctccttttcctctccgtccttgcgggtcccgcaaaccctgccgctgtttccttagcggccggcctccggttttccttttccgcgtgggggcacgcggaccctccgtgggggagctgctccaaggcgccg

SEQ ID NO: 668726 - DNA, 346 bp, Homo sapiens
ttcattagcaaatggcagtggaaaaggagagaccacctagtggaggggtgaggagagggcagtggaaaaggagagaccacctagtggaggggtgaggagagggcagtggaaaaggagagaccacctagtggaggggagggcggtggaaaaggagagaccacctagtgggggggtgaggagagggcagtggaaaaggagagaccacctagtggaggggtgaggagagggcggtggaaaaggagagaccatctagtggaggggtgaggagagggcggtggaaaaggagagaccacctagtggaggggtgaggagagggcggtggaaaaggagagaccacctagtggag

SEQ ID NO: 668727 - DNA, 162 bp, Homo sapiens
ggtaccggattgggattaggtaggtatgactaagagagaggaggaagtgcacattactcagttgtgaagtacaatttatagatgttaaatagaaaagaagggttttgtttagatgaagggaagatattgagtaatcgggatgaactacctatttcacactcg

SEQ ID NO: 668728 - DNA, 465 bp, Homo sapiens
gtaggggcgcggcatgtcaagtgtgtggacagaagatccgtgaggacagcgttaggacgagagcctgtattaggcgagaactagcttgagatctcccagagtgccagggataagcagatggaggtgtgagtgggaggtgcatagaccgaggagaagaggtagtagagtcaggctggagataggagccaagtcccttgagcctcatgtactaaatcaggggtctgagtactgtactaaatggggagaacctttaaggagatataacaaagaagtttccatgattgctgttgtaaagaagaatcctttggctgtagtgtggatcactgtctttagcaaggaaggaagcagagctcacactggaaggctgctgacatgtccatgggatactcagccatgggcatgagactggagagccatggtcaggttggaatctgccttgctgataggtgtagggggggtccgagc

SEQ ID NO: 668729 - DNA, 121 bp, Homo sapiens
tcatattccttcatttagtatttattgaatgtctactatgtgcaaggcactcacccatgggcctggacagaccacatggcaaggtacacaagcaatccatttagagccccattccgaatat

SEQ ID NO: 668730 - DNA, 930 bp, Homo sapiens
caagctttgatatgctttgcgctgccgtgcagcaaccgacgagcgcagcgtctagagagtcgagtaagcggtttcgcataatttcgatatagcactagcatatacgacggttctcaagtcgacggtactggcacatttcctctccagatcggccattagagaacgggcgtatggagtgatatgacatgtctatataattctctaaatgccgactttaattaccgagcagctgagctccctgctgttgctgagttctccaccagcgagatcatgggtcagttctgcagatcgactggccgtcgttatacatggtctcgggtggatcaggatgtactatgcactgcgctctcacagctctagccgagaatgtgacaggatgaggcgactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggatttatgtatgtgtctcaggatccaaaagatcaactattacttggaccaacatatgctactccaaaaagttctagaaaggcaggattgaccattgaatgatatgtgatgcttttgaattttcatgaagcttctctcgggtcagactttggcaattttaaagccatggattctgattggtttgcagaaaaactacatggggtagaaacaaccacaggttggattgcccccttggagaagtttaatacactggggtggatctctgtcctggaacacctttggagcctggctgggtggtctggtgcgcca

SEQ ID NO: 668731 - DNA, 1530 bp, Homo sapiens
ggggacaacaatacggggaatgtggggccgcctaatatggagcctaagtagttaccacaacacaggcgcggcttccttctcacacacaggttgagtagtagttaagaccccccatgggccgggtctctataaagaggaaattcatgggagaccagtgattaaagcgccgtcgttgccacaagagggaccgacttggcttaacacacagggggttccatattggcccgcgcaaaatgctccgcctccggtatagatatatacttgtggagggggactttttttttacgaccacaacagctagttgaccccacacgggtgttcttgggaggggcccctcggtgaatatttgttgaggcattataactgaatagggcgcgagtctttcctccccggcgaaagatttataatgtggaggagagaccaccacacttgttatacatagccccttttggtgggggaaaatttatctttggggcaaacagaacctgtgtccgacgattggtccgcccaacgacgggggcgttgtccgcgggattttttgtgccgacgaaggggattgtgaactctcgagggactaattggttgtgttagaagaaaaaagcggtcttctcgttcgggggcgaacctgcgtgagtttgatttcgcgagacgtctcccagtgttgaatcccgcgcgcttgatatgaggccggtttggtgtttccccgccgcgcagaaccaacgagtatggtggggacacgactcgccgggttttgaaagtaccaacacgcatttcacataaggcgtctgcacgtgctagagtattgtgtgaggggcagaacgataaggggaaacctcggggacacaagggtgggcctgcgcaagaagaagatgtttgttgtcgcccaaacacacaagcatgggccgcgcgattgagcgaacagagcaacagagggggagtcttccacacccctggcgacgggccccggggcccacttctctgtgcgagaatgggggcaccacataaacacatcccggcgggagaacagttactccccggacaccgtgggtaaagaattgctgccaaaaaagttgcggtccacaagccgtccgtctagacccagagggtcctaaataacttgcccgggaacacactgggggggatacagaggatagcgcacctataccacacgcggggggcccaaaggatgaatgtccccaggtctggaatagcgtgtaacctgcggctgcgcccccacatgcaacgagctaatctgggccccacgagaatctcccaaagtttttgaccctgtagaagagagaagggaatttggggtttcttgaaatctgggaccaaaaagtccctgcggttcaggcagcaattagcccatctgtgccctgctgaggggctggcgtgccttgagatggccgtgatgttccacaaccctttttggaaaaaaaggtctttttgtttcagggtccacccgagtcaccttttttgttttaaagttcaccgtccacagctttgggaaaaaccatcctggggaattta

SEQ ID NO: 668732 - DNA, 293 bp, Homo sapiens
ctgaataatctgacgggtcgcctcatgctggctgtgagaagagcagtgctagcgctcccatgaagataaggctacaacactggagtcatcaatgccccccagaaggtgagtactgtgccctcgttggcttatgaacaccagcctgctctgttgcacctcacacatgcccacagtctcacgccaccacctgaacttacgagtcctttatatgaccgcactgtactgtctgcctctccagccagtgttctggccctgttcatgtcagagcctcttctcttgctttggaatcaggg

SEQ ID NO: 668733 - DNA, 1334 bp, Homo sapiens
gagagccgaggtctgggctgcagtaggtcccggcaaccgcaggctcgcggcgggcgctgggcgcgggatccgactctagtcgtaatggaggcgggcggctttctggactcgctcatttacggagcatgcgtggtcttcacccttggcatgttctccgccggcctctcggacctcaggcacatgcgaatgacccggagtgtggacaacgtccagttcctgccctttctcaccacggaagtcaacaacctgggctggctgagttatggggctttgaagggagacgggatcctcatcgtcgtcaacacagtgggtgctgcgcttcagaccctgtatatcttggcatatctgcattactgccctcggaagcgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttttttaattttggaggttggggtgcaatctttagaatatgccttaaaaggccgggcgcggtggctcacgcctgtaatcccagcactttgggaggccaaggtgggcggatcgcctgaggtcaggagttcaagaccaacctgactaacatggtgaaaccccatctctactaaaaatacaaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaataaagtgttccccacccctgccaaaaaaaaaaaa

SEQ ID NO: 668734 - DNA, 1210 bp, Homo sapiens
gagagccgaggtctgggctgcagtaggtcccggcaaccgcaggctcgcggcgggcgctgggcgcgggatccgactctagtcgtaatggaggcgggcggctttctggactcgctcatttacggagcatgcgtggtcttcacccttggcatgttctccgccggcctctcggacctcaggcacatgcgaatgacccggagtgtggacaacgtccagttcctgccctttctcaccacggaagtcaacgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttttttaattttggaggttggggtgcaatctttagaatatgccttaaaaggccgggcgcggtggctcacgcctgtaatcccagcactttgggaggccaaggtgggcggatcgcctgaggtcaggagttcaagaccaacctgactaacatggtgaaaccccatctctactaaaaatacaaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaataaagtgttccccacccctgccaaaaaaaaaaaa

SEQ ID NO: 668735 - DNA, 1048 bp, Homo sapiens
gagagccgaggtctgggctgcagtaggtcccggcaaccgcaggctcgcggcgggcgctgggcgcgggatccgactctagtcgtaatggaggcgggcggctttctggactcgctcatttacggagcatgcgtggtcttcacccttggcatgttctccgccggcctctcggacctcaggcacatgcgaatgacccggagtgtggacaacgtccagttcctgccctttctcaccacggaagtcaagctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttttttaattttggaggttggggtgcaatctttagaatatgccttaaaaggccgggcgcggtggctcacgcctgtaatcccagcactttgggaggccaaggtgggcggatcgcctgaggtcaggagttcaagaccaacctgactaacatggtgaaaccccatctctactaaaaatacaaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaataaagtgttccccacccctgccaaaaaaaaaaaa

SEQ ID NO: 668736 - DNA, 142 bp, Homo sapiens
tggccacccccggccagtccactaggcgtcctcccgactcctctcccgggagcctcctcagctactccatccttgcaccctgggggcccaagcccacccggcatgcacaggagcacggggcataggtgtctcctggggaggc

SEQ ID NO: 668737 - DNA, 173 bp, Homo sapiens
agcacccatcagcgggtccacatcggtgcctatcctggctaagggcaatcatacactaatcacctcccgaagtggaccaccatagaaacgcgaaacatccgggaggcaattgagcattttggaatcaagatctatcaattcccagactgtgactctgatgggacgaagatgcg

SEQ ID NO: 668738 - DNA, 886 bp, Homo sapiens
  misc_feature (688)..(688): n is a, c, g, or t
  misc_feature (693)..(693): n is a, c, g, or t
  misc_feature (700)..(700): n is a, c, g, or t
  misc_feature (707)..(707): n is a, c, g, or t
  misc_feature (713)..(713): n is a, c, g, or t
  misc_feature (715)..(715): n is a, c, g, or t
  misc_feature (727)..(729): n is a, c, g, or t
  misc_feature (733)..(733): n is a, c, g, or t
  misc_feature (739)..(739): n is a, c, g, or t
  misc_feature (741)..(741): n is a, c, g, or t
  misc_feature (743)..(743): n is a, c, g, or t
  misc_feature (752)..(752): n is a, c, g, or t
  misc_feature (758)..(758): n is a, c, g, or t
  misc_feature (773)..(773): n is a, c, g, or t
  misc_feature (787)..(787): n is a, c, g, or t
gagagccgaggtctgggctgcagtaggtcccggcaaccgcaggctcgcggcgggcgctgggcgcgggatccgactctagtcgtaatggaggcgggcggctttctggactcgctcatttacggagcatgcgtggtcttcaccaacctgggctggctgagttatggggctttgaagggagacgggatcctcatcgtcgtcaacacagtgggtgctgcgcttcagaccctgtatatcttggcatatctgcattactgccctcggaagcgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgcaactgancaagngactctngttaagnggctgngncagtccaggtgnnnggtngggacncngnggctggggnaaggcnagacagttcttatgntggggcaggagacnttataaagttaaaactggggggggacaaaagcaagagggggccactcaccagagagggctggagacacagagcccaaaacggggcacagcagacagata

SEQ ID NO: 668739 - DNA, 1030 bp, Homo sapiens
gatagggactgccttcatacattcctactccaatctactttggagcagtcattgacaccacctgcatgctctggcaacaggaatgtggtgtgcagggttcttgctgggagtacaacgtgacgtcgtttcgttttgtgtattttggtttggctgccggcctcaaattcgttgggtttatttttatttttctggcctggtactccataaaatacaaggaggatggactgcagaggcggaggcagagagaatttcccctgagcaccgtgagtgagagagtgggacaccccgacaatgcccggactagatcttgcccagctttcagcacccagggagaattccacgaagagactggcctgcaaaaagggatccagtgcgcagcacagacctacccggggcccttcccagaagcaataagttcctctgcggacccggggctggaagagagccccgctgccttggagccgccctcctgaagcttgaaaatggaagaatttagttttgttggttgaattgaaaatggcgacttgagaaacaactgtgccttcttttctttctttcttttttttaacctctacagacacaatcctcaaaccaacaaaactcagtatacacagccgctattcattgagggctggatacctcaacaagactgagagcctttccccgcttctctccaagaaggagacgttcagctagatttgttcccatttccgttgtgttaattcaaagctcatgctcccctacggtacaggctgaggtacacggttcgcaaaaccatgggaaggggaatggcggtgcatatcattaactaacactccaaacaaaggtgagcttgcccaggacttggcatttccaaatcaaagtttttagatatgaacacctactgtgagttctgctacaaagcacaaatgaatttgtctcaactatgcaatttgattggaaaaatgtatgtgcagcatgttacatttactttcacggaataaagcagatatgtttctgaaaaacccaaccccatacataaaaacaaggg

SEQ ID NO: 668740 - DNA, 283 bp, Homo sapiens
tttttagtagagatgggtttcaccatgttagtcaggttggtcttgaactcctgacctcagcgatgccgcccatctctactaaaaatacaaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaataaagtgttccccacccctgccaaaaaaaaaaaa

SEQ ID NO: 668741 - DNA, 1070 bp, Homo sapiens
gctctttctctcctccctctgccttcccaggtgcataaaggtctctgtcgttacccggaagttgttggccatgcctattgatgtaggctttcccccgggttctctaaactaagctatttaaaggtctgtggtcgcaaatggtatcgactaagccgtaggatgggacttaatgtagaagggcatatagtattacactgatcctcagcggatgctaaatagacgtagtctaggtgcaaggcgcgtgatgcagcagcgggcaaatgtgcgatgcggtcttcaagggcttttcggactgtttgctcaagctgggcgatccagcatgggcaactacccgcatgggcctggacgacaagactgaacatcaagaccgtgtgcacatactgggaggatttccacagctgcacggtcacagcccttacggattggccatggaatggggcgaaagatatgtgggataaactggagaaaagaatccaagaaacctcaacatccaaggcagcttattcgaactctgcggcagcggcaacggggcggcggggtccctgctcccggcgttcccggtgctcctggtgtctctctcggcaagactatagcgacctggatttccttctgagcgtggggccagctccccccgagcgccaaccaaactcactccatgctccggaaatcgagaggaagatccataagttctatggggacgttgtgattctctgtgatgctgaaaacactcatatagggaatagtgggaaatccatgatacatactagaacagtaccgacggaaactcggagtaaaataggccaaatgttacaaacagggaggcaagcaagcacaggcaaaaatcgggaccacccagaatataagtcgcggacgtatcacaacaccaaattcagaaaaaggggaaaaacgagcaccatcgttaaacatatacatcattaatcacgtataaaagaagggaaaaaaaacacctcaggaaagggccctgggcacacacaagaataataacaatgcaaggaaacatgacaaaagaagaggcacctacccaaatagaaaggcaaggaagaaacagg

SEQ ID NO: 668742 - DNA, 1871 bp, Homo sapiens
  misc_feature (1338)..(1339): n is a, c, g, or t
  misc_feature (1342)..(1342): n is a, c, g, or t
  misc_feature (1347)..(1347): n is a, c, g, or t
  misc_feature (1357)..(1357): n is a, c, g, or t
gagagccgaggtctgggctgcagtaggtcccggcaaccgcaggctcgcggcgggcgctgggcgcgggatccgactctagtcgtaatggaggcgggcggctttctggactcgctcatttacggagcatgcgtggtcttcacccttggcatgttctccgccggcctctcggacctcaggcacatgcgaatgacccggagtgtggacaacgtccagttcctgccctttctcaccacggaagtcaacaacctgggctggctgagttatggggctttgaagggagacgggatcctcatcgtcgtcaacacagtgggtgctgcgcttcagaccctgtatatcttggcatatctgcattactgccctcggaagcgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttttttaattttggaggttggggtgcaatctttagaatatgccttaaaaggccgggcgcggtggctcacgcctgtaatcccagcactttgggaggccaaggtgggcggatcgcctgaggtcaggagttcaagaccaacctgactaacatggtgaaaccccatctctactaaaaatacaaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaataaagtgttccccacccctgccaaaaaaaaaaaacaannaanaacancaaaaaaaanaacaaaaaaaacacaacaaaacaaacaaagaaaacaaagacaaagaaaaaaacaaaacagaaaacggaaacaacaaaaaacaagcacaaggggggggggcggcaaaaaacaacacgggggggcgagaaaatagcacactttgtaaaaagcgcccacaaggaggagtcaaaaaagacgagccgccgcgcggccaaacaaacagcgcggcgacgaacacaacgcatgccagcagcagcttcggagagcacacacccacccgtggggggggggaaccaacgaggacaccaacacatgataatgagacccggcaaacacaacgacagggtgtgggggaccacaccctacactggcgtgagacaccgccctgctctctataaaattacggacgcactaaaaaaaggacagcaagtagcatcccagcaggacgcgagacaggcccacaacgtcgcagagcaacacacgacgaccgcagcacgaggccgcagacacacacaagacacgcaacgcgcagcgg

SEQ ID NO: 668743 - DNA, 121 bp, Homo sapiens
gtcatagctgttagtgtcaaacgactgcagtgcatgtcattgctgttagtgtaacacgacggccagcgcatggtcatgctattcgtgtcacacgacggccagtgcctggcttagcttttcg

SEQ ID NO: 668744 - DNA, 1310 bp, Homo sapiens
gagagccgaggtctgggctgcagtaggtcccggcaaccgcaggctcgcggcgggcgctgggcgcgggatccgactctagtcgtaatggaggcgggcggctttctggactcgctcatttacggagcatgcgtggtcttcacctcggacctcaggcacatgcgaatgacccggagtgtggacaacgtccagttcctgccctttctcaccacggaagtcaacaacctgggctggctgagttatggggctttgaagggagacgggatcctcatcgtcgtcaacacagtgggtgctgcgcttcagaccctgtatatcttggcatatctgcattactgccctcggaagcgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttttttaattttggaggttggggtgcaatctttagaatatgccttaaaaggccgggcgcggtggctcacgcctgtaatcccagcactttgggaggccaaggtgggcggatcgcctgaggtcaggagttcaagaccaacctgactaacatggtgaaaccccatctctactaaaaatacaaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaataaagtgttccccacccctgccaaaaaaaaaaaa

SEQ ID NO: 668745 - DNA, 1789 bp, Homo sapiens
  misc_feature (571)..(571): n is a, c, g, or t
  misc_feature (582)..(582): n is a, c, g, or t
  misc_feature (617)..(617): n is a, c, g, or t
  misc_feature (622)..(622): n is a, c, g, or t
gagagccgaggtctgggctgcagtaggtcccggcaaccgcaggctcgcggcgggcgctgggcgcgggatccgactctagtcgtaatggaggcgggcggctttctggactcgctcatttacggagcatgcgtggtcttcacccttggcatgttctccgccggcctctcggacctcaggcacatgcgaatgacccggagtgtggacaacgtccagttcctgccctttctcaccacggaagtcaagtgaggggccgacggctgcggtagtgggaaaggctaccagagggaggtgggggcggggcaggaggagcaagagtgaaagaggtttggccgggacgcggtggctcacgcctgtaatccctgcactttgggaggccgagacgggcggatcacgaggtcaggagatccagaccatcctggctaacacggtgaaaccccgtctctactaaaaatacaaaaaattagccgggcgtggtgccgggcgcctgtagtcccagctactcgggaggctgaggcaggagaatggcgtgaacccaggaggcggagcttgcagtgagccgagatcgtgccancgtactccagnctgggcgaatgagcgagactacgtctcacataaanataangtgtgcaaagacccttggggtcctcctctcacattgaacccttttgagccatgtccatccccttccaccctgcagcaacctgggctggctgagttatggggctttgaagggagacgggatcctcatcgtcgtcaacacagtgggtgctgcgcttcagaccctgtatatcttggcatatctgcattactgccctcggaagcgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttttttaattttggaggttggggtgcaatctttagaatatgccttaaaaggccgggcgcggtggctcacgcctgtaatcccagcactttgggaggccaaggtgggcggatcgcctgaggtcaggagttcaagaccaacctgactaacatggtgaaaccccatctctactaaaaatacaaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaataaagtgttccccacccctgccaaaaaaaaaaaa

SEQ ID NO: 668746 - DNA, 1384 bp, Homo sapiens
gcgagagggagggcaaaagaggaaggctgggtgattcctggtaatgtgttattttgagaaaaagcttcggcagcacactccagaaaaaaacttcccaaaccctgggcaactgaggttctgatgtggagctctggatggaaagcgtgctgaagtcttgttaaactagcaagcttttgtttggaggtccaccgccgaaggcgcacaggcctgtgggaacacgagcgttgagactgggggcgtctagatgatccaaggggtaggcagagtgtgagcagcggcaggtatcggggacacacccgcggagccctaggaaggggactgaccgggacatggaagagctcggacctcaggcacatgcgaatgacccggagtgtggacaacgtccagttcctgccctttctcaccacggaagtcaacgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttttttaattttggaggttggggtgcaatctttagaatatgccttaaaaggccgggcgcggtggctcacgcctgtaatcccagcactttgggaggccaaggtgggcggatcgcctgaggtcaggagttcaagaccaacctgactaacatggtgaaaccccatctctactaaaaatacaaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaataaagtgttccccacccctgccaaaaaaaaaaaa

SEQ ID NO: 668747 - DNA, 196 bp, Homo sapiens
ctttttttttaaaaaaaaaaattttttttgaaagggtttgaggcccaaagggggccaaaaaaaatttttttctttgggctaatctaaaaagggtttttaaagggtgccctaccaacctggtgaaatcaagaaattttgcccatgggcccaaatggtaacccttggtttttttaaaaaaaggaatttgaaaccccga

SEQ ID NO: 668748 - DNA, 257 bp, Homo sapiens
cccggttccttcggagctcgtcgtctctgccgtcctctgacttttaatttccaggacttgccttctgccatgtcgtctgaagaagggaaactcttcgtaggagggctcaacttcaacaccgatgaacaggcacttgaagaccacttcagcagctttgggcctatctctgaggtggttgttgtaaggaccgggagactaaagatcctggggttttggcttataccttacaaccaagagcatgcctagatgcgatgaga

SEQ ID NO: 668749 - DNA, 1311 bp, Homo sapiens
  misc_feature (965)..(965): n is a, c, g, or t
  misc_feature (969)..(969): n is a, c, g, or t
  misc_feature (971)..(971): n is a, c, g, or t
  misc_feature (974)..(974): n is a, c, g, or t
  misc_feature (977)..(977): n is a, c, g, or t
  misc_feature (979)..(979): n is a, c, g, or t
  misc_feature (986)..(986): n is a, c, g, or t
  misc_feature (999)..(999): n is a, c, g, or t
  misc_feature (1010)..(1011): n is a, c, g, or t
  misc_feature (1016)..(1016): n is a, c, g, or t
  misc_feature (1032)..(1032): n is a, c, g, or t
  misc_feature (1035)..(1035): n is a, c, g, or t
  misc_feature (1048)..(1048): n is a, c, g, or t
  misc_feature (1068)..(1068): n is a, c, g, or t
  misc_feature (1078)..(1078): n is a, c, g, or t
  misc_feature (1080)..(1080): n is a, c, g, or t
  misc_feature (1093)..(1093): n is a, c, g, or t
  misc_feature (1098)..(1098): n is a, c, g, or t
  misc_feature (1104)..(1104): n is a, c, g, or t
gagagccgaggtctgggctgcagtaggtcccggcaaccgcaggctcgcggcgggcgctgggcgcgggatccgactctagtcgtaatggaggcgggcggctttctggactcgctcatttacggagcatgcgtggtcttcacccttggcatgttctccgccggcctctcggacctcaggcacatgcgaatgacccggagtgtggacaacgtccagttcctgccctttctcaccacggaagtcaacaacctgggctggctgagttatggggctttgaagggagacgggatcctcatcgtcgtcaacacagtgggtgctgcgcttcagaccctgtatatcttggcatatctgcattactgccctcggaagcgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagattttttantttngnagntgngngtgcacnctttagaaatatncttaaaaggcnngcgcngtggtcacgcctggtnatncccagcactttgngagggccagtgtggcggatngctgaagtcngnagtcaagaacaantgatnacatgntgaacccattttttctataaatccaaatttccagatgatagccatgccgttatcccataattgggagcggcggcaggaatgcgtgtacccagacgtgagctatctcaggctcagagcccaggatataatagaccatcaagataatatacaaaaaaggtgcccctgtagaaaaacacacacacaaggggcacatctagtgccaaatcg

SEQ ID NO: 668750 - DNA, 480 bp, Homo sapiens
tcggtagcagtgggtgcctgtagagcgatgcgtgtgaactaatctagtggttgaagaggcaggacggcttgcagctgcctgggtcccactacaggatgccagcaggcgtcactttcctctcgctgggccacagagatatattatatataatgacttgaaactggctgtgtctcggtgtggcgaggatggcccatgggtgctgctggtacgcgccagggctatccaccttcagcatctccatgtagaagatgacgcgctggtggttctgctgcagggcgtccagctcagcatggcccacggagctgtgttcacgcatctgtgcaacaccgcatcagtgccgatggccctacagggggtccttgcccaccgtgatgttgcagagactcttggccaccagcgggtacaggaccacatgcttgatgtcacagaggaactgggcaatctacccttctagcatggtgcacacgatggtctaccaca

SEQ ID NO: 668751 - DNA, 640 bp, Homo sapiens
  misc_feature (2)..(2): n is a, c, g, or t
  misc_feature (30)..(30): n is a, c, g, or t
tntgccgaggggagggatatatttaatatnttgactttgtcagagatataattggtgtatgcatatttgcagaattatgaaatggggtatgttaaacactttgtatgacagatgcattcgacagcattaacttaagcataccctgagaatgactggatggtctaagaagaatatgtgttcagagtctaagctaaggaatccgggaatggccaacccagagagattcacttcttatctgtgaaggacacttgaactccctgcctgtccgttggaactcaggatgtgcaaggaaccaaggccttttattttgggttaaatggaggttgctaagtggagagtgctaagtagaaatggtatataaactacatactttttacaaataggaggggtcctgtccagcccactgacactggaccacatttgtatttaagtcctaaaaaaacccctagtcccatttactggctctgggtctttttttggaaaggggccatcccttgtggaaataaaatgggtccagcatgacacatgtggaggaatttttaaattatataaatttttctcaattaagggtggggaaatttttaaagggcctgacctgtcccgggatggggaaaaatttaaaggggcaaaaatagtaggt

SEQ ID NO: 668752 - DNA, 438 bp, Homo sapiens
  misc_feature (7)..(7): n is a, c, g, or t
  misc_feature (13)..(13): n is a, c, g, or t
  misc_feature (31)..(32): n is a, c, g, or t
  misc_feature (53)..(53): n is a, c, g, or t
  misc_feature (73)..(73): n is a, c, g, or t
  misc_feature (183)..(183): n is a, c, g, or t
  misc_feature (372)..(372): n is a, c, g, or t
  misc_feature (401)..(401): n is a, c, g, or t
  misc_feature (425)..(425): n is a, c, g, or t
aattcgngcacgnggagaaggggccacactnncccttttaacaggagccacanaggtgctaacagcgaggacnctttggtgaggacggagccctcacgacctcagcagtgttgcgttggggatcaggtttccgatggtgaacttggggacacgtccacaccacagcacgtgcctattgtgttnctcggtggctggtgtgtttgaggatggcgcgtgcatgcgttttccagctttctttgtggaggaagttacctgtgggtattaacctgtccccagccatcctctcactgagcttgggttgcctgggcctgggtttcctgttgttgctggaacgaatgaccacaagacagtggcattagacagcgcaggcanacatgacctccttgggcttctgcgggtgncaacactgccgctccttcttgganggctcagggaagg

SEQ ID NO: 668753 - DNA, 138 bp, Homo sapiens
gctctcttacggcagcttttgagcccttcactgggttacacctcagatgcgtgtgtgtccctgatacatgaaggcctccagaagtgtctgatacggtgttgaaggcgatcacagggattgtgctgcattctgacttag

SEQ ID NO: 668754 - DNA, 1008 bp, Homo sapiens
  misc_feature (15)..(15): n is a, c, g, or t
  misc_feature (40)..(40): n is a, c, g, or t
  misc_feature (68)..(68): n is a, c, g, or t
  misc_feature (76)..(76): n is a, c, g, or t
  misc_feature (79)..(79): n is a, c, g, or t
  misc_feature (90)..(90): n is a, c, g, or t
  misc_feature (109)..(109): n is a, c, g, or t
  misc_feature (125)..(125): n is a, c, g, or t
  misc_feature (127)..(127): n is a, c, g, or t
  misc_feature (134)..(134): n is a, c, g, or t
  misc_feature (153)..(153): n is a, c, g, or t
  misc_feature (187)..(187): n is a, c, g, or t
  misc_feature (211)..(211): n is a, c, g, or t
  misc_feature (216)..(216): n is a, c, g, or t
  misc_feature (221)..(221): n is a, c, g, or t
  misc_feature (225)..(225): n is a, c, g, or t
  misc_feature (232)..(232): n is a, c, g, or t
  misc_feature (234)..(234): n is a, c, g, or t
  misc_feature (237)..(237): n is a, c, g, or t
  misc_feature (239)..(240): n is a, c, g, or t
  misc_feature (242)..(242): n is a, c, g, or t
  misc_feature (244)..(245): n is a, c, g, or t
  misc_feature (248)..(248): n is a, c, g, or t
  misc_feature (250)..(250): n is a, c, g, or t
  misc_feature (254)..(254): n is a, c, g, or t
  misc_feature (313)..(313): n is a, c, g, or t
  misc_feature (315)..(315): n is a, c, g, or t
  misc_feature (317)..(317): n is a, c, g, or t
  misc_feature (348)..(348): n is a, c, g, or t
  misc_feature (351)..(351): n is a, c, g, or t
  misc_feature (361)..(362): n is a, c, g, or t
  misc_feature (369)..(369): n is a, c, g, or t
  misc_feature (380)..(380): n is a, c, g, or t
  misc_feature (387)..(387): n is a, c, g, or t
  misc_feature (428)..(428): n is a, c, g, or t
  misc_feature (432)..(432): n is a, c, g, or t
  misc_feature (440)..(440): n is a, c, g, or t
  misc_feature (443)..(443): n is a, c, g, or t
  misc_feature (448)..(448): n is a, c, g, or t
  misc_feature (488)..(488): n is a, c, g, or t
  misc_feature (548)..(548): n is a, c, g, or t
  misc_feature (554)..(554): n is a, c, g, or t
  misc_feature (937)..(937): n is a, c, g, or t
  misc_feature (989)..(989): n is a, c, g, or t
taacatttctacgcntgctttccgaggctgcatgaaaaanttgaagaaaaccagtggtgtcgttagantgaatganaangaaggagtaanaaaaaagtgctcggaagantggaagcttgtgcgancngcctcantctccagaggaggacaatngagtttcactgatttgggcttaccacctactgancacctccaggcctcatttggattncaganctttnaacncagtggnanatnannanannatnanaaanggacaaggaacctgcaggtcactctggaagatggttacattgaattgagcaccagcganangncggcccaatttttaaatctccacagacgtanatngatggtttanngcattangtatctgtaanaagcganaactctggactacggcttctcatcgatgaccagcttctganaaanagcaaaangcnaaaanacatttcaagttcccggcagtctctgcgtctgggcggganaattttgagggttgtattagcaatgtttttgtccagaggttatcactgagtcctgaagtnctaganttgaccagtaactctctcaagagagatgtgtccctgggaggctgcagtttaaacaaacacaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtggttcacacgggcactaaagaactcctttatggctctttatctntcaaaaggacgtctggtcttgcactggggacagatgggaaaaattgaggatnaaagcaagagaaatgcact

SEQ ID NO: 668755 - DNA, 443 bp, Homo sapiens
agatcacccggaagaagcagaagaagatcagacgggttcagcactggtgtaactgtaagttatatgtcaagtatgcttggtatgagttccgggcaatggtgaaaggataaggtgaatgattatggaaaataagattttggaattattggaacagaaaggcagcgtatcaatgaatgatgatattttcccgttggtggaaaaagaatttgaaggtcaggtgattggtgcagaactttatgaacttgcacaccaatacatatcacagttgttgtatggggtacatactgccggggttgccgtgattgctgttcctaagtttgcagcgggtcagcagttcggtcagatggttgttgctgatgtgatttatacaaaggtgaatgatacaccgtatgattttatgcagtagttacgcaatagttacggtcgacgcggccgcgaattta

SEQ ID NO: 668756 - DNA, 166 bp, Homo sapiens
ccaacatgtagacagtaaaaaaatacatgcaccacatacttttactgaaaacacttaacttggaacgaaagcaccgaaactacacaaatgcagaatgaagacagcatttcacctccacccaaaagtagtcatcgtacaaggtgtcacagtccaccgtaacttcact

SEQ ID NO: 668757 - DNA, 180 bp, Homo sapiens
gtgttctttgtcttcctgcgattgggattccgtgtacactccatatacctctaacctccgcactttcccactcatctctggcatactgactgtcgccttctctctcgttctccctcgttgacaacctctgcgccgatgagagccaaacttcatgcctgcaatctatctgcgcttggccgc

SEQ ID NO: 668758 - DNA, 393 bp, Homo sapiens
tatgcggtcccttcgacggtgtctgtttgaagtaattattgggggagttcctgtcatggctcagaggttactgaatctgcctaggagcacatgaggttgcaggtttgatccctgaccttgctcagtgggttgaggatctggcattccatgagctgtggtgtagtttgcagacacagctcgtatcccacgttgctgtggctgtggcataggctggcagctgcagctcccattagactagacctctagcctgggaacctccatgtgccacaagtgtggccctagaaaagaccccccctcaaaaaaaggtaattattggtactatagttgctttttccccccttcttttgtggttctcttgttcctttcttcctctcttgcagaacaccgtcgaag

SEQ ID NO: 668759 - DNA, 155 bp, Homo sapiens
gagtgaattgagcattgtattactggctctcattttctgtcttaagttgtcgaccgctaacagtggtaggcttgatatacttctgtccactgtggagcgtggtggttcccattgaagggtttgtgttgtgcctggctggatttgagattccgtct

SEQ ID NO: 668760 - DNA, 251 bp, Homo sapiens
tcgaccttcaggctgattgaggcgaatcatttgaacccaggaggcggaggctgcagtgagccgagatcacaccactgctctccagcctgggcaacatgaaggagattctttctcaaaaaaaaaaaagaaaaaaagaaaaaagaaaaaaaaagaaagtagggatgtcatcactgatccttctgacatgacagacattaaaaagctaataagtggctgggtacagtggctcacgcttgcaatcaagcctggaa

SEQ ID NO: 668761 - DNA, 599 bp, Homo sapiens
tggaaaaagtcatggaggccagggggtgggcttgaaaccagcttgggggggtctcgatcccttcctttttggtctaaattaatgtatacgggttcttcgaatgtgtggtaggggggggggcatccatatagtcactccaggtttatggagggttcttctactataaggacttttcgcttcgaagcgaaggcttctcaaatcatgaaaattattaatatacggctgtagagaaatgaatgagcctacagatgataggatgtccaggtggtgtatgcatcggggtagtccgagtaacgtcggggcatcccggataggccgagaaagtgtggggggacgaaagttagattaacgccgatgaatattcgatagtggaaagggattctgggcgtaggtaatcgggccaagggtgtacgcctgagactcgcgggaacatcacggtgaatgaagcctcctatgagggcaaataccagccctatggatagggaccatacggggaatgtgagctacaacgtagacacgtgtacgtgtagcaccgagtcaagtgatggagtctgcaaacacaacgccagtcaggcacctaggcgacaagaaagaggatc

SEQ ID NO: 668762 - DNA, 1114 bp, Homo sapiens
gtgtgcagacccgcgtgtggtcgcaggcaaggaccctcaaaataaacagcctctacacttgctgagcctgtcgttccgccaggcctgcgtccggagtcatcctggctgctgctgggccctgatcctgatggctggaagatctgacttgcgagccatgagcaggaaatgagtagcttcaatgtgtaggacagatctgggccacttggagcccggggcaatgtcctacttggttgcgaggcctgtgggtctgtggatatgcagcaagcctgtgggcaagaggtgcgttttacctcggggataagaggttaccaagattgtgtatcactcgatactcttccagtacatataggtatatcgctgtggtagagtctgggtcatctttgccaaggatatgtgatcttcaaggagagatgccgtgcctataactgcggtcacaggtggccacattgccaagtgactgcaaggatgcccaatgagagagcgagagccattggctgcatacacactgtggcaaaatcaaggccatctggctcgtgactgcgaccatgcaggatgcgcacgaactggctaatacttggtgccagcaatccgggacacattcacacacaggacgggcaccaaaagttgacagtggcactacggatgctgggggaacatgggccattgttagcccattcaacatggcaggctaggaccacgttgaagtcaacctggtaaccggctgctgggccgaagtacagcaggcccctgtgcaccggggacatgcacaaattgcagggctaacagccctaaataactaatcccatgggcggcccactcctaatacgggacgcggcgctggaaaatgtacccctgaaaccccaccaccgcgggccccaatgccttgcacgctacaagtgacaaccccaggccacagcagcgtaccacggaccgggcaaacagccggcacaaccggcggggcgaaacacaccggaattcctcgcgtcaccaccacgaaaggtgactgaccacacggggcactgcgcagaaacacgggaaaaacaccccgcaggccacagaacaacactaacagcgacaggtcaaagaccaccgagatgaaaagaccacaaaagaa

SEQ ID NO: 668763 - DNA, 459 bp, Homo sapiens
  misc_feature (8)..(8): n is a, c, g, or t
  misc_feature (30)..(30): n is a, c, g, or t
  misc_feature (44)..(44): n is a, c, g, or t
  misc_feature (70)..(70): n is a, c, g, or t
  misc_feature (456)..(456): n is a, c, g, or t
  misc_feature (459)..(459): n is a, c, g, or t
aatttccnccaagaggtttcaagcccctanactctgacaacctncccaaacattgcctatgaagagcctnaaaattggaggaaatatgtccacactccgtaaaatggaaaattccaacattgttaaagatggtaatcctccttcaaattaaccctacagattctcccacaactcccattaaaatccctagcaggttttcctaacaccgcatgttctcactcataagtgggagttgaacaatgagaacacatggacacagggagggcaacatcacacactggggcctgtcagggggtgcggggcaaggggagggagagcattggacaaatacctaatgcatgtggggcttaaaacctagatgatgggttgatgggtgcaacaaaccaccatggcacatgtatacctatgtaacaaacctgcactttctgcacatgtatcccaaaacttaaagtgaanagn

SEQ ID NO: 668764 - DNA, 950 bp, Homo sapiens
ggagagagaactagtctcgagtttgtgggttctattttctcggtggacaggaagtagaattaatgggggagtattaaaaggggggcagcacatgtggaagccctcatgagtgcagggcccgccattgtgtccaaagggccacgcacgggggatgtacttgaccccaaagccatctgggatgaacccgcttttcagccaccagtgtcttcaaattcatcagctttgaactgggtgaagccccacttcttgcgagcagtgtggatcttctgggcggccaggaaacttgaactgggcccgtgggcagggccctcaatcacatgtgcctcctgtgtctgcagcttaggtgcggatggacatgaataactgtggccaagtggtgacacccgtggccacagatgcccgtgggagctttccaaaggcacactcgcagtgcctgattgggagcctgatcagccccagacacaggacaacatctgtggtgatgcggatgacgtggaaggggctggagccgaaccccggaatatggaagccatctgtgggccacaatcgtttttaacgccagtgtaccgatatgggcaccaaaattcgggacgagacctccagggcctatccaacgaggacagcgtgctaaaaattcatctgacaccatggtggcccaaaaagcggaaaatgatcaccagtttgagactttttcgcggcaccgagggtccaaaatgtgcgaaatctgggcactccgggacacctcggcaaaaaccacaaacattgtggaaatacgggatggtacttaccgaatcaccggtgaaacaacggagacggggcggtcgggccccgggggcaaagccagccacagagagtgagatgacggcgcccgcgggggcagtagcccgggagtggccaagcgcccatcggacacccaaggccgcaaaacgagccggaaagaggagacgcca

SEQ ID NO: 668765 - DNA, 276 bp, Homo sapiens
  misc_feature (166)..(167): n is a, c, g, or t
  misc_feature (204)..(204): n is a, c, g, or t
gacgctctctctgtggggaggggaccagcttccctcgtgattcccgtcctttcaagttcattatggcagctctgtcaatgagcaccccaggtggtgtggcctgcagcaccagtgaccctgtgctgaatggcccagatgacctgtgcagtgccggtgagaaattccnntttcctttgggaatgaaccaccaactgctcagtccanagctcacacgggttatctatgtcggcaatgccttccctgccctgcagccaataccccccacagagagagcgt

SEQ ID NO: 668766 - DNA, 139 bp, Homo sapiens
cagttgactgttttcacacccagctaaggttgcgttcgcgggcttgaactcatgctgcgggctgtgcttgaagtcatagtcaggctgaaggatcaggagcggtcgcctgagtcctgtaagtaggagagtgatatttgat

SEQ ID NO: 668767 - DNA, 220 bp, Homo sapiens
acttcttccctagggctggatcactgtggcacgtgtgtgtcatcctccaccgggcacacggcgccactcacacgtcttgctggcaccgttgaacgctacgcacctgactgttgagactcctacaagcacaatggtggcagcggggtcccatgtccacaggggtctcctattttctacctttatggagtagggagtgagagccccatacagacttttaggc

SEQ ID NO: 668768 - DNA, 130 bp, Homo sapiens
tatcatcatacagactaaatgatactgagtatgcaatgtagtgtagacagacttccatctataatggataatacaggatcactactgtggcagtatgggaagtcttatatattgctgtgggactggattc

SEQ ID NO: 668769 - DNA, 735 bp, Homo sapiens
agcggggtcggggagtgtccctgtgctgaaagaatgaggagatcctgggggccttacctactagctggaatcgactgaagagactgcctgccagtgcgggagtgtaggaagctcgatccccaaatgaaaatgagctgagtgggcagtgcagcttgctgagacagaacctggagtgttgcatgggtcgctagaggcctggttcctggtctgtgcttgctctcctgtgaagccatggtacaggcagaactcagtggctgatccccaggtgagggcatgcggctctgcctgggattccaccgagagtacaaggcgggtagattgcgtgggtggaggaaagaaacggatgtagcctgcaacttgatcggaccaatagcaaccgctgagatgggcttacaatttgcaaagaatgcaggcaagaaagctagaagacacatgcggccggtccatgtgaggcgggtacgaaggctggtccgtaagagtcagcacctgaacagcctttatgtcttccgatagtatttgcggagttgacaaaaacagcgcaggaggaaacagtggctcgcacccatttaaccgaatcgttatacggacgagtctatatacgcgtttgctaagccgggaatcttgatatggtgccggaagaaacgcattgcccttggacaccattgtaccctgggatggaaactggaacgacaggtgagattcagaagcgtttagtaagcagggtacaagtacctg

SEQ ID NO: 668770 - DNA, 1202 bp, Homo sapiens
ccacgcgttccgggcaaaaccccgactctgcatcaactgagggcaaagtcagccactcttaattacgctaagcccttactagaccgagatgggacttgaaatccacacaaacacttagattaagcagcttaagcagccgctaagtcaacgtggcatatccaatcgtacttcatcccgccagcccgtggcaaaaaagagcggggagacagccccgagcgatgggttgtagacagcatgcgtgtgcttgcgaattgtgccaattacaatgatgagataatcgacctcgtgagcttggtaaacaatgaggccgtaaccccatgatctatgagaatttaccagtccaatgccttcacgtcagcactagtttataccctacacccacgcatctgcatgttcggccgacccgtgagactcattcgtcgtaaccaaagcggcagagagaagagcagttggtgaaccacgtagtaccgtactgagttgcggtgcagtgacgctgggagtcgctagtgcacagctactaagacataccttatccggaagaccagaaggctgtgggccaagagacggcaggaaaagcgtactcaggtaagacgaccaagcgatcgtaacaagagtaaatacagtagaagcaagtcgccaatggcaatatctagtcaagtgaatcctttacgtgacgatcacgatacatacgcccatcgatcaaagtgcggaggcctttaggggccctgacatgtagcatagatatgcccccataaagtatagtgcggaatgacgcgcccagtaataatgcgacgttgtccccccagtgaattccaaaacgaaaccagtaaggaatgtcctggaagtacagtgtacacatcccgtgcgtcatccgtaacctccctggaattcgcattctgtcatattcaatgcgaaagaggcccgggcaagaccacgagcaacagcaaggggactggaacaacacaggtagcataaccaccaaccgacacttaacgaccaggggcaaccataaactacagcagaccaccactgggacagacacgaccgggagtaaagaaccgctgaaaaccaggaccaacactcagcatctagccaagccgctaagcaaggagagctcactagccacgactaatacgcaaaggaggggacgaaaccgaaggagcagtaccacgacagaaacacagtccacagcaatcacaaac

SEQ ID NO: 668771 - DNA, 140 bp, Homo sapiens
tcattatgtcctttgaatgaagtcctgtcttagtggctgcattaccaatggcctatcttgctgcctaaagagcgcctcatggtactgaggtcacagaattccccccaacccagcatgggactcatggaaaattgaatgat

SEQ ID NO: 668772 - DNA, 931 bp, Homo sapiens
  misc_feature (1)..(1): n is a, c, g, or t
ntgcgtgcagcgctggcgcagcgcggagggcgcgggttgccctttatatgtgcgccatggctgtcctggcgtgtcgccgtttttactgtgcagcagccggtttccccgccggggttcgcgcatacggggcattgcctttcggtgggccccgcccttgggcgcccttgccagccccccggctccatgtgccagatttccccggcggggccccgtccccctgtgcaattgtttctcgggcccctcaaaccaacctctttctggcttcattttcccccccacaatttgctgtgggaagcggtaacacttttttcccggaccatggtctgcggtacatggcctgtgggtttcttcctcctcctcgtatctccctacccctctggctgggtcccgccccttttttctcggcgcctccaaccccgctcattcagtggcggtcacccccccgcgccatttatccgccccgtgtccctggggaggaatggctcaccccgcgcccgtgtgcgagtgatcattcgcgctcgggttttgtcccccgagcacgccccctatttgtagggagtcccggcaagctccccctttgtatcaaggcgggatgatcactgccctccaaacacacaggtggggagccacctccggacgaatcctccccacgccgtgcagtgggttggcccggcaagagaggtctggggggagccaccatctttcctggtagacagggcacgctctccccgaaccgccaggtatgatggcgcctctgtctgatccgctccccggatgttttgacaaggccgcccccctggcacatccgttaagggcggcttctggaggtctaggctcctacgcgtccccccgcactcctgggccgttccttacactgttgcacgccagcccttggccccaagggaaaaaaacttttttcgtcccacatagc

SEQ ID NO: 668773 - DNA, 702 bp, Homo sapiens
gcggcagcagcatgctggggtgctgcgtggcgtgtcggggctccggtgccggggctggcggcgccatcttgtgccctggtggcctggtgcgggagtgcctggtggattgtggtgccccgtgggggcgcaggggactacgggaacggcctggagtctgaggagctggagcctgaggagctgctgctggagcccgagccggagcccgagcccgaaggaggagcctgcccggcccctggcccccccgggagctccgggccctgggcctggttcgggagcccccggcagccaagaggaggaggagcgagccgggactaggtcgagggtgacccgggggacggcgccacaagacggacccggagctcggaagctatcaacacgctcgagtcacgcacactgcacggaacgaaccctgaccacagctcaccagcgagcccacccaacccacgctaccacacaccagactggactactgacctccaccctcccaggcagatgctggccccggtgatcatgtccattgcggcacgaacactgccacggctcgatacgccccgtaaccagtcgtattgttcggccgactgctgggagctatggggtgcaacatgcaggaaggagcttggacgcgtcactattcagtggctcgtggttcagttcgaatcggtggtaccatacttgtgttgagcagtatttacgtggccatcg

SEQ ID NO: 668774 - DNA, 496 bp, Homo sapiens
ccgatgccacacgtaggctctagtagtataacgtaccttggatacttacggaatggactaagtatagctcctgggctacaaacctgtactgcatgtaatctatactgaatcctgtgggcagatgtacaataacagtgagttttagtgtatactaaacatagaacgcggaacagcaaaaatatggtattataatcttaccggaccagcagtcagactcggtgatctgacattgactgaaatgtcgttatgcaggccatgacgtgtattacctctctgacgttccccaggagagctggttccagaaggttcggatgagtcctgaatgtttatgtatggcattttcctttagcaaaagaaagccaaagaacatcaaaagctttcgggggttctagtagccattgaagtactcctaagtgtggtcatcagaacataagccattctttaaccgcttgacttctaacggtagaggtccattcggcgggtcttctagaatccg

SEQ ID NO: 668775 - DNA, 1346 bp, Homo sapiens
acctgagatctatcatgtgatccgtgagactggataatgtcctgaatggcctgcagtacttgcacccgtgtatttttgggatgtcgaaccggacgaactggaatatctgacacagcgtgtgcaaactcacggacacaagcgtaactcggaacgacacgacaacgccacctcgaagacacgacaaccacacgaacgctcgacaaacaaaggacacacggctcacagatgcttaccaacagcgatgcattgcccagcagtactggcctacacgcacagctgggaacctctcgtgggatagtggcgggcactgccaagcacttccttttcaacgacacgcgcctacgcactctctcgtcttcggaggaacagcgatgcaagtagggaacataaacaattccttacggaagaaattggggacttagttgtctcatgcacatacataaatccgacccttaacgcgtgtgggttgcatcgttttagtataagatcaaaggaccagtggagaacacaagacaagtatggaccgattaccgtggaaaattgagggtgaaaagaggagtttttacaattttaagtgtgcaccgaggtgcattgagcagaatgttgttgggatggtaaaacaggagtttatcgagtcgtagacgtttgagattatgtggatagaggaaatagggacgatgagtggggagagtttattgtcggcggaagaactggtgtgtctatagcaccaaagtggaactgatgatttccctgtgtggaatgggtgtaacaaacaatgcaatacaaagccccgacatccttgggtcgacggcgagccgtcactcacaagtggcaaccgccacacaagatggtggatcaccttggcaacggtgggaacttgtcactcaacgcgtcggccaaccgcacagggggtggtataacagttggctatgggcagcgacacgggattataaagcacagttattccgtcacccacagaagacaaacagcaacatggggctgatttaaacagcactccagtagcccagaaggcgcccgctgggtgcgaacattatgggacacacacagggcaaaggaccttgacgattactctggcggtgaggcaacacaaacgcttgggtacgcgggtgcgactcacaacacatggggctgtcgggcacaacgacacgtcatacttcatacacgggcttcaagtataagccccgccaacacaacatttgctcacccttatcaaaggtgactttcacattaatacacactggttcgtggcacagcggaaactatccctcgaaacaagcaaacgtgagcggtcacagacacatacacagggacgcgcgcctcaccag

SEQ ID NO: 668776 - DNA, 135 bp, Homo sapiens
gccttgagacccagaagggagcgaaggtttttcctgccccaacgcagtgaccgaaaggctttccgccttaacggccggccgttatcctcgcctgcaagatgggcccccactctctgggcttctgcgctatataca

SEQ ID NO: 668777 - DNA, 829 bp, Homo sapiens
agcggaggcgactctcccgtggcgccatggcggaatgcagaggacggcaggaaactgggtcccttgaagaatctacaggatgagtctgaggaagaagagagcgaagaggaacccaagactagaatgtatgaagaggcttatccaagtggggtaactgaatatacttcaaaaggatgcaggtagctgtcatgacagatccatgacaagttttgtggcatttgggcacacatgatggcagaggtttattgtacttgatgtccaggggaacatcactcgagaagttgcgatgtaagtcgctgtgaagataaatcagattagctttggatgaaagtggagagcacatgggtgtgtgttcagaggatggcgaaggtgcgaggtatttaggactggtattctggagaagaattgtcagccgagactgttgagactgtcccattaacaattattagctgtgcgacccacattgtcgtcgagatccagtggcaagcagttgtgtgagcggagggaacaagctggctactgtttgaacggtcttggatgagcagatggaagtctggcgtgttctggatgacaggggaacgggatcgctaaaggagtgtgaaggtggagaggcatctgattgcgttgggccgaataatatgggtgtgaaggatgatgacatgcatctcatagagcaaagacatcaccaggtgtgccccggcgagtgactataagtcttcaggccaggacattgtatactctggaagcctctgctggaaagggcccaaggtgcacacgtgattatctgcgtgggggggaaatctgtcaaagggtgtggtcagtgaaggac

SEQ ID NO: 668778 - DNA, 323 bp, Homo sapiens
  misc_feature (277)..(277): n is a, c, g, or t
atctagaggatctatcctggtatcccacccatgaaaaaaaagatatcatcgctggtcattggagaactgcaaatcaaaaccacaatgagataccatctcatgccagttagaatggcaatcatgaagagtcaggaaacaacagatgctggagatgtgaagaaatagaaatgcttttacactggttggtgggagtgtagattggttcaaccatttgtggaaaacagctgtggagattcctcaaggaatcgtagaactagcaaacacgcattcgacccangcaatcccacttactgggctatatacccaagaggattatgagctcg

SEQ ID NO: 668779 - DNA, 960 bp, Homo sapiens
aaaaaaaaaggaaaagagaaacagagaagaacacgagacgacagacagtgacagagacagaactcggcgaagctggtcgggcggacacagtgtgatcgttccctgtcaacccgccgcgagagtatgcccccgcaagtggcaggttcccgtcgcacaagcgaccatgtgtcgctccaaggccgccaaccaggtgcggggactggccgccgacacccccgtgtggtgtgggggccgccagctgcctcttggaggtgcgacagaccgctggggaccagtccttttgggaggaaactaaacgaacacgcggtgtgggccaaggaacacacaggggccgtggttgtcagaaaaagcaccgcgcgcttcgggagataacgagaatctataggcgtgccggtcggacatgggaaactgtttcccccgcgtccctctgataatgctggaatgttcttgcaaccacacgaggtacttccccgcgacacgcccaagtttttccccgttgagtgcggcccgccggtacattttaagcgggtgtctttaggtatcaacactaggtattacccgcaagcagggaaacaacaccggcgcggggagtagacccccacactggtagatcttcttacagggaggtgaaccacctctgtcctaaattgctcctccaaagtggactagtcccgcttgttgcacttgttataacccgcttgggactccaataagtcgttatgcagccgcttcatgaatcacaggatacccgcacaacaccggagaaccttgtgagacacagaaatccgcacgctgaaataattggtctttagatcgagactcctcgagctaaatacacgccgtataatcttggcggaccactcatcactgcatggcaccaccaccttaaagacaaacccgaggcccgtttgtatccgggaaaaacaaatggggagatcacccccaacaacaaaagacagc

SEQ ID NO: 668780 - DNA, 334 bp, Homo sapiens
taaatccctcaatctggagtgcagtggctcatgcctgtattctaacactttgggagggcaaggtaggaggatcccttgaggcaaggaatttgagaacagcctgggcaacacaacaagaccctctctctattaaaaataaatacattaaaataaattttggctgggcacggtggctcacgactgtcatcccggcactttgggagcctgaggcgggcagatcgcgaggtcaggagttcgagaccagcctgacctacatggtgaaaccccgtctctactataaatacagaatttagcttgcgtggtggctcgtgcctgttatcccagctactcagga

SEQ ID NO: 668781 - DNA, 444 bp, Homo sapiens
acacatgacccttacaatatggtaccatatgatggtagaagaagcgaatggagagcgacgaaaggatgggctgatcaggaggatcatacttacttctgtagaaataacaagaaaccagtgacccagctatagtcatttgctggcacgcaatgctgaattcaatagtccagatgaggccaattaaatggtacgaccacatgtaccgactgcccgaacggggctatataatccacttggacgacttccataacctgggcagctcctgcagttcccaggctcagcagacacagccacccagaggcacccagaagaaaatgcggatggcaaatgtccacagtggctggaacagcaggaagggagcactgctgatggctttatttgtgatctggcaaagactcaactgtcagattttctcctctttctgagaccaacaaatcaagacga

SEQ ID NO: 668782 - DNA, 496 bp, Homo sapiens
cacgtagcccggccgtacgcgtaaccgcataagattactgcaggccaactactcatgcagcataattggaagctccaacacgagcaatatcaaccattaaccttacctctacacttatcatcctcacaattctaattctactgactatccttgaaatggtcgccaatccgcggattggcgaccattccaaatagacaagtcgtcatcagaggttgataagttagtgctaaacagggaatcaaaacaacaccgtgctaacacaaaacacacataagtacacagcacacaggttctataaagcaactatgcaatcaagtctacataacaaccatcacaaaatcaaaatctcacatgtcaatatcaaccctgaatgtaaatgggccacattcccccacttaaaagatacagagttgcacgctggataaaagagaagattcaaccatctattgtcttcaagagatccatctcacatgtaacagcacacccaggctcaaac

SEQ ID NO: 668783 - DNA, 263 bp, Homo sapiens
accaccgcgtggttctcaccagttggaagtcgcaggccttaggttatcgaggtgaatggtttcgccggccttggtactgatcgggatctcctcggctttgcagcgcaatacgtcagtgcctacctgatcggaccgcgccattttcggggtaggctggctgatcggtccccgatcgcttaacgtgctgaagtccagggtcagacggttaccctggaagccaccgaatacccccagatccttccaggcctcgtcccaaatctcga

SEQ ID NO: 668784 - DNA, 839 bp, Homo sapiens
cccgcggtcttctctgcaaatgggctccgtggcctagcgcccccgtccccgccacccgtgatcgtgcgccgaggccgcgaggggtcgccgccagatcccaccagccagcaagctaaagcatggcggcatcccctccagcggctcgctcgtggccacccacgactactaccggcgccgcctgggttccacttccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagccctccgcgcccgatgtccccatcggatcctcgccctccaactcccaaccccccaccgctgtaaacttagggcgggctgcagtgcaagcagaccttcgcatcaacacagcagacaccaaaaacccagtgagagccccgcttctcttatcgggccgcgggccccagcacttcggcatggcttttccttgaccacctggaacttgtgccccttgggccacccaaggccgggaatacacttaaaactttccaaatggcacggccagcgtacacagcacgctacatgaaatcgcaaaacacagccgccagccgcgattcatatatgtccgagggcggtccgcagcacaaaaccgcgctcactgagcacagtgggcacgttggccacatagcggtgttcatggaaccccgagttttgtagtgcaccacccgggggaagacatctacgccgggccccccatagttgggggagccgcgattcattttcgatagccccgggtaccctgt

SEQ ID NO: 668785 - DNA, 1696 bp, Homo sapiens
tgtttgggggtttttcactcatctcctcacactcctcgggagtactacggggggtttctggaaaacgcgagggcaagggcagccgagccggttgtcttttctcctttcttttaagggcgtgtttcttcttcgcgggtttcctccgaggctttcctagttaattcttcagcgagcgcggttctcctcgggccgtggaaccgagttggcttctccttgtcagtgagcatctccgagagattctctattgctgcggggggatactctctctctcgcgagtgcttctctatatagaaggaaggacacgagagtgcggctctcttatcagagctgtggggtttcctgcgaagagagccttctctcccgcgagaaatataccagcgctgcgggggggggccacactctacgagagagaaagagctgcaaatctcgagaataatcgtgggtgagagggggcggaaaatacgtgtggaggattgtgggtgtgtgtgcgcagaggggagtatatggcgagagagagaatgtgcgggggcgctatgtgtgtgtctcttgtgtggggaaaagaggtgtagcgtctcgggcgccaaatgtgagagggggtgggggagtgtgtgaaaaaagatgtgtgacgtctcccatatatatgtgtgtggggcgggtgtgtgtatcacccaccctgtgtgggtcctatcaacgaggggggggcctctctgtgtggagacaaaactggtgtggcgctgtcccccctattttgtggtgtgtgtggggccccgcggtgggggaaaaatcttcaaactcttcgagagcacacaccgcgagagagagcgtgtgggccaaaatcacacgccccgccccaaatatagggccgagagagagggcccgtgtgataaataggggagctcacagggggagaagatcccgcgtgtggatcacaagggcccaaggagtggggaagcaccccgccggggacgcacggacgcagtccccgccgggccgcggtgggcatcattagggagaggcctatatatacggagaaacctcgctggcggcggcatcaaaatttcacaacgacgggggggctattttcttcttattcgtcggcccccgatgaagggggggggccgcacaccaacctttctttttttccaccacaagggtgtgtgggggaggagataatacaccggcacggcagaaagaggagaggggggcgccgcgggttggccaaccacaggcaaaagggggggcgccttctagaaacacacggggtggggggattgtgggagtggaggttcacaccgcagaggggaaacaacaacgaaagacaactcaattgcttggtgtgggggtcaacccgttcgggggctggctgtggggcgcggacaacaaagaaaaaaagtgttcccagccgttgaggggcacaccaaaaacatcgttggccgccagcgtggagttgtgcggacacaagcaggaacacccacggtggtggtgcgcgggggaacaacagacaatcactcgtcgggcgcctctgcgggggtgattacgccaccaccacagcggttcttgggacggagatggagcacccctatggagggagagggagaccatcacacggcgcccaggaatagacaacagggggatagacaagcacactcacaaacagcgagtgccccccagggcggggggagagcagtggtcccac

SEQ ID NO: 668786 - DNA, 169 bp, Homo sapiens
  misc_feature (20)..(20): n is a, c, g, or t
  misc_feature (138)..(138): n is a, c, g, or t
acccccctggcttgaaaaantcccctaagaagcctaatttccagaagccccggaaaaaaaaaaataattccaataagttggcgccaagaactggggttagctttccaaaacaagcttccacaggtttaaaaggaaaanctgttgcctgaaaatggggtttgggtggggc

SEQ ID NO: 668787 - DNA, 365 bp, Homo sapiens
acggtctcaagggctatagaggagatgagggtcacaggatgtcgtatgtctaccgggtgcgtagtacggctagagtgggagatcagctctttattaaagtgaatctgcttttcaatacagaaaactaagttagatgacagattcccgaatggtactgctgtggcaggcctctgggagagtgttcccagggggctatttgggtaagttggttatttttcagtgccttaccagcaatcagtgtcagggtgttgcatttgaataacagtctgaggtaagagtcaagtggggctctgctcagtaactgacaggctggatccggggaagcaaccgctgctgcctagatagggaacccttctacaggggca

SEQ ID NO: 668788 - DNA, 782 bp, Homo sapiens
ggagagagagaactagtctcggtctagggggggtgtttttccagagtcggatctgattaattggttacccaaaaaatcttatttcggacgggatccagacttaaaagtaaaagctcgcaaagaggaaagtcgggtctcttcgcaattggtccctgggcgcttctccttagcctccttcattctctgggccaaaatgtttagcatattctggcagcctcttcttaattttcctgggtacgctgcttcttcagagcaatacgccgccgttggtggctgcaggacccgtggagtacacaagaccgctgaatctggggtgcgcttgggccctaggtttcttcaccttctttaattacaaggggctttcttacaacatcactggggggactatcatcttctttcaaagagtattgaaaatgtttggcggatacctggctaagctcctttggggggcccaggcggcgaggccctggtagttatcagtcatgtcccaggaatatccttctctccctttttttacaatacccaatgttgaaaacgctccagattggcttccacaatgcaaccagggaacggatttcctcttatctttctccagttctcctgggtctgtaccaggaatgccccttactcagtagcagggggacacggccagggcgtcaagaaaccctgcttcagggcggaaaccttgtttggtcgtcccaccattgattcggaccaattaacccttccattcttcacccagagcgtcagcagcaatttctggggccatacgttctcataga

SEQ ID NO: 668789 - DNA, 310 bp, Homo sapiens
gtgagggtaatgtgggagctgaggtataaatgggcctgtgtatccccttctcccggcccagctgctccctcctgcctgctgcccacaggtctcctctgtccctgtcctctggtggttggggatggagcggcagaaaggggttgtaatgggggctgggctctgtcttctacaggccaccccgaggtcctcagtggtttgctggggagccggacggggccctaaaggggtacaggttgggtgggcccttccctaagagctctaggggctcagcgctttggccttctggttgccttctacagttcaacccaag

SEQ ID NO: 668790 - DNA, 547 bp, Homo sapiens
gagggcgatggtggtacacgcctatagtcctagctactagaaaggctgagtgggagaatcgctgagcctgggaggttgaggctgcagtgagctgtaatcacaccaccaactcagcctgggtaactgagtgagactgcctcaaaacaaaataaaaataataaataaaaatggaaacagtctataaacctttttagttgttgatttataaaaaatcaaaacatacagattattactaaagggtttagctttggaattgagtagttgaacaaccacttaaatatcctttctttgtctaagaattttacagatataaactgttttgaatatttggacttggtgttattaccaagaaaaataataactgtaagctcacaacctcttcttatgaaacagtatagagaagtcacactgtaagtcttgcttgccctgctatgctactaggcagtatgcacaggcttttgtatgctatgatatgcatattccattccaagtcgtgacaaccagatgcaaagaatgtgcagcactcatcacttgttgtctggaatcc

SEQ ID NO: 668791 - DNA, 172 bp, Homo sapiens
aacccgggtacgagcttcatctctaacgcttcatgggtgcatttcgacagagttttacttccgtttgtaacgttgacttggagcaaagtgtgaccactcagtactcgggtttgaataacaccagtctccaatcgtgcccatctacgtgaacctatgtaccacattgaccact

SEQ ID NO: 668792 - DNA, 431 bp, Homo sapiens
tccccacgatcaccatatttggcatgctggtctcgaactccttaccttgtgatctgccttctctatggacctccctacagcgctgggattacaggtgtgagctaccgtgactcagacttatgacccactttttaatgggattatttattttatatacttcttgaattaatttcctgtatagattctggatattagacctttgttggatgcattagtttgtgaatattttgtcccgtactgtaggttgtctttattctatacattgtttcttttgctgttttgagtatctttacattatggtattcagtatttgtgttgtacttttgttttagtactttatcctaattattttccgaaggtaaatttccataatggtgttacctgggttttcttctaggaatctaataagtaagaggcattctgtgtaaatc

SEQ ID NO: 668793 - DNA, 748 bp, Homo sapiens
atacgcactgtcttactctaagcgccacggggattaacgtatcaaggaggacgtgtgctgatggtctaatctactacgagtaacttttgtacttctcctggtcatgtgagtagtttggacgccgtaagtgatttgcatttgtttacatgtccgacattattcacataaataatgtcgtgtaacaagaaaagaacgataaatgaagccaacatgattgttctcatttcgggaggaactctgttgcttcgcctggacaagtcaggcaaaatgctgatttcctccttgggtagaaagagggagtcgagggcaaatggggtagtagagagaaaacaggcgagatcaagcactctaattccagtgggctttaagagataagacagaatatcagctttacaacaatccctagaggctcgaccacagaataatgccagtcaccaccctgaacgcacaatctccagtgcaggatctaatgactgtactatattgatcgttagtattattattgttattattgttgttctgtaaacatcgcttgcacaagcttagcctttttgcgttctgttgtgcgtgcctgtaaaaccccatgctttgtgaaatgagaatcttgacatttttcttgtgaaatctggaaaatgtgagtcaattgccatcaagctgtgtttagtgttctctatgtcaaagtttagttttatattgagaatgttaacttattgtttactccgcggggggcagaaatatatccgttgtg

SEQ ID NO: 668794 - DNA, 842 bp, Homo sapiens
  misc_feature (283)..(283): n is a, c, g, or t
agcgggggaccgggaacggggagcgcggctgccagcacccctgagccgcctgccggaccctccgtcgccccgtgggctggcactccagggacctgagggtcccctggatgtgctcccgactatcgagcgcacgttccagaatgtgctcatcgatgagctaggcgagtacgtgtgacgagggggggccacagaggatgggggccgtcgagggcgcccctgtgcgtgcgccctggtgtccccgtcccggcggcgatgcgctccttgggcgtaggatcccccccgntcaaggggggggttgggaggccgtggtgttcccattggcggcgggaggtcccccaagcactgggcctcgggaatgcctggcggtgtggacccgcggcgcgctgtggggtgtggggcagcgagtgtcgcgccggctcttggccttcctgggcgccacgcgcttttgggcgatctagtggcccgtagggggcgcgggaccaaggagagcccttgctgtgtgcccccgggggggaactgtctgcactccccgcgggggggcccccacggacatcatggggccgggggcacccccaggggaagcttgtacgacccacgccacaatccaaggtgggaaatgggggcggcgtgcccaggtacatgccattgaagacattggattctccaaaataaaccgctagggacagttcgggtggcggatttgtacccccgtgtgagctctcatgtgcaatagtgtgttgtcccccaaaaagagagcgggttgtcccaaaatagtttagccaaatggacccgtaaatggtccccggtaacttgtgtcgtgcacacagaaccgatttttcccc

SEQ ID NO: 668795 - DNA, 1035 bp, Homo sapiens
ctgtttgtgttgtcggccttattgtcgctggtttgtactcgtgttgttcttgttttttctctccctcctcgcgttcgtgtttcttgtgtctgcctcggcctttgttgcgtctcccccgtgcgtggtatcggcgttggctcttgccctggccctcccgtgtgctgtttctcagttggcgcgtgtactcatccgtgtgcggtcgggttccgctattttccccgggcttgttggtctttgccattttgtgtacccttggggccttttgttgttctcttctctcgtctctgctgctcggccggattcctgtgactttgttctgattctaaatgtcccccgaggatttacctagccaatttgtccaaaaggtgagatcctgagatgatttggtcaaattgggataaggccccgccatcggcattgtaacaagcaccccagtcactaggatccagatggacccccacctttgagaaacccccccccgtttcgaactttttgcacccttaattttctctgttcctgagcccccccacttctctaggagaaacttagaggaaaagggcaccagaccactacatatctaaagctttggaccagtccttgacctctataaacttcagagtcctccattataaaatgggaagactgagctggagttcccgccagtgatgcttttagttttaaaagtctatgatctggacttcctataatcaccaaataccaccaatcctcccaagaatttgacttggaaaaaaatgtccaaaggaaaaccaggttatctgccccatgtgcatatggcaccaaccttgactaccctggcctggcccgtggtgcgccagtcccgggctatctgtactgtttcaaagaattactttgtagttgacaaccaccaaacaccaacaccaaaaaaggcataaaatgccagccggtttatagaaaaaacagcctggtattctcccagttaggtatgcccagagtcccattctttttaacagctgtgagaatttgctgcttcattcccaaccaaaattttattta

SEQ ID NO: 668796 - DNA, 142 bp, Homo sapiens
  misc_feature (90)..(90): n is a, c, g, or t
tcgagacccccatcacagcagtcgcggcaggcttggcatatacggaggatataaactctataaatatttatccagaaacaatatcgccgnaagatatatatgggtaaactcactctacttagactctacttatatggcttta

SEQ ID NO: 668797 - DNA, 231 bp, Homo sapiens
cggcacgagggaatgcggcctttgagtcatgaagactccatctccatgtgaccgaacactgcagctgtctgaccttccaaagagtaagactctcggcaggttctctttgagtcaatagcgtgttttcgtccatctgttgacaaatgacagatctttttttttttccccctatcagttgagtttttttattgacagataacttctttaggggaagtaaaacagtcatctcga

SEQ ID NO: 668798 - DNA, 337 bp, Homo sapiens
atcgagctcgctacctgttagtagcaacaacctagggtcagttttgcatgtggtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 668799 - DNA, 211 bp, Homo sapiens
  misc_feature (37)..(38): n is a, c, g, or t
cacggcaaaaggaatagtcagcagagttaacagacannacacagagtgggaaaaagtcttcacaatctatacatctgacagagggctaacatccagaatctacaacgaactcaaacaaatcagcaagaaaaaaaaattccatcaaaaaatgggctaaggacatgaataaacaattctcaaaagaagatatacaaatgaccaacaaacatat

SEQ ID NO: 668800 - DNA, 162 bp, Homo sapiens
gtctgtagcactgatgttcagctcgtcgttgtttcagttaagctcaatggcgaacatgggaaccgagctttcgccttcccgtgggggagaaaccctctggctgatggctttgccccggaattatcaaacagccaccgggtgactttctggcttccacatcca

SEQ ID NO: 668801 - DNA, 363 bp, Homo sapiens
aagcagtaatacagactcagtggttgtctacccttgatatggttcagctccgtatcccacccaaatcccatgtcaaattgcaattcccagtgttgagggagggacctggtaggaggtgattggctcatggcggctgacgtcccccttgctgttctcatgatagtgagtgagcgctcatgggatctggttgtttagaagcatgcaccacctcccgcttcactctctctgtctctcctgctccaccatggccagaaacgtgcctgcttccccttcgccttctggcgtgattgtcagtttcctgaggcctccccagccatggttcctgtacagcctggaggactgtgagtctgtattaactgcttg

SEQ ID NO: 668802 - DNA, 287 bp, Homo sapiens
gctattattttcttctgcataaatgtacactcatttcattatgtgccttgctccctgattgtgcaaagctatatatatacacacaaatatatatatatatatgagagagagatatattcattcagtactactgatgtttttttttgttctactgctggattaagttattgtctgagttacacttgccacttgtcataaactattgtaatggcttaggacagtggtcatatagccagagtaaatttgtttttccagtttcattattttgtcatctatcccaattctta

SEQ ID NO: 668803 - DNA, 177 bp, Homo sapiens
gtcgacgctgagaaacagattaggccattaacgaaaaaagttgtggccacgtgtgtgctcacgcctatagtcccagcactttgggaggccgaggcagggggatcacgaggtcaggagatcgagaccatcctggctaatatggcgaaaccccgtctctactaaatatacaaaaaaagt

SEQ ID NO: 668804 - DNA, 339 bp, Homo sapiens
cagggcattggcatcggttggctattgttaagactacggaccttgttagactatggaccttatgcagctttcagtgtctgtatgcgctgtgtgtgcattctacgcaaggtgatctcatgtgtagtatcttgtaaccatctccacccctgccattgccatagaactgtctcgtcaccgagtggaactcacctcccttgtgattctccttttgagcctcatccccacacattgcccgtgtgtccttggcagccacaaatcccttctctgttctccatctctagttttgtcatatggaggatgttatgtacatggaagcgtgtagtgtgtaaccttctgtaa

SEQ ID NO: 668805 - DNA, 199 bp, Homo sapiens
acagtccacgcataatatgtcagtgtatgacaaactgccaaactgtatccagagatggcgtactatattatattcccaccagcaataagtgacctagtttttctaaatcctcaccagcatgtggtattgtcaaagtgatcttttcatctaaatgcatatatatacatatatatgtgtgtgtgtgtgtgtgtgtgtgtgt

SEQ ID NO: 668806 - DNA, 181 bp, Homo sapiens
  misc_feature (45)..(45): n is a, c, g, or t
  misc_feature (95)..(95): n is a, c, g, or t
  misc_feature (100)..(100): n is a, c, g, or t
ccaaaaaatttttttcttccggtagcctctcgggcccccccccanaatcccccagcctcatgtcctgccccatccctatcctgcctgatccctgnatctncctcagatcccctcttctcagacagcgccaggccggggtggggccggggttggggccagaaccccacagtcgccccctccc

SEQ ID NO: 668807 - DNA, 407 bp, Homo sapiens
cccaaaaaagtttatggttatttgtgtgggggggtgttgttatatattattgtctttaagggaaaagaagctataagattccctgcccccccaagtatcctttagaaaagtgaagccccaagatttaggttgatgaaaaatccatgagtttgccttttgacctgttcagtgtctgtcttccagcccggtgggtacccttcttcaaaattgtaccccgtttgctaattaaaaatatcttggaaagcctcatggtccctaattttccactagcccccggtattttgaaaacgtgtgtctggatattacctcttgtttaaactgaatgtatgatattttgttagaatggaaaagtactatcttgttaatttaagtattttaaaaatagttgtatatttttcttcctctta

SEQ ID NO: 668808 - DNA, 181 bp, Homo sapiens
  misc_feature (95)..(95): n is a, c, g, or t
  misc_feature (100)..(100): n is a, c, g, or t
gcggccgcctactactactactactgctcgaattcaagcttctaacgatgtacggggacatgtcctgccccatccctatcctgcctgatccctgnatctncctcagatcccctcttctcagacagcgccaggccggggtggggccggggttggggccagaaccccacagtcgccccctccc

SEQ ID NO: 668809 - DNA, 630 bp, Homo sapiens
actctcctctctatgggctctgtgatccactctgggcacagggagggagacccgagagccccaccccagacatcggggcctgtggcaaaaccatctatttgtggggggatttgcattggtatctgaatgcccaagtgagatgttaggctgtctgtggtttctgtcttctcattcttatttggtgttaggtaactcagaaccgactgcagtttcgccatcatttaaatctttatatagacttttccccctgctttttatttgagccatttattactttccttgaaagggaattaattgatagtataatttgaagatttttttttcaggattgggaatgggatttctaaaggctgcaaaatgtcatcactagaattttcaccgtagatctgagaagacacttagtctgcagtgtggctgttgaaaacgttggtaaaacacaaattaacgtatttttactttggttagtgatagcctttcaaatggttattcttacaaatcttttattgtgaaaaattcaaaatacacaaaaatggaacgaatagcatgatgcacccccgtgtaccatcactcagctcagtagtgatcttttatataatctactaccaccagtcattgattcccatcccctct

SEQ ID NO: 668810 - DNA, 336 bp, Homo sapiens
gagagaggatttcgccattatggcaggctggtcttgaactctatgttctcaagtgatccaccctcctaccgtctccccacagtgctgggattacaggcacgagccaccatgcctggcccacagaagatcttttaaataaatattgtatggcctacatctacgcatccctcatcccactccgataaaaaaatggctatatataagtcattacatcatctacggtcttgatgctggtttgcttaattcgtgaatctcttatgacttttacaatatcatcttatgtcacatagggattgtctagggaggagcagcaaaaagtcaccaacagtgcagaga

SEQ ID NO: 668811 - DNA, 142 bp, Homo sapiens
cttatgtgtgccactaagccaaccactttattgactctagccgcagacctcctcatactaacctgaagtcggagtgacaaccaggtaagctaccctttaagcatcattggacaagtagcactccggatctatacttgcatca

SEQ ID NO: 668812 - DNA, 1502 bp, Homo sapiens
taagaggaaaacccggtaagtgagtgttcggggtttgagggatataggaggaaaatgtgggggaatagggtttttgaacattgaggggtgtttttctcggtgttgaatgagggttattagtgtttgtaaagtgtgggtgggtgagttgagccccatgtggtgttgggtggctcaacattatgttcagaaggggagatatgcagggcgtggtgacacctacctcagtggtggaagctcccgtgtgataagatcaggacagacaggtgcactaatctggcactcgaggggagaaacagtggtggctctccttaccccacaagacagagagtctttccttcccgaaatgagggttctaacatcaggtggcgggggtataagcggcgcacaggtttctagcccgcgcgctctgtggctataacacagtttcatcttcacacacagcagccataatctacgtgcgtgtgcactcttagcaagtctttcgcggaagaggtcttctctttttatacacataccgtgccactaacactcgataatcgccgccacatccagatccaacacttcacccgtattctctcgccatcaacccctttctgaacatactaatgctgactcctacacgtatgactcactaatacaacttcactctccaatctctgcacagcccacatcgactctcacacactcccccccatctatgcgaatcaacaatcaatctctttcacacaatcttgccatttgatcttccctctctcgtataccagctcttcactcaactcgactcaccacaccagcacattctcaacacaattgcactcctgtctcaccacacccctccaagctgtcccaccagcctcgcgccactcccaatttgaccaaaaaaaactactttttcaaacatcacatcacccgtccctactctcaaccccttccttcttctctcggactgccctaccggccacgaaactcgccccacgtcgtgtcgctcactctcgcgctcacccctgcccccccatctcttgcgtcacgtagcactccaagcagctgaacagcggtccatacagggccactgtgcgagttgctcggctccactcgcccctcatccaaccacaatacctcgtcattccacaccgcgcgctgccactacgctagcccttctgaacgcctcgtgtccttctcatgtgtggcaggcggactgttgtcgggggtgtctagattgatcatatgtgacacacctcgtcccccttcttttcgcatccatctcctgacccttgagacatttcgtcgacactcatctcatcaatctgtcagatcatccactcttcgacacccctactttcccccccccactctcccccctcacccactcctcactcctcaccacccctcccgacacatacatccgcgtctgacctctctccatctgctcctatctccccgaacaccactacacaatatcaaccgtaccaaacacacgacacatccacaatctcttcacctcc

SEQ ID NO: 668813 - DNA, 141 bp, Homo sapiens
aaaaaaaaaatttttttttatgaatgttggttttcctacccaaaaagatggaggggttaaaatttgggtatgatttttatgtttttttaataaaaaacccttttcaaggttattttcctaaataaacctcataattgtgga

SEQ ID NO: 668814 - DNA, 932 bp, Homo sapiens
  misc_feature (863)..(863): n is a, c, g, or t
  misc_feature (887)..(887): n is a, c, g, or t
  misc_feature (926)..(926): n is a, c, g, or t
ccctctccgcgccgccgccggcggcctccgcgcgggcctcccagcccttattccactcactttgttctccgcctttgtcctaatccacaccagcaggtggagccgcagttaaagtttccgagtccattccgggagcgggagcccatcttgctggctgccgaggccctcgctggaggaggagggtcagaactcgggtgcagccaatcgagggcaacgctgctacttatcagagcagaatgggctgtagtttagtgaaataggaaagctgcaaaacactgtggagtgctcccgtgtaaataaaaagaggaaaaaagtttctcaagtcgccgctgcacgacgtctggccggcgctggagcgggggtctgcgctctcccgagcggccgcgcgctggactttattgtgccgcaaccagccccagttcccattgtttgtgtttttttcaaaatatggcaaaggttcaggtgaacaatgtagtggtgctggataacccttctcctttctacaacccgttccagttcgagatcaccttcgagtgcatcgaggacctgtctgaagacttggaatggaaaattatctatgtgggctctgcagaaagtgaagaatacgatcaagttttagactctgttttagtgggtcccgttcctgcaggaaggcatatgtttgtgtttcaggctgatgcaccgaatgcaggactcatcccagatgcagatgcagtgggggtaacagttgttctgattacttgcacctaccgaggtcaagaatttattagagttggctactatgtaaataatgaatacactgaaacagaattaagggaaaacccaccagtaaaaccagacttttctaagcttcaaaggaatantttgggcatctaatcccagagtcncaagattccaccattaactggggaagataatacagaaanactgga

SEQ ID NO: 668815 - DNA, 124 bp, Homo sapiens
  misc_feature (1)..(1): n is a, c, g, or t
nttgctctggtggtatcctccttgttccaatgttctaatgcctcagttaactccacctccatagcctgcacagtttcctccactagctccagggttatgtggcttcactgtctgggtacagtga

SEQ ID NO: 668816 - DNA, 1034 bp, Homo sapiens
  misc_feature (312)..(312): n is a, c, g, or t
agcggcggggtctgggtttcgtacgtagcagaacaagctcctctcgggcctctttcattattattattatgatgattattattatcatttgtggagatggcgtctcgctctgacgctccaggctggagtgcaggtggtgcaatcttcgggctaacatgctgaccgtccggcatccctgggtttgtagattacaacttgctcctgctcgtcatgtcttcagcggatgtagctgcgaggacatacgaggccggctcgccgaggcactacctgagggtacattgatcgatactctggtacctggtatgatgtggnctttgcaggtaataagttggctacaaggcgtggggcatcacatacatgcctgtgacgcttgggaggtcgctcgcaactcgagtgcatcacgtcacgtcgccagaaagtgacaagaatactagcagagcggctatgagggcgcgtctcgctaccgatgggtcgtcgagagggattgagtgaagcctgggccatcttggaattggggtaccaagtaaaggtatgcaaagtaggtcagggttggacagcgagtagatggatcgtggctcattcgcggtataaacaactagttccactggtagccagcgtttgtcgaactgactgttgagtcgaagctggggccatttccccgatcgtaagacactttcttgcattgcgctggaaggcgaaggtggaaacctgattctgtaaatgggggcagaaaagtggtttgaagcacaacgcgggaagtacgttgcaactggtaccatttatgggatcctcagatgtatgcgggttgggttgtggaaggttaactagaaagtagttggatgcatgttggcgaagagtagggacagttgtatgattgggaaggtggtaatttagtcacaggaagtgacagtgaggggttggtagcactgaagaggtatgggtgaggacaatgaacatgttacagcgatgatgagggaatagattagggttcaaggaaccaagtgggggaagaatttgaattggaaagggataca

SEQ ID NO: 668817 - DNA, 398 bp, Homo sapiens
gtgccttcctcagcagacctgtgactccggccctgtaagccgattctgagatgatggtgaaaggctctggcttccaggctgttgagctgctcacgactgcacctgctggggagctgcctgagccaagtgcacagaatgccatgtggaggagaaccgtgctcacctgtcaacatgtcccgatcaccagacacggaccccgcatagcatgcaccgcgagcaactagcgtgtatctataagacaggtagctgactgacctctacactgatatctagagtggcggttatacggcaggaggcattattcggaattctgccggtaagctccatgtccgatatgcgtacacaattggcgatatccaagcagggcaattggctcttcaatgttccctcctcctgcg

SEQ ID NO: 668818 - DNA, 690 bp, Homo sapiens
agggggtgccggtagttatctttctcttcctaacagtatgtggatgtggcacgctctctgtgtgccccagctcactggtggctctgtctacaaatatgcttcctttcaggtggagaacgaccaggagcggttcctgagtgacctgcattaatgaatcggcaagtgaagaaaataagagaaactacggcagcagaccgaggggaccattaagaagctacgacgtgacgaccggaaaaggcagagatgagagaagacagcacatgccaggacgaagaacaaggcggcgcgacacacacccaccaaacgacacagccggacacacaacagaaaccgcccaggccgacacagacccaacaacgcaacacacgcaacacaaacaaccacccgcgccacgaaagccagccaaaaacgggaaacagacgaccaacgacaagagaacagagggagtgaagcagaagagaagagggaggaacgagaggtggaagaaaaaggaggagcgaggagagtaaggagggacctaggcgacccggaaagccagaaaagcaggcgaggagaggaagagaagcgcacggagtaaaaaagaggtggacaagcacgcagccggaaacagagaaagaaacacatgagcgaaaacaagaagccgtcaacacacacacacaagagcagagcaaccacgcaagaaagagaaca

SEQ ID NO: 668819 - DNA, 1202 bp, Homo sapiens
  misc_feature (461)..(461): n is a, c, g, or t
  misc_feature (517)..(517): n is a, c, g, or t
  misc_feature (526)..(526): n is a, c, g, or t
  misc_feature (531)..(531): n is a, c, g, or t
  misc_feature (537)..(537): n is a, c, g, or t
  misc_feature (1154)..(1154): n is a, c, g, or t
ggtcgtactatgccctgcggcgcgagcgcggggcggttcctatcgcgcgctccgagcatgagccccacagtcgaatgggcagcgcaggagctccagaggcatcgcccgtggggcgactgtgaccggccggaggtagggccatgcgaggagcattccctccgccgaagggctgatcggcctatcgcagtaatggcgcgacgctgcaaagagcaactgggagcactttatcgccgccacggtggtgacaggggagtcgtccctcacgtgtgtgaaccggaacaggcatgaagcaaggcggtggccatctgtgagactgtccaatctgacgccagtctgacgccacttagcctagggctgctgacggccgaaggagggtagggtcacccactcctgagggaagcaccacccctatacgtaacgaacgaaggatgactgtcctctgtttcaccgggaaggcactncttcacacagtttgaacgtgcggtgcactgcgtagcgtttcacacgcagtgaaaantcgcgcaanggganagcggntgggagggaattgaaagtaactgtaatcctgcacgcatctcattgagtctcggacgagaacgcgtatacagaagcaacgcgcagggcacgcgagtgggtaagcgaatgcgggccggatctgaggggcgcggatggcattggtcgccccttcgtatccggccggtacatggggacagcggggcccgacatgggccactctcgctcgaatgagagacctcgtggagaacgaaccggggggggtcaaacgcgcgaggcgacccgggatggccctccaagtcggtacgggacgtggacgataacgaacacggcaatccgccacgcggacggcccaattcgcttgccaggtactgcgatccctaggtctcgcgtccggggggaaccctgtgaagcccgggtagcgttacccctttccaattggaagagggacttcccctgccattcgatgacagccagaacgtggcatgatcacgggcttttccgtacccggcgcgacaggggtcccgggatccggagcgaaacatattcgcgttggccggcagaaccaattcggagggcgaaggaaaacggtcttggttgcactgtagcgcggttcctgtggcgcccctggtgaaactctntttcgggagaggccacacggtggaagggacatgtggcgcccaaacccg

SEQ ID NO: 668820 - DNA, 704 bp, Homo sapiens
cctgtcagttatcgggtgtgaccgccgcggccagagtatgtctctgtgggaagattctgtcctccgtccatatgcgaccatgactcgcaggatatctctacgttcaggcagctctgggttgactactggcaaaattgctggagctcggcctgtttgtttgtgggtggaggtattggtggcactatcctatagtgccaaactgggattcccattctccgggaaagtgtatgcagaaaaccataggcttatcttcatgacaaaactctctcgaggatggttcttggtgcctgcagcttatatactgttccatatgccaccagcaccactccgattgcagtgcgggtccactaaaacatctctagtgtatcagaagtaatgaacagaatctacagaggctgcctcacaactccaagatagcaatgagggagatactccagcttcagcgaacagcaggtgataccctgtcggtcccaggccctgcggttcaggcctgaggacctcgtttccagaaaccggatcaccctgaacttggtgacggaaaacccaaagctgcgcttgtcgagaagaagcgtcctcatctactataagggagcgagcactgaagaagtggagtcgcgttgccacaggacatccagacagctaaattgggttctagccagagctaaaaagccggggaaatgaggtgtaccgcagtatgcaccaag

SEQ ID NO: 668821 - DNA, 242 bp, Homo sapiens
tgttttgggccaggagactacgttctgggacaggatctgtgctggagatgtcaccgtgaggcattagctggatgcagagaggccagtgtgaggcaagacctggggctgtctaaagctgctgggagacacgcaaggaatctggacagggaagagttgccactgaagacgaaaagtttgggcctgtgaaaggcccttggtgaagcatgtagcttgtggcttaaaagagtgcgcacatggtgttg

SEQ ID NO: 668822 - DNA, 159 bp, Homo sapiens
catgatccagcagcagtcccatatgtcatgaaccgacgggcagtaccctctctatggtacatatcggatcattgtcgtcctcgcagtgtgccggagggtacgtctctcccacggtacaatcgccgactgatccagctttcgaagtgctgattatcggcg

SEQ ID NO: 668823 - DNA, 422 bp, Homo sapiens
agcttctgggccccagggggatgggatgcacttcagttctgcattcccggcaaggctgggaagggtcccagaaggcttggaagctattgcccacccttcagagttgacagatgaggaaactgaggcccgggtggtgctatgacttatgaagaatagaaggcagcttgctgcagagtgaggcctggcgtctatgtcttttggctctgatcttccttgccattacgttaaaacagagatcccctagctcagctgaaatgcacctgtctctagaaggccccaactcatgcagtgcttttctacctgtcatcttggttcatcttgccgccttcacgttgtccaggtgaaataggaagatcgtctctatgtgaccagtgcagacatggagcagcatggctgggctgatgtgggtcctgcactcaggc

SEQ ID NO: 668824 - DNA, 860 bp, Homo sapiens
atgaaccataaccaatactaccaatcaatactcatcattaataatcataatggctatagcaataaaactaggaatagccccctttcacttctgagtcccagaggttacccaaggcacccctctgacatccggcctgcttcttctcacatgacaaaaattagcccccatctcaatcatataccaaatctctccctcacgtaaacgtaagccttctcctcactctctcaatcttatccatcatagcaggcagttgaggtggattaaagcaaacccagctacgcaaaatcttagcatactccgtcaattacccgacataggatgaataagtagcagttctaccgtacaagcctaacagaacattcttaatttaactatttatattatcctaactactaccggattcctactactcagttaaactccagcaccagagacccgtactactatctcgcagctgaaacaagctagatgactaaacacccttaattccatccacctccgtctccctaggaggtcgtgcgcccgtaactggtttttggcccaaaatgggcattatcgaagaatgcacaaagaaacaataggctcgtatgcccacatatagcacatcacctcttaactctagttctactagctagtctatccagctcaataaatatcccatatctaacaagtagaataaagccgttggacattaaaaacccacccattctgccaaatcatgcttaacagtatctactattccttattatactaagaaagaaaaaaaaaatggggggcgccgaaaattaacatgggcgggcgaagaagaacgcgaacgcgcaggctccaaaggggggggaacggggtggaggaccaacgcg

SEQ ID NO: 668825 - DNA, 1001 bp, Homo sapiens
aagacgtgattcactacgtgtgatcgtacgatggatcctagagtttgacctacgacgagagtgtgttaagtcgagtgctgctggttaacgggcgcatctgtcaatatgatcgaggccctggatgttgtaggggcaggcgtgtagggtggcatggcgcgctgtacaataacagtgtgaagactttgatcggagcgtacggagtggaagtacggtggtcctcgttgttctagcgtctggagtatcacatatattagtgtggcacccacacgtatgagtcatacagcgttcgaggaacctctgtgaagagggactctccggaacgctgtgctgagaggatgcatgacatgtccgtgttggcgcaccatcgtacaaggtaacgacactatgtgtcttgtgaactagaaaaactgtccgaaagtgaagggaagctagaaccacccatgaaaacataccccttgcgtagactttggatccatcggttgacgcaagtacccgcatgttggagaagccgcgtttaaacccgtgccggttcggtgagagaacccagggtcccggggggtatgatccttaaccttgtgtggcctcatttgatggaatacaattcggtagaagggatgcatgtcttggaccggtccacgaatgtcacttgatttccttgatattaggcttagataagccagtgcgcctttgttggggattgaaggtggtcgtagcttaaaaatttatcaggggcactaaccaagttaccttttatgaattctatccctggggcagagaaaagaaggtgtcgcgatttcccattgctttgtacgggttcaattggaccacttactaaaaaaacactctcggtgggaatgacacccggatagacgtactggaggtcattgcggggtcacaattgaacagcgctgtggtcaggggagatcaagatgactaactgttcagccggtagatggtagggtttacccgcgggtagtttgattaaactttgggcaggacca

SEQ ID NO: 668826 - DNA, 205 bp, Homo sapiens
cacacctttgtacagaggtgtacaaatgcctctatgaggatttttcctccagattctgagagtcaaagcagacccaatgtttcaggatacactccagagggtacaagctgggggtggtgaagtgagctggttgccattctgaagcagggaatagaggcattcccatttcccttctttctttcagtgaaactcagggttacagaga

SEQ ID NO: 668827 - DNA, 375 bp, Homo sapiens
ggagtctacccatatagtcgactgcaggcggcgcacattcactagctattatacccgggtcctgggtacgggcaattctcctgtctcagcctacccaagtagctaggattgcaggtagccactaccacacccagctaattataatcgtataatatggtagagacgggtttcaccgtgtatgggcaggctggtttcaaactcctagaactacgagtgatctgaccgcctacggctcccaaagtgctgtgattaccggcataagccactatgcctagcccaaattttcttttatgatcgaccaactcttcacattcatcactcactgttataagagaatcggtctctaagccattacatactcttccaatctatttg

SEQ ID NO: 668828 - DNA, 112 bp, Homo sapiens
gtctgctctacgaggatccccggcacgaggctgcggacggtcagtatttcctttatttatttatttattttgagatggagtctccctctagtcgcccaggctggagtgcaat

SEQ ID NO: 668829 - DNA, 1254 bp, Homo sapiens
  misc_feature (140)..(140): n is a, c, g, or t
  misc_feature (285)..(285): n is a, c, g, or t
gaaacaggtctgccatgacatccatgaatgcaagcgatggcaacaatggtggctgtgaaccaaacgtccatctgcaccaacactgtgggctactttacaagtgtgtgtccactgaccagtcctggtgttttccttggagncaaccagataccagggctgcctcccaggcctcggatcctgccatcatggcactcaagagccaacagtccccatgaccgacatcgcattgcatcacttgtcttctttagaactgcaagtgagtgcagatgatcctgaccagatgtnaacgttggctggcttgcggcgccgtgcggacaatcgggacatctgttgattgcttggcggaacattgtactagcgaagtaactaatcagtactgtgcataacctcatggagccaattgcatcgtgaccccatgacagtgagtatctacagcaaagcaaaatcgacctcggcgaacatctacgagagcaaacgttgccacttttagcacaccgcaaacttctgtgcgcaggcgaaacggactcgccttgattagactccgaattgtgtgatacgcggtgggaccattgtacgtttagcttgagttgattaagctttgactaaggtgagaaattccgtgagtcgaacagaaacattgttccgactgagaccaaaacattgacccatgagcgttggttttcaccccccaaacaaatctatataacccaagctattataagcctccaagtaacttaccgtagggaaatatccaagtagtattggtaggtcgaatggccctttggttgaaccaccattttgtggttccctcccagaatgagtacacctaatacaagcagtttgaaaccccaaagacagagggcgctacctagggaaattgcggctaaaagtttggagcgcacacagtggatcgcattcgcgcgtttgtgttggtataccataactcgggcaaccaggcattggagacacatagcgcggcggcagtttgggtccacttcgtccacaatatattgggccactatgaccatgatagcccacacatattgcccccccttatagaagaggcttccccccaaagaaatcgccgacgatatccatggcaactgaacggcaccacggcgtgtacattgaatgcggaccccgaggcgggacatggatgtgacatggaactatgcgccatttgtgctgacacgcagggcattaggcctcctgtgggaacaacatgtgcataccatcaagtaccgcttaaccgcc

SEQ ID NO: 668830 - DNA, 81 bp, Homo sapiens
  misc_feature (70)..(70): n is a, c, g, or t
cgctgatgcggctcagcggggtgcaacgggtggagtctgtgttctttggtggggggacccccagcttagncagtccccaca

SEQ ID NO: 668831 - DNA, 233 bp, Homo sapiens
atgtcactaggaggagggaggatttaggatggtaagtaggtacagagactctgttcaggccctgaagctgtcccttgcccttcttccccttccctgactgcaggagttatgtggaagtgtgtgtggcagcaggcagcggggaggggaggaacaggaaagcggaaactgggaggtctctgtacctaactttaccatcctaaatccttccctccttctcttctctcccctcccag

SEQ ID NO: 668832 - DNA, 1093 bp, Homo sapiens
acctgtgttgtgtccccttggtaccttgcaaagtgttccgggggcacaagctggtccgggacaccctttcttgttcccggttttagccgggcgtggtgaaagcattgtttcgcggagccctctttcggaccccttttcgaagtttttttgccctcctctgtgcggatttggggtccgctgttcccccctctaagggcaggtttttctacaccccctatttaggggagagtccgggtataaagggtaacataacccgggtgcatcaatcgccgtgtgaccacgttggtgctcgccttctggaatgaagtgtttctcccgtggggtgtctgctgcccgataatatttttcgagagaagttttttcacaccccgggggaccccaattcgggaagtttctcaacaacccctgggaggttttgtggggcccctgtgttaaggggaatgttgtttcccccgggtgcggaaccttgttgggaccaaaatgtcacgtgcttttttcggggagctcacccggcgccccctcttttgttgcgctcccccgcggctttttacccagggggatctcttggggaaccggcgctggagtgatccccgaagcactgatcccgagttaaaggtttatatgggcccaccatcgggtttttttgcgcttcccctttgaagctatttgcaccacccccctgtgaaaattgggtgagaaggttcacaaggaaccccacaggtgctttttctctgattccatacaaggttttctgggggccccattttccggccctttggggaggcccggagagctgttctcgccccaggacatcccgcaagttctcctttctggtggctggaggccgcgccatgagcccccccctttctcccccgccggccacccttccccccccagtgccctcccggctttttttggggagagaaacccctctttttgagggagatgagtgtttgcctcccgcccctgcccactatctggggacccaccggtcacccccttaccccccccaggtcactcccccaccccccaatcccgggtgggaaaccaaaccggggttgtggtggtgatatatacgacctttatcttttta

SEQ ID NO: 668833 - DNA, 244 bp, Homo sapiens
gtcgtagcttaaccaggctgatgctcatgtactgttggtcaggtagatgccctgggagagctggcacagcggcgtgtctgagtgtgtctcgcagggagtgcagcactgaagtggcaaggtgcacagcaggcagagtgtctggccacctgccagggttggtcatgtagatacagggtctccgtccacgtgctgcatgcggcagacagaacacccaagagcgccaggctgattgagcagcatgtgc

SEQ ID NO: 668834 - DNA, 1179 bp, Homo sapiens
  misc_feature (331)..(331): n is a, c, g, or t
  misc_feature (373)..(373): n is a, c, g, or t
  misc_feature (463)..(463): n is a, c, g, or t
  misc_feature (487)..(487): n is a, c, g, or t
  misc_feature (519)..(519): n is a, c, g, or t
  misc_feature (872)..(873): n is a, c, g, or t
  misc_feature (875)..(875): n is a, c, g, or t
  misc_feature (886)..(887): n is a, c, g, or t
  misc_feature (907)..(907): n is a, c, g, or t
  misc_feature (912)..(912): n is a, c, g, or t
  misc_feature (915)..(915): n is a, c, g, or t
  misc_feature (917)..(917): n is a, c, g, or t
  misc_feature (933)..(933): n is a, c, g, or t
  misc_feature (955)..(955): n is a, c, g, or t
  misc_feature (971)..(971): n is a, c, g, or t
  misc_feature (973)..(973): n is a, c, g, or t
  misc_feature (983)..(983): n is a, c, g, or t
  misc_feature (1001)..(1001): n is a, c, g, or t
  misc_feature (1006)..(1006): n is a, c, g, or t
  misc_feature (1013)..(1013): n is a, c, g, or t
  misc_feature (1028)..(1028): n is a, c, g, or t
  misc_feature (1041)..(1041): n is a, c, g, or t
  misc_feature (1043)..(1043): n is a, c, g, or t
  misc_feature (1047)..(1047): n is a, c, g, or t
  misc_feature (1053)..(1053): n is a, c, g, or t
  misc_feature (1065)..(1065): n is a, c, g, or t
  misc_feature (1100)..(1100): n is a, c, g, or t
  misc_feature (1115)..(1115): n is a, c, g, or t
  misc_feature (1164)..(1164): n is a, c, g, or t
gatccaaattcaagtattgtctaatggaggtccgtgctccagaagcagtaactgataaaattttgccaagagtcgagcaagacaattgataggaatatgcagttgcccgtgaccctgaaagtagaccttggtgttctgggaaagcagcagtgagagttggaaaataagttgcaaacccttcaacaggggaaaatgtggatgcggtagaagcttatgctacaatgctgagaagcatctctgatttcagcgcactgaaagaactactttctgggccaaaccgactgaagatccgtattgatgctatgcatggagtcgtgggaccgtcatgtanagaagatcctctgtgaagaactcggtgcccctgcgaactcgncagttaactgcgtcctctggaggacttggaggccaccaccctgaccccaactcacctatgcagctgacctggtggagaccatgaagtcangagagcatgatttggggctgcctngatggagatggggatcgaaacatgattctggncaagcatgggttctttgtgaacccttcagactctgtggctgtcattgctgccaacatcttcagcattcccgtatttccagcagactggggtccgccggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagnncntgggcaaaatnngggccgggatttcttccacnagtcntgntnacgaggagtgggaagnggagggcgcaaacaaatgatgnaaggattggtaggccngntgtttgatcngtcctttgtggggaagcnttatncagcaangaacaaatttcacangtgggagaaggcngntaanttgtantacagcgacccntgggatgggaatcatttcaacaaatcaggggttcngcttcattttcacanatggttctcgaatcgtcttccgactgagcggcatgggagtgcgggggcnacattcggctgtaca

SEQ ID NO: 668835 - DNA, 112 bp, Homo sapiens
gtagacctatggaaggcaggaggaatgagtcccagacacattcttcgtccgtcagttgtgcccaggaccatgacattacctattacttactgtcatctatatgcccatcatc

SEQ ID NO: 668836 - DNA, 152 bp, Homo sapiens
cctatgcttgtgtccaggaggtgctgccagtctcttcattacagtcaggctctgaggttggggaagtggaagtttccagctatttcatccctcatccctgagggcctagaatcagttcagcaactatactaaatgagatgatgtggcttgta

SEQ ID NO: 668837 - DNA, 221 bp, Homo sapiens
cgtgagccatcatggctgagcgcttttagagacgcgcataacgaggcttcggtgacaccaagttctctagctgtgcatgatggagccccgcagaatgagcctgcctgggatggcctgagttcccaggagctgtctggtggccctggtgatgcgccctgaggctggagcccccaatggccagaccagcctggttctgtcctctgtcctgactgtgtcccaat

SEQ ID NO: 668838 - DNA, 931 bp, Homo sapiens
  misc_feature (416)..(416): n is a, c, g, or t
atcccgccactgcactccagccagggcgacagagcgagactctgtctcaaaaaaaaaaaaaaagtttttggtcccccttttggtttggcaggaaaagaggctttggacccaactctccttttattaatattaatactttggaatattttttggtgggagaccggggtctggctggtgttggccagagctagtcttgaactccggggctcaggtgatcttcctggtctcggcctcccagaatgctggggattacaagtgtgagccatcatgctgggacctccaactctcttttactttaaaaaaaaaaaaaattcggggttaaaaaggtggtccttttttggttttcccggtttaacaacgcgggctcctggccgggtgctgtggtcccagcgttgggctcctggaaactccgcggngtttccccaaggggggcgggcctttcacgggctctctgcgccccaccaccccccagccaaaggtttcctcctggagggagacaccaggctccggaaattatttcctggaccttttaactaccggccgagatttccttaaaataaagttcttctctcattataagaaggttgtcccttgaccattttgtgctgcccatttccccggcgtggcttttttcccgttggaaacccttcaacattgtggtccgtaacgggaatctgggtcaacactccttgtggtggccgggcgcgggttcgacccttaatccaagcctgtgggagcccgggcggtggtcaccctgggaccggggaccggctgggcaaagagaacccggtttttaattacaaatttcgcggtggcctgtgttggcccgtaccagtgtgtgccgggtcaggcgggggccccactcgttgttgagctcccaggctgtggcctactagcgacaactcgttggtgcaccccgtaactcacttgc

SEQ ID NO: 668839 - DNA, 501 bp, Homo sapiens
tgcttctgaattgtcgatgtctggggcagtgctttccttacccaccagctgtttagttgcaaaaaccgctaggtgtacggatagtgtaatcattttgaatcgatgcagtagtatatcaatgagtgggatatcttcgatgaatgctctctgtctgtgtttagtgagtctctgccactcttgctgtgaagttgaggtgcgtgtagaagaaaccttttactatgtgaaactttacaacacttgtgagggcaactcaatttggtttatgcgcagtgtagtatttctccaggtatcatccaaaatgcgccacagacaaggctttggtcctcattaggggttgcctcagcgtaaccctctagggctgttctatgaaattggtgccagagttttacatcgaggtacctccgctttgtagaacgtattgtttactaatgttattgaaaccaatttctagttcatactgatgttgttggaaacagcaattaaagtttttgttccatgaaa

SEQ ID NO: 668840 - DNA, 1393 bp, Homo sapiens
  misc_feature (493)..(493): n is a, c, g, or t
agcggacttgtgcaggaggataagccggagctagtcagccccaaggtcagatcccagacttgggatcaccaaagcgagcattctgtccaatcaagtgatccgaatctgcctcgacctggctgggcctggcgccgcttgtcgggaccgggagaagcgtgatgcaagccgtaggaggccttggtatcagctgggctttaccactcctgtgtgagatcttggctgccctctgatagctcaagggcagctatccagcctatctatcgcttgtacgcttcaagcatgagccgggtgtaggaaaaaacgtagacagtctgccttcctctctggaaacctggcgggcgtggtgcacagcacctgcgacatgcacgcttcccgaaagccatcctctaagccatgtgaatcacagcatgtggacagtggtgcctcatcacctgtcatgctgcctttccaggcagctgcgcgcaatgagggaccacctgaccccatggtgggnccctactgccaaattgtgcgacccaattgctatggcacactactgacttccagggaccagtgctgaatggcgccttctgactccagaactgcgtgaacctcgctgtaagagggctgttacgccgtgcatgtgcatcggaggacgcttccgctgggatagactcgtgtaggatcactcgttacatcacacctacctcaactcgtgcacgtaccccagtgacgcaacctgggataatgtgtcctgcttcgcacgtaaggtctagcgagtggtcgagcgagcttcgagttgtgcccgggatgacgaagggaataggacgctatgagcgatttcccctttgggcaaggcaaagaaatatcgcctcaccatttggtacttgcaattgctcaaagcggatgaaaggcttaccttggaaccccaagagggtagttcccccgtgaaaaagaagcggttcgaggcgaagaaatccgcctccggggggatggtcccaacccccgggtgcgttttccattgcaagtgggcccccagttgttgggggaattgaaggaaactagtgcgtaacctcattctgtggtcgcaacctgcccgagggttggcttaatagggcgatggcattccgcgctaccctgcctttgggtggtgtgttcttttcccggcaacactggtacgcgctgacgggtacgcccctgactatcctggtacatgcgcgttgagtgcaaccggattatactttcccgtttcgcggttcccttggtgaaccttgggtcggtgcccccgcacgtggctagtgccttggagttgggttgccccctggcatgtgatccattggggcgcccgcttctcccaggtggtgaaacgggatggaggggggggacctcaccgatccgggggggcgtcctcccg

SEQ ID NO: 668841 - DNA, 430 bp, Homo sapiens
  misc_feature (44)..(44): n is a, c, g, or t
  misc_feature (61)..(61): n is a, c, g, or t
ggctgctctagagtaccccgatgacgtaatcttggccactggcnatgtggctcgtgctatnttgcaaataaagttttactgggacaaagccaagcctatcatttgcaaattgtctataaatattttcatgttacagcaatcacaccagtttcaacatgagacccatcttgtctcacgaagctgcaaaatatctcactatcttggccccttgcaagcacagtttgcccaaacctatagttttaatatacatcacacagcatcagctatctccatagcacacctatctcaccacaacaccattgtggggaccagggaccttcttttttttttggagcacggggtcttgcccctgttgcaccagcgctggacttgtagctggcatgatcagtgggctcacgtgcagccctcagccacagattatactcatcgg

SEQ ID NO: 668842 - DNA, 472 bp, Homo sapiens
atgagagagaacgtgtgcgacaaccttggggaccacctcgatgtcgcactgtctatctcagttcctggagggaggaggatggagagcgggtcgtgactgaaatcaccctgcggtggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttctctctccact

SEQ ID NO: 668843 - DNA, 532 bp, Homo sapiens
agagcagaaattcacattcaagcagtctggtttcagaatctgtgcttgttacaaaagaaaattttgattagtactaggtaagaaagaaatgaacagtgctgtgacagagagtactggaattttctgtgttgagggatactactttaaaggcaacatctgagcagagcactgagggatgcaaagaagccagttaggtgaagaactggatgagaggattggtgttctgggtagaaaatattgcaagcaggccgggtgcggtggctcatgcctgtaatcccagcactttgggaaggccgaggcaggtggatcacctgaggtcaggagttcaagaccagcctggccaacatggcgaaaccccgtctctaataagaatacaaaaattagccgggcacggtggcgcatgcctgtagtcccagctactcaggaggctgaggcaggagaatcacttgaacccgggtggcggaggttgcagtgggctgaaatcgtgccactgtactccaggctgggtgacagagcgagactccatctcaaa

SEQ ID NO: 668844 - DNA, 240 bp, Homo sapiens
  misc_feature (26)..(26): n is a, c, g, or t
  misc_feature (62)..(62): n is a, c, g, or t
  misc_feature (94)..(94): n is a, c, g, or t
  misc_feature (99)..(99): n is a, c, g, or t
  misc_feature (134)..(134): n is a, c, g, or t
  misc_feature (153)..(153): n is a, c, g, or t
tccctatcaatcaccgaactactttnctttttaaagtacttggttaagtaatacttttctgnggattggttagatattgtcaaatatttttgcnggtcncctaaaatgcagccagatgtttcattgttaaaaanctatataaaagtgcaagcnccttttttaaattacataaatcccatgaatacatggccaaaatagttattttttaaagactttaaaataaatgatttaatcgatgct

SEQ ID NO: 668845 - DNA, 635 bp, Homo sapiens
cttgtgtttttccttatgagcaagagcaattggttgagaccaagcgaaccataaacttgctatagtttgggagtcccctctgaaaaaaacatggtctggttttataactatcggtatgtaataaacccagaccttgttatttattgtggggactcacatactatcccatgttaaaggttcgcttggacactcaaaaatgcaattgcacataaaaaaatacactagttttccctggggaaaaaaaattaattccatagcagtccagttaaggcacgtgttttataacatcgcgactggaaaacaccctgggtttgatacaaaatgagttcaatgatacaggtgctactgtccacttaagcaaaaaaaaaatttttttttttccttcagcgtgtttaataaaatttggtcctgtttaccaaaattttttcatttttaaaatccgtctttttataaaattggtctgggctaagtaaattgtaaatccgcaccctgcaggtggggggaggttttttttaaatatcccacatgtcacggtttggtatacaatttggattggtttttggtatcctatttgggaggtggggctttcccctctggcttataggggttttctttcactcttcacctctatactg

SEQ ID NO: 668846 - DNA, 102 bp, Homo sapiens
actacaggatctcaagtatccagcagagaaggaagtttaatcataagcgcgcgaataaggagacaggggaaacctcaaatctgcctgtctgagccgtttagg

SEQ ID NO: 668847 - DNA, 620 bp, Homo sapiens
cacctgctgcagtggctgctgctgctgctgcccacgctctgtggcccaggcactgctagcctggaccacctcatccttgagcctgtagcccagtggccctagagtatctaggtagccaagagcctagggagcaaggccgtttgcagatggccaagcaggcccatagagggcaatatggccaatacaagagcacagctctgggaggaaccattggttggggcagccatgagtagacccataattgcgcaacatgaagagtggctggcacggggaccaaagttcgtgatacacaacacaagttcaccgattgtacaaccaaaaagcacattggtgccacaaaccgcggcaaagggcccacacatatataaagcgaccaaggtggaaaccaagcaagacaaatggcaccagagcgacaacgaacattgataccccaattgacgaacacggcccacaagagtacacggaattggcgaaaaaaaaccagggattccacacaagttacacgacccccacaatatggacaaaacaagcccaattgtagacaataaccaaaagtatgggcgaccaaccgcaacaaggaaaatcgaggcaaaaaaacaccaaagaaaaaagaaatgggg

SEQ ID NO: 668848 - DNA, 471 bp, Homo sapiens
gagtacagtggcgcagtgtcagcttgctgcactccccctccggggttcaagccattcttgtgcctcagcctcctgagtagccaccacgcctggctaatctttgtattttttggtagagacggggattcaccatgttggccaggctggtctcaaactcctggcttcaagtaatccccccatctcagcctcccaaagtgctgaaatgacaggtgtgagctgccgtacctggctgaataacaatttaattgtacatttaaaaataactaaaagaatataattgtattgtttgtaatacaaagaataaatgcttgaggtgatagatacctcgtttaccacgtgattttttttttttccggaggcagggtctggctgtgttgcccagtctggagtgcaggggtgggatcatggcttatggcaaactccgcttcccagtcttaagcaacccttccacctcagccggggcgaaagaaa

SEQ ID NO: 668849 - DNA, 230 bp, Homo sapiens
tttagatgcactaggtcccttgaggccaggagctgaagaccagcccgggcaacacaatgagaccccatctctacaaaacactttaaaaacaaaaatctagccaagtatagttgtgcatttctgtagtcctagctactcaggaggctgaagcaggagcccatgagttcaaggttacagtgagctatgatcgtgccactacacttcagcttgggcaacagagataccttgtc

SEQ ID NO: 668850 - DNA, 1236 bp, Homo sapiens
agcggggtgtggggcaccgggcggggccgcgggaaccggcgccccgacagtgagctgctgctgtcagatcaatgcccggggcccccgatcatcactgcgccgcgctttctggcgcctgagaacttagcgttcccggttattgccatgatgacttggcctcggcgcttgaggctggggtccgggccctccactccgcgtcccgtcctgcgcgcgaactcgcggtcgcgagccactgggaggcaggaggcatctgtccgccgtgcggctgggctgcaggccgagagcgcgcacgcgtggcagaacgctgaacccgtgggcgagtcaccagcggcatccgtatgatagtcttgccccaggggtgtgagcttgaggtgaccagtcagtatggaaggagcctcctgcatgagagcgtcatattgactggctgcctgggaacaacagacgaaatagacgtgtgcgtgaatgcgctgaacgaatgtcgaacgaacgtgttagcctgattgaccaatgggcttcctaccatgagatcgcgagtggtagaacgcatcggactgacgcacgatccacttccacgtggggaatgcatggctaattttatacaagaccaattcttcgaagatgctggaacgtgcacctcatcgaggccaaatgttctatacccactggatagttgcgaactctccgttagggtgtcgaccccaacgtcctggggcatggaccccttggggacgggactgatggagcaccgattgacatgccccaggtggactgcatttcaagcccgaggaagtaatgcgccttcaccagttatggaaccgttcgtgcggccagctggttgggctgatttccgcaagacttgggagtgtccactggccacaatgagcgaagttgcgcgcaaaaagattaaggcgcgtatggttcattaaccaaagagagcctgggcgggaaaaaaccgcacgttcactttacgtcccttcggcagatgcaccaccttgggaggcacgtctggggatatcgcctggggaaggcaggacagcgctgtggtatacgtgggggcaatttattgtctctcagcgtgcaccaacccgttttgactggggcccttagttttaccccgggccgtgtgctccaggtgtgaactcccacacacctggtggtggcctttgtggcccccaagtgtgcggagtcttggtcctgtgtgcgccgggggcgtattgcgcgcatttagtgcccccc

SEQ ID NO: 668851 - DNA, 920 bp, Homo sapiens
  misc_feature (577)..(577): n is a, c, g, or t
tcagcttcttggcatgtacatattcatttgtgagtgttaatgtgctgctgttttttgttttttggtggttttgtttttgttttttttgttttgagatggagtcttactctgtcgcccaggctggagtgcagtggtacgatcttggctcactgcaacctccgcctcctgggttcaagtaattctcctgcctcagctttccaagtagctgggattacaggcacccatcaccacacccagctaattttcgtctttttaatagagagggggtttttccatgttggccaggctggtcttgaactcctgacctcaggtgatccgcctgcctcagcttcccaaagtgctgagattacaggcatgagctaccacgcctggcccgtgttgctgttttaaaggtgctgccatgttcccccatcttttttttttttgagatggagtctcgctctgtcgcccaggctggagtgcagtggtggcgatcttggctcactgcaagctccgcctcccaggttcacaccattctcctgcctcagcctcccaagtagctgggactacaggcgcccaccaccagcctggctaattngtattttagtagagatggggtttcaccgtgttagccaggctggtctcgatctgaactcatgatccaccgctcggctcccaaagtgctgggattacaggcggtggaaccaatggccggcttcccctctcattatgatgccctctgggcaggcgaacggctctgggggtctttcccactggtctaccaaggccccgtgaatggccggcgaaaggaggaataagatggttgggaacggaagcggtgggcaccggttggaggatttctattcttgtccacagcggaaggtatagcgtgtcaagacttttttgtaaacgcggaaatggaccgccaaaaaggtggctta

SEQ ID NO: 668852 - DNA, 419 bp, Homo sapiens
  misc_feature (39)..(39): n is a, c, g, or t
  misc_feature (275)..(275): n is a, c, g, or t
  misc_feature (283)..(283): n is a, c, g, or t
  misc_feature (346)..(346): n is a, c, g, or t
acactggacacgtgctgcttctccttgccttccaccatngatatagcttcttgaggcctccccagcaatgtggaactgtgagtcaattaaacctcttttctttataaattactctgtctcaggtatttcttcatagcagtgtgagaacggactagcagaaccaccatttcccttggggagctagtgaaaacatatggcaactttaagaagggaaaaggaagaaaaataaaacataccctctaaatccgggggaggggcaagaacactgagaaggncatactgncaaacccaggggcacagtaactgcttaagactaaggcttaatcaggacatacccataacttgnctctcaccaccagactacaaagcatagagcaacaagtaattgcactatactaccgggagagggaccagggagt

SEQ ID NO: 668853 - DNA, 1517 bp, Homo sapiens
  misc_feature (819)..(819): n is a, c, g, or t
atgggtagaaataggcgacggatccagctaggacgctggtctagtgtcatggcgctcacgaaaagacatggaatacaaggcatctcactacgcagcactgatgacaaatcgtggcttctgccccacgctctcaggactatgacctacgacacgtcacgagactacgtgctaccagattcaggactgacacaggagcctgggtgtcccacggataaccgctcccgcgagcaccgatgtcatacaacgagacacatcacagtgcgaggacccataccgagcccgagcacacccgcaggaccgcatacagaacacatcctgctacgcactactcactgataccagtacccaggcacttagcccacgactcctgcgcacagaatgagagacaaacaagcaaaagtacagatgagcgaagctagcagctaagacacgaggaacaccacgaaaagagcgacagacgaacaggacaaaacagaccaacaacaacaaagcaacacacgaagcaacgaaggatcagacgcccacacaagacgacgcgaagacccacgcaaagcgacccgcgcaaaacacacagacaccctccccatacacaagagaacaacacacaaacgaacccacgaacaaccaaacccaatcagaaacacaacccacagccccaagccactcgcacaccagcacgcagacagaccaacccaccagcgccgccccaccagcaccatacccgcagcaaaataagcaaacagaacgcgacatcgacagaccacacaacaacgaaccacgcggacacacacaagcaagcaacaacacccgccaaacganaagaacacaaaccaaagaactagaccagacccaacccacaaactccaacacagacacccaaacaccagaccaccaaccccgcacatacccacgatgctaacaagaacgaaaaaaggaaaccataacaaacaagacatcgcgatggaagcacacaacacaccgccacaatccaagacgcacaagaacaaacgaacaagcagaccaaatgtagagctcacaagacaaaacctacgaaagacatagccacacaatcacacaagagaccacaaacacacgagactcgcactcacacactacatcatcaatgtcaccaagcacgccacaccacaccactcatcccaccacagcagtacatcaaaacaccaccaccagccgcaaacaaaaaaaaccacgaatccccacaaacaactacagatcacacaacgcaaccacaaaacccaacacacacaccatgcaactcccaacaggcaaagacaaacaacacacaaaaaaccgacagatagagcaacacacaccacagagacagacacaaccatcgacaaccacaaacgtcacaagcgacaaaacacacagaccagaccagcaacacagccagctatgcgatcaatcatacaccgaccagaaccacacaccacgaccgacagcaagacaacacacaaacacaccatgacatgacgacagaacaccaaaaaaaccga

SEQ ID NO: 668854 - DNA, 143 bp, Homo sapiens
gttcaaataatgatcgtgaacgtcggagagcctgtgtggctacaaaaatgttgagtcgtaataccgtcggaaatggggaaagcctagtcgaagtactctgaggcttgtaggagggtaaaatagagacccagtaaaattgtaat

SEQ ID NO: 668855 - DNA, 394 bp, Homo sapiens
  misc_feature (9)..(9): n is a, c, g, or t
  misc_feature (25)..(25): n is a, c, g, or t
  misc_feature (56)..(56): n is a, c, g, or t
ggaagaaanattccccacaacaaanttaaatatgaaataggcaagggaagttcatngggaacccacccttagcgtttgcccaacccattgttggtatcaaaagtactgtcccaattatgtcgtggtgattaaacctatgtgatatggttttcccataaggaataacagttggctgggcatgatggctcatgtctgtaatcccagcactttgggcgactaaggcaggcagatcccttgagctcaagagttcaagaccagcctaggaaacatggtgaaaccccaactctacaaaaaattagccaggattgcctgagcccaggaggtcgagactgcagtgagccatgatcttgccactgcatgccagcccaggtgacagagtgaaaccctgtctcaa

SEQ ID NO: 668856 - DNA, 147 bp, Homo sapiens
ttatctggtactgtgtgcagacattcttctgcgagctttacacctattccttcctttaaactctcattacccctataaggtaaatacgtttgagccttgaacaatgccgaagttatgggtgtccatcctcacacaggcctttaggta

SEQ ID NO: 668857 - DNA, 353 bp, Homo sapiens
gaaaaccgtggcgtaataaaatacaaaaatagccaggagttgtgtgcgtcatcccagctacctgggaggctgaggtaggagaatatgcttgaacctgggagctggaggttccagtgagccgagatcgcaccactgcactccagcctaggcaacagagtgagaccccatctcaaaaaaaaaaaaaaatggattctatcccaaaagaaaacaggtgaacaagccctcctacctcgggaccatgcacaagacaagaaatactagccatttataccccttccagggtgcaagtgaggccataagccaccacggtatccggcctccaaatgtttccacactttggccctggctcatct

SEQ ID NO: 668858 - DNA, 147 bp, Homo sapiens
tgaccctagaggatcccaagctccaacagagaggggactattcagtctggccactccgcaaaacagaaaagaagtggcgggtgccggccactcagtaggctctgctccgattgcttgctgaagactttaacaagtttgggaggtcaa

SEQ ID NO: 668859 - DNA, 332 bp, Homo sapiens
tattccgatacttagtccagcgctggttggagttgagcgagtgaatgggcagagtacattagcccactgagtcgctccacctcctctttctctactagtaagcagtgcacgggctctgcatgaacagggagtgaaaaccacaggaagtaggcaaccctcaggcctttgctggctgtaaggcagtgatgctactggaggggaagtgggaggcctgtgaaacgccctgctccgctcagtcaaatctacccacgcccccaggcaggagcctgtgaccggctcctgggtcacctgctaacaccctgaatctgaccaggctgttcctgctgaaattc

SEQ ID NO: 668860 - DNA, 212 bp, Homo sapiens
tccacacatgcttccggaaccaaggaaaaaagaacaaatattgtaaccaaagctcatgcttatagctatagtcactgaggaaatcacaagggtgatgggaataatgagccaaagcatggaggaggaaccccaatgcataaatatcatcatcacacagggactaagcagatgatgaggtgcagatgcatccccaggatgggctctaatccaac

SEQ ID NO: 668861 - DNA, 507 bp, Homo sapiens
  misc_feature (9)..(9): n is a, c, g, or t
  misc_feature (159)..(159): n is a, c, g, or t
  misc_feature (207)..(207): n is a, c, g, or t
  misc_feature (226)..(226): n is a, c, g, or t
  misc_feature (251)..(251): n is a, c, g, or t
  misc_feature (263)..(263): n is a, c, g, or t
  misc_feature (269)..(269): n is a, c, g, or t
  misc_feature (279)..(279): n is a, c, g, or t
  misc_feature (307)..(307): n is a, c, g, or t
  misc_feature (318)..(319): n is a, c, g, or t
  misc_feature (341)..(341): n is a, c, g, or t
  misc_feature (345)..(345): n is a, c, g, or t
  misc_feature (350)..(350): n is a, c, g, or t
  misc_feature (356)..(356): n is a, c, g, or t
  misc_feature (363)..(363): n is a, c, g, or t
  misc_feature (387)..(387): n is a, c, g, or t
  misc_feature (396)..(396): n is a, c, g, or t
  misc_feature (403)..(403): n is a, c, g, or t
  misc_feature (441)..(441): n is a, c, g, or t
  misc_feature (456)..(456): n is a, c, g, or t
tccataaantttttacagtttacagcagagaacaaggtttgtttctgcgcatgagtgtaaaagccaaaccaaactttattattgcaatcacacaaatactgcaattaaaaaaaatcaaagagcagttaccccaatgcaaaaaaacagggactgccagantcaatcttagaatggaaacacaaacacactagccccaaaccctaaaanagagattcacaaggaactnagctgacgaacagacgcagcagggnggacaccatggncttggnaccttagggngctcacttagaaacctgacttacgaaanatcagccatcnnagtttacaacttttggttatanatgntaccntgatgngccagtngttagggtgcgttatccatttgtnagctttganccctggntctttctaatgttcacccatgaagggcccttgttttgnctctaaatggtggtnatctgggggagctgtcttcagggatacctaagggatcttcagagctaaaag

SEQ ID NO: 668862 - DNA, 812 bp, Homo sapiens
tggtgtcctgtgggtggacgtggttggtgattgggaggatcctggtatacggtaacagggccaaatggcagatcttcgtgaaaacccttaccggagacatcaccttgagtgtgtgagcccagtgacaccatcggaaaatgtgaagtggcacgatccacggataaggaaggcattccccccgaccagcagaggctcatctttgtcaggcgaagcagctggagagatgggcgacgtctcttctgagctacaacatccagaaggagtcgagcctgtcacctggtcctgcgtctcgagaggtgggatgtagatcttcgtgaagagcctgagctggggagagcatacaccctgtgaatgtggagcccagtgacagcatcgaaaatgtgaatggccaagataccaggataaagaaggaatcgtctcccgagcagcaaggacatctttgcaggcagcagctggaagatggacgcactctttctgactacaacataccagaaggagtcgacctgcacctggtcctgcgtctgagaggtggatgtagatcttcgtgaatagcctgacggcgagacagcaggctggacgttgagcccagtgacatcattcgacaatgtgcatggccaggatccatgataggtaaggtgattcgcccggacagcaaaggtccacaatgtagggagcaggggaaagtgcgacactctggtacaacattcggagaggacctgtcagtttgcgtggggtgttacaccagtttcggggcaagtggtcttgagcttccatagtaatctcgagatacgcgtaggtgtgaaactgcttgg

SEQ ID NO: 668863 - DNA, 437 bp, Homo sapiens
gtctgtgagggtgttgccaaaggagataaatattggagtcagtggactggagagggcagacccaccctcagtgtgggtgggcaccctcgaatcaaccgccagtgcggctaggttaaagccgacttgccgagtcttccgatcatcatctttctcttgtgctggatgcttcctgaccctgaatatggaactccaagttcttcagcttctggacccttggacatacaccagtgatttgccgggggctctcaggccttcaaccacagactgaaggctgcgctgtcagcttccttccctacttttgaggttttgggactcgagctggctttcttgcttcacaacttgcagacagctcattgtgggacttcactttgtgatcatgtgaataatactccttaataagtcgacgcggcccgaatttagtagtagtaggcggccgc

SEQ ID NO: 668864 - DNA, 1299 bp, Homo sapiens
  misc_feature (1299)..(1299): n is a, c, g, or t
ttcttgattcctggctccttctcactgtctcccccatcagaccacgccggcctgcagtctgctcctgctgttaccaacacactggctttcggctgaagcatttctgtatacttgtattactagctatctgacactttactatgagcttttcacgtccagcgccaacgctgcttactactgctgctgctgcgctggctggcactaggccttgcggccttagcgctctctctacacagctgacaaccttgctgggcgcagctcaacaactctacccctcactagctcccctggaagctcagctacggacctctggcgaacctcgtgcactcactcacaccactcccaagaacttaacccctgctctcctctctctctccctttgccactctctactctctactctctaccctctacatctatagcacccggaaggctccttcggcgtacgtgcgtacagccccccagggcgcttggcacgccttgcgcacacgtggcccgcccgcacctccatgtgcgccctttcaggcgtgcccacaggcgcatcccaaccccgtcccccaagggcttctcccactggaccgcgcgttcttacctctgctggcgccctttccacgtcgcgccttcctgtgcgacgcctacgccctggcgggaatccttaccgcggcccggccccaaccccacacccatcgccccgtggcgcgccttacactcttgtctcgctcgtactactctagtgatttactatattagcggggcgtattatttctacaagccagccgcctaacgacgacgcaatcgtgcggccggcatctctaccacccgcagagtggtcgatataaggccccccgacgtgccaatgctggcgccctcctcctcaggacatactcttatccgctgtggtaaacccctctgcggggtgaacacctctaccaccactcctcgtggcgcccccttccggccggcccctccttcccgccccaagaagcacgtgcgtgactgcgtaggagccacggatatttcacaaccagcaggcggtcgtcttgttttgaaatggtcccacacaccagacgggccgcaccccacgaaggcccccccttcttaccgcacccttcgagaaagattcctttcaaccaacgatccccgccggaggggcgatcctttcatcccccacattcctatatataacattgctcgggcgcagaggagggccaccccaatataatggcggccctaccaacgcgatcatacagtttgtagcaaacagcacgttttactacacaaactgcctgactgaccatn

SEQ ID NO: 668865 - DNA, 116 bp, Homo sapiens
actgtcacaagatgtagtccaaatgtacttataaatcttcaaacactggcattcacatacggtagaagatgaaaaatccagtgaaacagattccaaaaattcaggtattgggatgt

SEQ ID NO: 668866 - DNA, 654 bp, Homo sapiens
  misc_feature (126)..(126): n is a, c, g, or t
agtggtggcgggtgcctgtagtcccagctactcgggaggctgagacaggagaatggtgtgaacccggaaggtgtagcttgcagtgagccgagactcgcgccactgcactccagcctgggtgacaangagtgagactctgtctcaaaaaaaaaaaaaaaaaaagaatacacatttcccaggcagcattgggtccattcctattttccctcaaggtttccaaaaaacaccacttcttatgtttgggggccaccattggtttcttcttccgaaaaaacctacagcaggctgtggacgcagtggggttcacaccgtgtgtaattcccagacacttttagggaggggcaggggcattgaggactcacttttgagcccattgagtttcgaaaccagcctgtgggcaacaaagttaagactccattctgttccaaaacaaacaaaaaattacgcgtggggtggtcggcagggcgagcggggaagaatcacgcgccttggtaaattcccagcgcactttgggagagggccaacgggtggggcgagggaccattagatgtctccgggaagattgggagagaccattcggcgggttaacacgggttgaaaccccggtctcctattaaaattacaccaaatattagccagaaggcgggcgagatc

SEQ ID NO: 668867 - DNA, 419 bp, Homo sapiens
tggaattgtctcctcctcattctaactcatgagaaaagaaaaagacacaagagaggcaaggtctcagctgccacggatttggaaataactgttaaataagggatgcacccccctcacagacattgtccattctctccccacacgatgcttgttacaccttatatatattttaacactggtatacataattaatgtaataactttacctccagaacaaaaatttctggaggccatgaccacgtcttatatatctctgaatcccacgtaacacagcacagacaagaaaaacaaggttgagatggtcccatcctattttatctatcattttatcaaatccctatttctatctggcactcatcaacagcagacacccaggctccaaacacacagatggcctatacctgactgcttcctccttt

SEQ ID NO: 668868 - DNA, 159 bp, Homo sapiens
cgccgttggagaatgtgcgttcctgcctgctaccaccactcggagcagaagccggctgacacccctcggctggacacccctcgaagagagggcgcttccttgagtaggtagggctccccttgccgcttccctccctatcactccatactgcgggtgggc

SEQ ID NO: 668869 - DNA, 1681 bp, Homo sapiens
ggcaagaacgatgcgccttacgaaaggcggcaaaaagggagccaagaagcaacagtggttgatccattgtgcttaagcacaagattggtcatgacatgtgagacagctcctgcgtatggtccacatgataagtaaactattggtaaagacgctcggtcaccaggcaccgcacggcaaccacccatcggcatctgaaatggtcctctacagggtcggtgctgatatgtggaacggtggaggtcttctgcatgcagtatgtgccaggacactgcactgagagctgagcagctatcagaacacacagttcctacagcgtgcaatatcacctgaacagcatgattccagcggactcacaagacacctaggcgcgtgaaactacaacgttgtctctagtggctcaatgcgatactccttgcacccgccgttggccaccatcctaaatggctggtctcacaatagggatgcgtggactaacacatggggctgacgcacccacaattggcaagtttagaacagaccttcatacggatttcggccatcgcttcccacaccgaacacttacctccggaacttgggttactaaccaactgggcatcttcgggttcatccggtttgccttggttcgtgtgacagagggcacacataacgtccaccacaagagacacccctgcaaaaccacgaacaatatcaaatcgcaattcacctgtggaccaagtgacaccacctatccatatagagtaggacttaccaaacgatccacctgccaaaaccgcaccggggttgccacgggcgccaaacagacatcgcgcggcgacagcgacaccagcacctcgacctcggagaatacacctccactctcgaacccgccccgcgaccggaccgaggtaggacacccgaaccaccagaacgttggaagacgtcgtagaaacccagaacacggatcgggctacacaacatccaaacagcgttcgaggatagtccccacgacaccccagcccacctctggcggaacacaaccggcacccatttacggaacacacacagcggcacctcgtggcccccaaaaccactgaacttcaggagctcacgcggcgcgtcccccagatgccacctgacacctccacccgcactacagagagcacacagttccagaacaacatcgccctagaacaggcaacacgcccccgcacagccgtcacggcacacctccgcggcgcacaacagcccatccactgggccagcgctgatccacctcgacgccgacaccccgcgcaacgccacgcgttcccatgcggagaacagatgccccaccctggggcgcacacgcaccacccacggcgtggcacctacaacgactagccaacgacagcccggcatgcggcccccactgccaccgccacgcgacagatatcgacagaaagaagatcacgggtcacaacgcaatcacgagacctatcaccacaccacggggtcgagaccaatcagaacgagggcgcacatcaaggcagacacggggcatgtggcgaatcacgacgcccgccgaacgcacgccaacaaccaaactgacgctgcactcccagtaaccacggcgacgcgccacagaggacaccacccagcactgacggacaccacgacgaacgaatcgacgcagacggcggctcccatcacacgaggcgacgac

SEQ ID NO: 668870 - DNA, 140 bp, Homo sapiens
  misc_feature (21)..(21): n is a, c, g, or t
  misc_feature (39)..(39): n is a, c, g, or t
  misc_feature (52)..(53): n is a, c, g, or t
  misc_feature (56)..(56): n is a, c, g, or t
tagaatcgagctggtcccganggggtggggcaggtgganataactgaatcanngangcgtttcccccatgctgttctcatggtagtgaataagtctcatgaggtctgatggttttataaatggatgttcccctgcacatg

SEQ ID NO: 668871 - DNA, 652 bp, Homo sapiens
  misc_feature (32)..(32): n is a, c, g, or t
  misc_feature (79)..(79): n is a, c, g, or t
  misc_feature (93)..(93): n is a, c, g, or t
  misc_feature (106)..(106): n is a, c, g, or t
  misc_feature (150)..(150): n is a, c, g, or t
  misc_feature (152)..(153): n is a, c, g, or t
  misc_feature (158)..(158): n is a, c, g, or t
  misc_feature (160)..(160): n is a, c, g, or t
  misc_feature (189)..(189): n is a, c, g, or t
  misc_feature (191)..(191): n is a, c, g, or t
  misc_feature (196)..(196): n is a, c, g, or t
  misc_feature (206)..(206): n is a, c, g, or t
  misc_feature (226)..(226): n is a, c, g, or t
  misc_feature (459)..(459): n is a, c, g, or t
  misc_feature (464)..(464): n is a, c, g, or t
  misc_feature (640)..(640): n is a, c, g, or t
cccaaaaaattcgcaaaaaggaaaaaaataanaaatccagaatttgcaggggaagtgaaaatgtaataatgtgatgaantaaaaggaatcctnatctctggaagcngggaggaataaaaagtcggtgtaaaaagcagcggcagggacaananntgacnanaaggctgggtcccagaaaaaattaaaganangcagnagctgaggcnccttctctgaaaactatttnaattgcacagtggccatagaaggctccatttgcatggtaatatctctgcagacaatttgtccacaatgaaaataatagcaccggcatcattgctttgggctgcagggaggacaatgacccaccatgaaaagagttaaaaagattctggggaaggggaaaggcaggcccacacggtggcaattcaagatcttttggatgccgtgagcgtgttctttaattaagcccctcttctncagcncatcctgcagaaacgcacctgcttcccatctgccatccaaaacggcaagcacaagaatgacttcacactgtcactttcagagttccgctgtggcccacagtgatttttcaagaaaggcagccacagactcgctcgcgctttctctttctcctttcctctgaaagactctataaaanccacattaaaaa

SEQ ID NO: 668872 - DNA, 132 bp, Homo sapiens
  misc_feature (105)..(105): n is a, c, g, or t
cttatgaggcagagggacagcgggcgcagaggtatagcttgaagtggcagaaggtcattcggggcgggagacctgagcctgctgagaaatccttttagcgccagnaagccccacccaggccctgtcctgtgt

SEQ ID NO: 668873 - DNA, 1103 bp, Homo sapiens
  misc_feature (352)..(352): n is a, c, g, or t
  misc_feature (413)..(413): n is a, c, g, or t
  misc_feature (457)..(457): n is a, c, g, or t
  misc_feature (503)..(503): n is a, c, g, or t
  misc_feature (520)..(520): n is a, c, g, or t
agcggctaatctagtgtacctaggcccgcggccgtacgggtagtagagctagcgccgcaccgctactagagggtaacgtggcccaccgctacctatacgcggtaccctgccgccaccgtaccacgctacagcgtagttagagaagataaagagggtacggaacagctgccaacgccggtcaatattatagctgagccctgttacattgggtggtaacttggctatacatctgtcgagctccgcaattagtactaaagtagaggcgccaactagcatgagtctttctatcatgttcgaaatcaacgaacttaaacggatccattttgatatcatcaaaatgagttcgcaatgntaaccaaatctcaggatagatatctaataaggctttatctataaatatcggactcggaaanataatgctattgatattatgattgaggagactatctacattttnagagacaaattaggcttgtaacattttatctgggctaacaagaagncaagatatcaattgganaagatcgttccactttctatttgacagggattgtctaattcattcaaacctctataccgatcagcgcgattagagctcgggagattcaacgtatctgaaatcacccggacagaatttcggacaacaatgaaacatatgcggcatggaacatagtgggtatgcacaaactcaatgttaaacgaataccaattgggactgcccatggtaatgcacacatttaggtcatttaatgtgatcaaggggtcagggatttggaaactttacttttttaacttttaaggaatgttctcaaatgtttcactaaaccgaaaggggcaatcttgaaaacttgataacggaatatttttcattctggaaaattgtgggttaaacggatcgggtgattcgcttaattgcgggatttgggaccgactttttctcttcggattcccatggacgggcccccactctcctcttgggggggggaggccctattcttcttgggcaatttactgccgtcatcgttcctacttttaacgcgctcccttggtcccccttgccttctgccgcccggtcaaaccggcgactcgcaccgaactcgcct

SEQ ID NO: 668874 - DNA, 238 bp, Homo sapiens
tatctgggactacaggcatacacacacacctggctaatttttttcttctttggtagtgatgaagtttcgccatgttgccccgactggtctcagactcctggactcaagtgatccacctccctcagcctccccaagtgctgggattacacacataagccaccgtgcctggccaaggatcttaattttcgaagtttattttccttgcaggttattgaggacatacccgtgccagccatag

SEQ ID NO: 668875 - DNA, 672 bp, Homo sapiens
  misc_feature (385)..(385): n is a, c, g, or t
  misc_feature (670)..(671): n is a, c, g, or t
ccctgatggggagagagggacagggcacacccccacaccacacaacccaccccccccccgccggcctgtgcccttttcaatacactgcacccgcaccaccccttttcccccaattgaacgcgcggggcgtcgcacccaaccacaatttattgtggtttcccccactcattcagccacccccattttttacattttattcctcccgccctattatgttgtggtgaatttgggcgccgataaacaattccacacagggaaacgcttatgacttgattacgatatttaatccgcctcactatgagggaatctcgccctcgagcccaagaatccgccacgaggacgacctacccacaggagaacatccctctcgcaaaggtctccttcntccccctccagagggggagaggagaacaccaaaaaaaaccccctgtgtccacaccccaattccttccttcttggttgtaaaccccccgggtttttataaaacccccccgttttttacccaaacaaaaacgttatttttgtgtgttggctcccccactcccctctcccaccctacgggaggaaaagcagggcttacagaaggtttttccttcaggaggaagcaccacaaaaacccctctgagtcaaggtgggggggaaaccctctcaataaacactttttggtttnna

SEQ ID NO: 668876 - DNA, 950 bp, Homo sapiens
ggtcttcaggagacctcagtggtggctgtgagagctacctagtcaacctgtctctcaatgatcaacgatggctccagtggggcttcagaccaggataccctggctcctctgcctggggccacgccccgtggcccctgctgcccagcgtttctcctaccagtaccctgccccactacccctacatgccctgcagcctccaccctaccatgagctttcatcttacacctagtggtgggggcagtgccagcagccagcatagtgagggcagccggagcagtgggtcgacaacggagtgatgagaggggcagggcgcacggggacgcgccgcgaggagcgggcccccgagtccaagtccaggacatgtggcagatgagtctgagtccctccagctcgagggggcagacttcggcggggtgggggaagcaagtgggactagcgatagggtggccctcctccatccagaggctcagaactaggagagtgtgcccctaatctccgagaccaggccaggtctccatccctatggaccgcgcatcatggaatggcacttacgccatgcaaagtccaggattggtggtcactgattgccaccaacatccaagcatccaagtccctccagcatgctgcacataacagggagaattgtgagcacttgtgagctctcgaccaggagaggcctggttcctcccccttccctcaggggtagaccaacgggacctttcgactgattcgtcaaggcttagtattcctcataacgccttatacgaggggttaagaacaagaagtcaccttaacatttgtgaaggggaactgtatgcaagtagaggcttagccctctatataatctgaaggaattcccatcgcatggggccccgtttgaagccccggaatgatgactctcctccagtagcgcaaaccgcctttgcaaggtggggatgagccagggaacg

SEQ ID NO: 668877 - DNA, 104 bp, Homo sapiens
gtacgtgtgtagagtaggagtagctctgatgctctgaagtcacccccagcacaaccccaatggcaaaaattcctttactccttcatagatattgctcgtacaca

SEQ ID NO: 668878 - DNA, 899 bp, Homo sapiens
  misc_feature (373)..(373): n is a, c, g, or t
gatgagctctttcagaggaattaaccccctaaatgaatgacttgagcagctgattatatgcgactcttgcctactgccgagtacagacctaattcttcgcccgacgattgggatcgtaacaagcgtctacagtggcaattcgatcttacccgtgtagtatccgcctaggcacttgaactgcgcattcgcacacagtacaagccaccacgcggaacgtatttgccatcagtgcgacttactgctgagcatgccaacctactgagctgtccgtctaaacccaggctcgttatatgcaatctaattcagcacacaactagtcgacatcaggaagaagcgatgatagtgaagttgggtcatcgaacctctaatcccngaatgcgcgtaatacgacaggctcggaatggagacagtccatcgcatgattgcgtatgtattcatagctcttctgtcacattgctacaaatccgagggtcagtgagtgcgcgaaagcactctacaggggaaatccaagtgtctcatcaatcactttccaaggcaaaaacgcgtgatacacatgagtgcggggaattatcatttgcatccctaggcatctcgacagaatgctaattaaggcgaacaactaggactcggaaatacgagccaaggggcacataatggctccccctccggaacaaaattaggaaaggggaccaaaccactaaatccgattgccccctttgaggtgatggggcggccgattcgaaagggcaccacctatatacaccattatgaccatttttagaagattcaatccaaccgcgttgtactttctggttaggcttaattggagtttattgggtcgcatcaaaagattaccttaaaaagtttaacaacgaatccagacacttcgtttgaaattg

SEQ ID NO: 668879 - DNA, 372 bp, Homo sapiens
aaaaacccccccccccaaaattaaaggggggttttttggcccccccccccccccaccgggggagccttttaggggtataaaaatggccccccccccccccagatttttccccgggggaggggggggatttttcccctttaaaaggcccccccccccccggccctttggccaaaagggtggggggcccctcaaaaaaaagggaaaaggcaagggaaaccctgtgcccctttttcattgcccaggggggggggcccccggggaggggtttccagttcccccggggcccgcccctgccagttttttggcaaggggggatttttctgggggggtttccgttgggggtttggggggggggtttttttttttttttta

SEQ ID NO: 668880 - DNA, 202 bp, Homo sapiens
  misc_feature (72)..(72): n is a, c, g, or t
ctgagggataacagagtagtagatacagacggtacagaaaccattcctgtactcaatgagtgctctcccagnattcccattatctatcattatgtaacaaattatactaatacgtagtggcttgaaacatccatattattcttccaccatattatgcggaacagcagtttggaaagggcatggtggagtcaggtgatatctg

SEQ ID NO: 668881 - DNA, 790 bp, Homo sapiens
ggtcaacggattgggtcgtatgggcgcctgggtcaccaggctgcttttaatctctggtaaagatggatatagtggccatcaatgaccccttcatagacctcaattacatggtttacatgttccagtatgattccacgcatggaaaattccatggaaccgtctaggctgagttaacgggaagcttgtcatcagtggaaatcccattcatcatcttccaggagcgagatccctccaaaatcaagtggggcgatgctgggcgctgtaggtacgtcgtggaggtccactggacgtcttcagcagcatggagaagggtggggctcattcgcagggggggagccatgaagggtctctcatctctgccccctctgtgtgatgcccccatgttcgtcgatggggtgtgaaccatgagaagtatgactaatagactcaagatcagtcaggaatgcctcctgtaggccatcaacatgtcgttagcgaacccctgagcaatggtcagtccatgacaactttggtatcgtggaaggactcatgagcacagttcatggcatcagtgacatccagaagactgtggatggcccatccgggaaactgtggcgtgatggcgcggggctctccagaacatcatccctgtcctctactggtgctgcaaggtctgtgggcaaggtcatccctgagctgacgggaaggtgactgtcatggtcttccgtgttcccactgcaaccgtgtagtggtggacctgaactgcagttagaaaactgcaaattgatgactcaaaaggggggaagaggcg

SEQ ID NO: 668882 - DNA, 154 bp, Homo sapiens
tgactctaccggatcttaatatctgcacccacagcgacatgtttttttcttactgactattgtccagaaacagttgcttcgttgatatttttttattttctggtaacctcatatacagaagcgatgttttgaagtccagattaaggttccggga

SEQ ID NO: 668883 - DNA, 373 bp, Homo sapiens
tcctgtgcttgtcaggtctggatcaggtgtctctctgaagttagggacactcttggcccaggtgaggatcacggtggtctccccgggtcaggtacctcttggcgcaggtgaggatcatgtggtctccctgagattgagaccctcttggaccaggtgaggatcacgtggtgtcccttagcttgggaccttcttggctcaggtgtggatcaagtggtctccctgaacgtcaggctcctcttggccaagtgaggatcacgtggtctccctgaaattgggaccctcttcgcccacgtgaagatcacgtggactccctgagattgggaccctcttgagccacgtgaggatcatgtggtctgcctgagattgagaccct

SEQ ID NO: 668884 - DNA, 207 bp, Homo sapiens
ctgactacggcggaagcaccatggttggactgactgcaggcggagggagaaaccgagccaagagtctttatgaggcttctgcaggaaggaacaggcatagcagggtaagcaggtttaggatcagctagtttgagtcattatagcaggctctgtggcccaggtctgagactagatgctaggagcctggtcccacaatgatgagggcat

SEQ ID NO: 668885 - DNA, 411 bp, Homo sapiens
aaaaatttttaataagacaatttcaataaaaacacatcatattatttaatatttttcaacactaacataaatcaaattttttaaaaacattccattgtgaaacataagttataaaccggttgaagtcacaatctgctaaaaatctaatcaacacataatctccaacagaagttgcaccagtgtatacacgatacgcattgcgatcacccacacctaaagtacttgaaacagtgatttaatatggaaagggtaagcgtacaacttagtgaattcaacacatacacgccgtatccatcacacatactctacccctatcaaaggcacacaacataaacaaggtcctcaacataactaccgcgcataacacaaacaaggtacacaacacaactaccacacacaacacaatcatgg

SEQ ID NO: 668886 - DNA, 651 bp, Homo sapiens
tactgaaaacacaccaggctgtctctggatgctttactggtggccttgaagttcatgcaggtgataggacgtggatcattgacgaagttcagtgtattctggctaagcttgatatacatgggacacggtcaaaggctacatatcgcatcagcatcagaagctggatggtgttcagcaagcagaacccatttcctcccctgctgccacggctgtgttgaacagtacacggtagtccccgatggacggtactcgcgctgtgattctggaagatctttgttgagcacttcttcgaaggaggctttgcgttgaggggctgcatcggttcacatttggcctaaggtgatggtcacctgaaaggctgtctttgttaacctttatggtgatgttctttgtgtaaaaagctgtaattctggaattatacacatggcatgttcttcagttatatctttccaggatatcatctattgttgatatattaatattgagaatgtgttatcaaaatgctgtggttaacttaagggcgagccttgttaaagagcagaatttaatttgatttaaattattgccagattttatagcttgccgtgtatggatgctcctcaatttatgatggggttacatcaccaataaacttatatcagttttggcttt

SEQ ID NO: 668887 - DNA, 145 bp, Homo sapiens
  misc_feature (44)..(44): n is a, c, g, or t
tacatcagagctaacaacccggggacggctttttaaatttcccngggaaggagaccgtcaggccgcatgtagaccatgctgctaagaaacagaacaaaatgcccaccccttctaatagtattatactaatttattaaaaaaaaaa

SEQ ID NO: 668888 - DNA, 571 bp, Homo sapiens
aagctaagtcaggatagctaagatctgattcacatctgctggagtgaaaaagtgatgatcagtcgtttcaggaaggttattatatgggggataattggtcgcttaagataccccaaaatcacatatgtacgcatacatcatatacacacacattgcatacacatttccccttgactgattcgcatctttgtagataaacactaaatttcgataaagattatttacacttatttaggctattactccaatttaaaaatcagtgaaagttttcaatgtttagtctcctaatatataatgcttaaatttgcaacaggaacaatacattatcaaaagcattaacctgtatttagctttcaaatatacctgtctatattaggcagtgatatcttaagaaatcattttctcccttatattttctaaagtgctttaaaaactcatttaatctacacatttttcagaggtaggtcggaattatcctcttgttgccaatgaggaaacaggcacagtgagcattggtgacttgtttcaggttacaccaaaaaaatccatgagtgctaagctcagagcccgg

SEQ ID NO: 668889 - DNA, 130 bp, Homo sapiens
caggagcaggactgtccggtagcctggagccattgccattaggtgagctgtccacaggacctgagtggtacggggagttgggccttgggatcctagagccggtctcttgagctgcatctagaggtgggga

SEQ ID NO: 668890 - DNA, 156 bp, Homo sapiens
ggctgacacacccagccctggatacggggtcccagacgcagacgtcgggaatttcttgacaatgctcagcagggtaggaccagaggcccatgttgaccagcctaaggtcctgggtttacgggaacaaactctttactttttaaaaaaattacttgg

SEQ ID NO: 668891 - DNA, 227 bp, Homo sapiens
  misc_feature (64)..(64): n is a, c, g, or t
  misc_feature (88)..(88): n is a, c, g, or t
  misc_feature (122)..(122): n is a, c, g, or t
  misc_feature (125)..(125): n is a, c, g, or t
  misc_feature (165)..(165): n is a, c, g, or t
  misc_feature (196)..(196): n is a, c, g, or t
catggggacccgggtttattttattaggaaggaaacaaccaagcaccccatgttcctgcccggnactcccggggggaacatgccaaanagccggggatcgaacccagcccacctgtcgtggnggncccttccttctcaggccacagaaataaacccgtgtacttnttattgttagcacaacattaccagaaaacgntaacggcagccaagcaggacagacagttaag

SEQ ID NO: 668892 - DNA, 326 bp, Homo sapiens
ggtgattagaggatccttgctcccattggttgccaggatcggctatgatccagctggcaaagagggagattcgttaaaaaaaaaaaaaaaaacaaaaatttacagtggagttaggacttgagtcatgccctataggttggtacaatgtgggtcaggaggtgaagggcattctgtgcctgaggaagctgcatagcccaggatgtcaggtgttggatggtgtcaggtggcagcagcgttaatgaaaaatgaggtgggatgtctaggatgcaatgaaaatatggaggctcttcaagggtgggttgaggattggagatacagttaactaa

SEQ ID NO: 668893 - DNA, 87 bp, Homo sapiens
  misc_feature (20)..(20): n is a, c, g, or t
tcatgtgagttagaggtagncttctgagtagcctcagtgtaaccttacgtgggcggtttacagtacccctaggggccacataggatc

SEQ ID NO: 668894 - DNA, 223 bp, Homo sapiens
  misc_feature (31)..(31): n is a, c, g, or t
  misc_feature (49)..(49): n is a, c, g, or t
  misc_feature (63)..(63): n is a, c, g, or t
cgaagtatatgctgagttatgtacttgcatnaggtcagcaattccagtnccaacaaataaggnatctattactgagcatcaactatggtgaaactgtgcttggtggaagttcaagaatgaatatatcaaaagtcacgtcctgcaggaagtcacaaccaacaacggagataaactgttaaactgaaaatgatccttgtatgaatcaaagatgctggtacacttg

SEQ ID NO: 668895 - DNA, 361 bp, Homo sapiens
agggcgtttttggaagacactgagataaccatgacccaatgtggatgggcactgatatggtttggctgtgtccccacccagatctcatcttgaattgtagttcctgtaatacctacatgtcgtgggagggacccaatgggaggtgactgaatcatggtggtggttactgccatgatgttctcatgacagtgagtgagttttcatgatttgatggttttataaggggcttttcccctttggctcagcacttcttgttgctgccatgtgaagagggatagctttgcttccccttctgccatgattgtgaggcccctgcagccatttggaactgtcagcccattaaacccctttgttctttata

SEQ ID NO: 668896 - DNA, 408 bp, Homo sapiens
tgtcgggacacatttgtcctatccgatcacaccatcccggatgtcacgctgatttagtgcggccggcggtgcggctctttagctgtgcatttattgcgtgactgcagcacgggtgcagtttgcgcgtagtcgatagcgttaaggaagtgaggtgcataacgactgcacaatgatacgggtagcgtgctttgccgaaaaggttgtccctgcgggtgaggcttttgcctgtagcataccgacgtgggcgataaatatcgtaattgtgtgcaccattgccgtcagtggattggccaccctaatgttaagggataacacgtggtttacgagtgacttagactatacgcgtggccgcgaggccgtgcgcctgactgagtctgtggacttgccacttttgtgtcgcttactacg

SEQ ID NO: 668897 - DNA, 279 bp, Homo sapiens
gcgggattgatctatatatatacacacagatatatacatacacgtatgcatatatatatgtgtgtgtgtatatatatatatatacacatagactgaaaatgggaaatctcaaggccactcagcgcttccagagggctcacagctgaacttggaatatcctaaaccgtgtattcaggtttatgaagtcccctgaacttggctcccatgcccgactttgtaccccacaagcacatcgctgcacagccgcagaggggctactgctctccaagggtaccgagc

SEQ ID NO: 668898 - DNA, 270 bp, Homo sapiens
gcatggcacaattctacggatgctggcagacaatagtgttggtagtccaccacctcaagacgaagcttatatctgaggctaagctctttaaaggccacgctaatctcatctctcatctatttgtcctccttagcacaatgtccaaacgcatagtaatctcagaacaggaaggcggcctggcttgctgaggagcccatccaggcacactggagcacatagagattcacccaatgtatgtagaacttcgcgtcatcctcatgcttgacttta

SEQ ID NO: 668899 - DNA, 398 bp, Homo sapiens
tccaaacggctttttcccaagaaaaaaatatagccagttgttttttcctgaagaaaaaaaaaacaccagcccaaaaaaagttccgaaccggcacccctgaaaatcccaacggtttacggcccccttgatttgggcacccaaaactcctttttaacctagcccggggaggtgccggtcccagattttaaagtaaaaaaaaaaaggcaacccgggtccaaaatgcggtttagtttcccccagccaaccccaaaccggggtttttttttaaaggaagggtaaccaaccggtccatccaacccctttttaaatttacttctcccaaaacccctttggccggggcccggcggcgggaggaaaaccacacccccttttttttttaacctttcccaaattttggg

SEQ ID NO: 668900 - DNA, 1052 bp, Homo sapiens
  misc_feature (441)..(441): n is a, c, g, or t
gacagtccctggcctaccataggcacttagaaagtatttgttaaaaattgattttttttttttaaagaaacaacccagagtttttttattctgccccaacccctggcattaaaataaatcttcctcaactgccatcactaatcgccaggattccctcctagccaattatgcttggactcaacctctacctcccactccacattccaaagtttctatttctttccattccagaagggcaactccacaacaggagtgagggagaggacctgactcctcctcagagtccaataacactcctaacctgctcccccacctgtggactttttaaatccatgaaaatagaacctgtcaagctaccacaaaatacatcagaagcagatcatctttcatagcatacaatctctgtaaatactgaaaaaagattatgaaaagcctgctaangtttgtctccagtgaaatagatgcaggcaagtattttgattgttctgaacacattagagatgagtgctacacagaactaaggtaaactttgtaaattcgtatgtcataacactttgttccacaaaaaactatcttattttttatactccatactgatacagccaagtaatgtggctcttattttctaaagatgccagcaatatgtttaaacatgtcttcattgtagtaaaagtatcatatttataaaaaatacatatgcatttaatgtgatattccttatagtcaaaatcttgatatcatcctgttaatctggctaaaaatgtatctgtaaaatgacagagaggaatattttgcattccctaaaacaacagttgttgaagctttggtaatgctggttatgggaatttaccaataacagggaatgaatttggatttcttttgtggaatcaaatggcacatgtcttattagttaaatatgtgaggtaatgaagttgagtttaggcacatccttatggcatataacgggacttaaagtcatttggacataggtggttttcttggcaagaagaatatagtcggtacctaagacaggtctatcagggagtagattc

SEQ ID NO: 668901 - DNA, 401 bp, Homo sapiens
  misc_feature (327)..(327): n is a, c, g, or t
cttttgaaatcacgtctaaaaaatatgactcagcctcttgagtagctgggattacaggcatgcgccaccatgcccagctaattttgtatttttagtagagacggagttgcaccatgttggccaggctggtcttgaattcctgacctcaggtgatccacctgcttcggcctcccaaagtgctaggattacaggtgtgagccaccacgcctggctaattttgtatttttagtagagatggggtttctccaaaggctggtcttgaactcccgacctcaggtgatccgcccaccttggcctcccgaagtgctgggattacaggcgtgacanccgttgcccggcctgatgtttttgaatgattatgaaaatgggtattacagcattaaaaccttagactgattttt

SEQ ID NO: 668902 - DNA, 110 bp, Homo sapiens
aaccactccaccttactaccagacaccttagctaacatttaccaaataaggttaggcgttagaattggaacctggcgcatagttatagtaccgcaggagaagatgaaaat

SEQ ID NO: 668903 - DNA, 578 bp, Homo sapiens
  misc_feature (251)..(251): n is a, c, g, or t
  misc_feature (565)..(566): n is a, c, g, or t
agtgaagtgaagacatcttctgtacctcattattctgtcatgacctggagcatcaggtggttgctgatgcagcagctcctatcctgaagaacattcttgtcatagactgaatgtttatgtccttgctaaattcagtttagaactttatcccagtgtgatactatttggaaatgtggtatttgggaagtgattaggctcgaccctcacttatgggattagtgcctctgtaaaataggccccagagaggtccntttccccttccatactctgtgaggacaaagtgaaaagtcagccatctatgaaccaggaagtgggtcctcatcagacaccaaacctgttggcaccttgatctttgacttctcggtctccagaattgtgagaaataagtttctgttgtataagtcactgtctatggtattttgttatagcagcctgcataaagacactactgtatgttccaaacactcatattcattatctataaaccttatataaacacatgagtgtatattatcatccctagtatagataaaataatggaaacagaaaataataaataactatnnaagttaatacaa

SEQ ID NO: 668904 - DNA, 144 bp, Homo sapiens
aagggaggccggaaggatattagtttgggggcggccaagctttcccaacaaaccaagggttttgggccccgggccgaaattcatcacaagtgccgtgtgcccggggagggtaacaaaggaaatacggtgccctgggggttgaca

SEQ ID NO: 668905 - DNA, 120 bp, Homo sapiens
tgcgaatcgagctcggtaccgttacaggctgtgccctattcgtctgggtacagaagaacacagctttctttagcaaaaacatttactttaaaaccaagcacctgtattgatattttagtg

SEQ ID NO: 668906 - DNA, 562 bp, Homo sapiens
tgtgatagacatatgacgtcttaaacataacacgtgctgcaaagaacactgatatccaaatgatctgccacatggaacaaatagggaaccatttttctagcctgtactgtctagggtttacaacgcacatgacctgcctttctgggaaggtgcttctgggtcataggccattcaaagcaaactttgatgacaaaaattattgcttcagctaatcttttatacatatttgattcatcattcatggtcaagctctcacctcaatattcaagtcagaaatagcttcttggcctgtacttcatctgcattttcaaataacacttcacattgtgaaagcctgctgaaagtacctaattaagcagcatggactctgcagcaattcattaatggcacagtgggcaggcacatcagcagcaaacgtaagagagggcaattccttcatttataatgttgtatgagaaccaggtctccagatacatttccagtgaaatgaaaacaaattttatggagtttaaacattttttccagtatccagataatttcagtgaggccacgagatctgctt

SEQ ID NO: 668907 - DNA, 678 bp, Homo sapiens
agcgggctgcatctggtctcgtcgagtcccctccgtccgccgctgtcgtcctgactctctctccctcctttcctcagaggatgtccggtcttccagatcaactcaacccgctcaaggagccactcggtttcatcaaggtcctcgagtggatagcttctatctttgctttcgccacctgtggacggttttaagggccaaacagacaattcaacgtgaatagtcctcctgcagttactgagaataaaactgttacagctactttggttatccattcaggttgaatgaggcatcatttcagccactccaggtgtaacacatatgtgatgtaaatggggaacgattacgtcctcataggcgattactcttcttcgtgcacaattctatgttacctatgcagctcttcgtgtacctgtactgatttgtgccttcttgctttatgttggctacacgagtctgtatctggactcgtcgtacacttcctatgatcagaccttgttgtcacacttgtagcacttttagtggttggtgaacacttcacctggtgctaagctctgcagattcacatagctatgggcaaaaatatgagaattcggcggacagaacaggctggtcatggctggcaccgggaacaagtctcgcatggcccaatactcggaaatgcttaaaccaacatattca

SEQ ID NO: 668908 - DNA, 293 bp, Homo sapiens
acccgctttgccccttgggcctttttgggggccccttttgaaccggtttggcccaaaaagccggggggggccgggccgggattcccgggggttcgtttcccctaaaattttttttggggggtgttcccctttttttttttggttttggaattgcccccctttttccccccccctgggcccccccacccacttacccgccccttatgggtttttcccccctcttttttttcctcccccccgcccttggtttgggctttggggggctcccaaaagggtttggtgggcccggatta

SEQ ID NO: 668909 - DNA, 203 bp, Homo sapiens
cagtgggaccacagacacccgcgaccacgccggcaattctatctgcataataaatagtagagacaaggatttcaccgatgatcagccaagatggtctcaacatcttatcttctctggaccttagcctggcctggaataacaccagcagctccccaggttctcgggccttatggactcaagattgaattacatcattctagagt

SEQ ID NO: 668910 - DNA, 253 bp, Homo sapiens
aaatacaaatccttttaagacagtaataccacatatagactctagatagtgtacgagatatcatattcaaattaatataaaagccaactactgtcattaagaaataatttaagattagtgctctagacagaaaataactctgtaaccatcaatcttattgccgacattccataacagtggtaggaaagatattctcatttattaattgaaccagacatttttataaaatactgattgactttgtacattatgg

SEQ ID NO: 668911 - DNA, 379 bp, Homo sapiens
aacttgtaatcaccagcacctgtacacattcacagctgacagtgttcagagaacgaaggacctttatcttggagcctttcagcccgccagatggtccttgtcattcaggccccaaacaaacaccttggttcttatcgtagctgctgattccagcccagcagccttctttctaatgaggcttccgctgttcgctttctcatcctcctcctcttcattatccgaagctaagatttttaatgcagccaaatcttcctcttctgcacggatccgtcccagcaggatgagaccatggattttacaatcgattcctgagctcctgcactgctttatagcaatttcaatatacctgtgatactctgtgcagtcattcagaaggggc

SEQ ID NO: 668912 - DNA, 756 bp, Homo sapiens
gggaacccgctcggtgtccttccatgctgtggaggctctgattgtttcgctctttctactgcttactcttcgggtccacactgcttttatgagcctgtaacactcaccctgaaggttggcaactgtgactcctgaagccagaagaccagagccccaggaggaacgaacaaattccagaggcgctgcttaagagctgtaacatttcaccgagaaggtctgcaggcttcactcctgagccagcgaggcagaaacccaccagaaggaagaaagtcttgaacacatccgaacatcagaagggaacaaactccaagactgtgccaccttaaagagctggtaacacctcacgtgcgaggttccgcgcgattacattttgaaggtcagtgagaccaaagaaccaagcaattcgggacacaaataccaatcttttcatgccagggagaagcctccttaaaaagacattgcgcgtgactaaagcaggcatgccaccagtggggtcagacaattcttcccttgaaaaggtttgatccatggggagccttgtacgaacgaaattcccttcctttttatcgcagatgagacttctttatgcttataggcaggggttccccgggcccagcacgtgcacaccagagtggagcacccggaaacattcacaggcaacgtagattcctttttcaaccttaagcacaagggttggtactcccaccacttttgttgtggatacagcagggcctcagagggtgagaagtggtctgc

SEQ ID NO: 668913 - DNA, 213 bp, Homo sapiens
cagattagcagaaggggcaagaggacagacactattctacatatcacataaggggagcgaggaactaccacactgtccatcaccttactggactcacgaaccctccagacgcctctttgtcccgtgaatgtcggaagttgatcagacgttgccttattccatgcccccttactacgtctctaggctcattcaacttgcctttccctcgggcct

SEQ ID NO: 668914 - DNA, 676 bp, Homo sapiens
ggggataaaaatgcaaccaaaggcggtgcggcactgacgaaaagcgtaaacacattaagagtctcattgagaaaatccctacagccaaacctgagctcttcgtttatcccctggattgggctattgtggattctatactggtggaccgtcgaattagaccatggattaataagaaaaccataggtgtataggcgaagaagaagctacattagttgattttgtctgttctaaggttatggctcatagttcaccccagagctttttagatgatgttgccatgaaacttgatgaataagcaaaagtttttatagtcaaaatgtgaagattattgatatatgaaacagaagccaagaaaatcggtcttgtgaagttaaactttttatatttagagttccattccagatttattctttgccacccttttaaggactatgaatccttctttgtctttgaacacattgtgagatctcgaatttttttttttttgaaaaaatgggaattttttgagcctctaattcgctgttgccctgggactcccttggtggaaagacatctgaatccttggtctcttagtctaccaagggcaaatgcgtgggtggttttttagccggaggtactggaccagcccatctgaataaaacaggtctgggaggtgggcctgaaaaataaaacactc

SEQ ID NO: 668915 - DNA, 185 bp, Homo sapiens
ctacccttgactcttgattaacggagaaaaatcttatggtaaaactagcctttcacataggtttgggtgtatttgttaaataactaacatgcgctctattttctgggtgtagaaagtattgggctctaggaaacatttacttgtgtgtgaaaagaataccccaaggtaataggccgcatccaaag

SEQ ID NO: 668916 - DNA, 714 bp, Homo sapiens
cgggcgccgtggctcatgcctgtaatcccagctgcttggcaggctgaggcgtttgagttccttgaacccgagagtcagagcttgcagtgagctgtgcaacacagcaagactccatctcaaaacactaaacaaacaatttaactgcctagaaggtagaaatcgagtgcattccttaggcctttgaataatagcccaacgataactcattcatattaaattatgacaacacactgcctcctgctaaactttcaaagcattatttccaactaaatcaggaagaacttcccacttttacatatgcacgacattgatgaccagccttactcagccgcgcctcgcctacccacccaaccctacctcttccataccacctcacaactacttgcaccctctaccggccctttacacccacatccgcctacccccgccttcgcctcacccctcatttcacaccactctctacccccacatcaccccatcactatacctcctcctccccccctccactccccccctcctcccctcctcccttcccctctcctccctccccccccctcctctccacctcccctcgaccccaccctccgcctctcccccccccccctctctccccctcccttccaccaccccctcttcccctaccacctcaccctcctcttccacccacctcgctctctctccctctctcaccctctcccctctccgccctctgcg

SEQ ID NO: 668917 - DNA, 213 bp, Homo sapiens
agattggaaacacaccagaaaaggggcgtttctttgccagcattggtgtattagaggtgtcatctctcctgtcctcttcggagtaaataaaggtgtgacacaagaagcagtgcgtggagggaggcacatatccctccctaaaaccacagaagataacctgatactcttttgacccactgcatcacactaaacagctgcagaccccctgaattt

SEQ ID NO: 668918 - DNA, 424 bp, Homo sapiens
cttttcggtggtgacgacctatgcagacgagatgatgcctctggtaaaggatttttttcatgcctctccaaatgaggagagaaggatgcacacgaagaaacacctggtgcagagccctaattcctagtttatggatgataactgccaatgatgctataaaatcaccacggcgtttagccaggcacaaacggcagttttaagtgttggctgttcaactgtgatgtgccagctttcagaaggaaaaggatggcttacagaaggaagcctctttaggaggaaccggactaaaagcactctaagtcaagatgattgggaaaccgaatcagttatcgacactttgggaaaaataaatttcatcgataaaaagaaaagatttcgcccgccaatcactttggctctggacttgggtttttggtgcgtccgg

SEQ ID NO: 668919 - DNA, 166 bp, Homo sapiens
gtgcgatcacatcgcggaggtggacagcgaggcaggatggagccgccgatccacacggagtacttgcgctcaggaggagcaggatctggatcttcatgtgctggggccaggcaggatctccttctgcatcctgtcggcaatgccaggtacatggtggtgccgccag

SEQ ID NO: 668920 - DNA, 732 bp, Homo sapiens
gctggtggcgaaaagggggcgccgtggccgctctagccgccctggtccagcgcctccctctctcagcatggactgaggagagcctggagtctggccttgcagacctacctgtgcgcagcatgcagcaggtggagctgtgccttgtggcgcctggcctggattctgtctgatgcatggctgaccaggcgccagctgcagggtggacctgaagggatgctcatctgagctcacctgaggccatgccatggtgtcatgtacaggaaggatgcacggttgtctggcctgcgcctggaccgaaggagacgcccgaggcctgccatggacacgatgctgacgtaccgaggcgtttccggggacggccatacactgcacggcgcgctgagaggcaccatgccagcgagcccgtggagtccgcgatcagagaccgtgcctaaagcgagaggcggaggacagacatctgcggcaggtgggcaggaggaggaagagggagaggacgaggcacgagctgagtggcaacaaaggtgagccgcgccctaactacagcacctgagccaacctggcgcatcacaacgccaatgcacgaagcgacacggcacgcaggccggagggactgacatcggcaggggggacacgaagcgaccatacacgtggtacccccaggaccccaggtcctcatgaacccagatgcccgagacaccatgaagagcacacgacgacggacaaagagacaag

SEQ ID NO: 668921 - DNA, 750 bp, Homo sapiens
  misc_feature (1)..(1): n is a, c, g, or t
  misc_feature (259)..(259): n is a, c, g, or t
  misc_feature (283)..(283): n is a, c, g, or t
  misc_feature (351)..(351): n is a, c, g, or t
  misc_feature (353)..(353): n is a, c, g, or t
  misc_feature (357)..(357): n is a, c, g, or t
  misc_feature (411)..(411): n is a, c, g, or t
  misc_feature (431)..(431): n is a, c, g, or t
  misc_feature (433)..(433): n is a, c, g, or t
  misc_feature (435)..(435): n is a, c, g, or t
  misc_feature (437)..(437): n is a, c, g, or t
  misc_feature (444)..(444): n is a, c, g, or t
  misc_feature (454)..(455): n is a, c, g, or t
  misc_feature (467)..(467): n is a, c, g, or t
  misc_feature (484)..(484): n is a, c, g, or t
  misc_feature (486)..(486): n is a, c, g, or t
  misc_feature (490)..(491): n is a, c, g, or t
  misc_feature (520)..(520): n is a, c, g, or t
  misc_feature (522)..(523): n is a, c, g, or t
  misc_feature (527)..(527): n is a, c, g, or t
  misc_feature (532)..(533): n is a, c, g, or t
  misc_feature (536)..(536): n is a, c, g, or t
  misc_feature (545)..(545): n is a, c, g, or t
  misc_feature (555)..(556): n is a, c, g, or t
  misc_feature (582)..(582): n is a, c, g, or t
  misc_feature (598)..(598): n is a, c, g, or t
  misc_feature (600)..(600): n is a, c, g, or t
  misc_feature (603)..(603): n is a, c, g, or t
  misc_feature (605)..(605): n is a, c, g, or t
  misc_feature (621)..(621): n is a, c, g, or t
  misc_feature (674)..(674): n is a, c, g, or t
  misc_feature (748)..(748): n is a, c, g, or t
nggtggctcacagcaaacaagtagctgtaaggcaggaagttacacaagcatttgcaaagatatttaattagaaaaaagtgttttaaggaacatttaatagaattatactttgtaggccacacaggttattggttcagattaatttaatcaggacttataaggtttgttttctgtgttccattctaaagagcataaatattaaatgcttataaaatacacttcattcaaaatgctttaaatacaaaacacaagttgggcncaaaacaatgcatcatggtctcgnggatacatttacaaaacactgtaatgaaaaattaacagcctcaagtaagtagataatactatacaacncntgcnccccaaatgccattttaaacaaagggggaaaaagcccccgcaatgtcaattagngttgttcttttaaccatatngnangnggttaanggggggattnncgaatttttagnggcggggttaaaattangngacnntcgaaacggggttaaaaacggcactgggncnncganggacnnacntgagggggnggggaaattnnggctttccggttggcaatagggccanaatacatgggggggcngntcncngggggcggcggggggngggccctaaacatttcacatttcgtacagatcgaggacggtgttcactagtanatacgtgtcataaactggactttcttggctcaatgacaggtgtagaaaatcgtgattcttataagactatctcnta

SEQ ID NO: 668922 - DNA, 158 bp, Homo sapiens
tctagagcgatcccctaatgctccctcttcacctgaacttacctcataagaaaacaaatcccagatgctgacaagcagatgacaaaaaagttgaccagcctccagaagctaaaaagccaaaataaaggtggtgtatagtagagctgcctattgaagcc

SEQ ID NO: 668923 - DNA, 125 bp, Homo sapiens
tcgtccgtcgtgagctgtactaggaactttcctaagaaaccgctgactacaggacaaaacacaaccaagggtacacgcaggcatcacgggtttcctgcccagcgacggcttagtccagctcccga

SEQ ID NO: 668924 - DNA, 482 bp, Homo sapiens
  misc_feature (10)..(10): n is a, c, g, or t
  misc_feature (100)..(100): n is a, c, g, or t
  misc_feature (121)..(121): n is a, c, g, or t
  misc_feature (181)..(181): n is a, c, g, or t
  misc_feature (189)..(189): n is a, c, g, or t
  misc_feature (236)..(237): n is a, c, g, or t
  misc_feature (258)..(258): n is a, c, g, or t
  misc_feature (264)..(264): n is a, c, g, or t
  misc_feature (287)..(287): n is a, c, g, or t
  misc_feature (298)..(298): n is a, c, g, or t
  misc_feature (392)..(392): n is a, c, g, or t
  misc_feature (401)..(401): n is a, c, g, or t
  misc_feature (412)..(412): n is a, c, g, or t
  misc_feature (451)..(451): n is a, c, g, or t
tgtttcctgntctctgtgttcttatgagttgattgttttttgtttttttctctctattttctctttatgtttctattggctaaggggtgttggttggttntggggggtttgaccgggtggnggcaggggcggagctcattcttaaagaaaaacctcaaagttcaacttcaaacagctgaantttgtttntttgctgtgggtcaccctgttcttgccacccaggaataaattataannttgccacctccgccgagggcnaaaggngctttcccgaactttggcctggnctgccccgggngccgccctcccggctgcttttttcaccaggggggtttttgggcccgctgttcttgtgttctttctttcgttgggttgtccgggcttctcccccngggggcttnttttttgcttnttctcctgttttctggtgaacccagggttttggggcttnttgctgtggttcacctgcccggcttgccctt

SEQ ID NO: 668925 - DNA, 346 bp, Homo sapiens
cgtgagaattctcttgtatacctggtgaggcagagggttgcatgtgagctgagattgggcctactgcactgcatcctgggggacggtgagactccatctcaataaggatagaatagaataactcttgtttaggtgttacagaatccagggcataaaagtctacagtttaatctcatacccagttcctagatgagtcccgttctccatgtcaggctcgtgacctaaacctcagggttgccttacttcggtagggcaccatctgctcccttccccgcctttgttcctctttgtgctctgctggctcctccggggttgggtgtgttcagaggcagaaataggctcaagg

SEQ ID NO: 668926 - DNA, 705 bp, Homo sapiens
atcagaggtgccttcttacatcagcgatttatgcactccaaggccgcagtgtggctgtgcaaaaacaaataatcttaaaaagcgtgtttcacagcaacctgtaccctgtcttggtcctgtgtctcgagtgtgaagatgtcaagaatgcaagggagtgtgtacagaatgggtcatatctgatcaatctggaagaaggctactgtacactgcggtaatcattggtatggaagcagttcacaaaatgaaaaaatactgactaagaccatcaaagcagtctccttctccagtgacctctatctgggctggctaatggcagctgtcacgctgatgataactgccttagtgaacaaactcaccaagagtatagattatacttggactgttatctgctgtttctgcttcaattaaagacgaaaaatctttgaaaatacaaccagtcccttgaaaagtggtctctctcacaagctgtcactggtctaatagacacaggaagaatatctgaagctgaaactctctgcacaaagaatttaaaaagtaccctgatcagccagccgttatcttacttgtgagaccaagttcagtgtaaaccctcctggagtcacaaaagcactcccagatgctgtacttgaagaacttacaaaacagtcatgtcgaatcaacctctgtccagcttggcgtgatggacatgtgttcaatccacgaatg

SEQ ID NO: 668927 - DNA, 1247 bp, Homo sapiens
gcagcgctgtccaccacctgacgtactgccccgtgtggccctatcatgccggacgaggacttcttcagcctcattcagagggtgcaggctaagcgcatggacgagcagcgggtggacctcgcctgggggcccggagccagggtggcaggcggaccgcccgagaccccagacagcagtgccagcctggatgcagagcataaggccctgtgcccaccgccaggcccaacctgacccaacatcctggacgaccggtctcacagttcacagaacaacgtccatcccgagagccaattgccgaggacaggacactggtgcatgcagccccacggacctcacccgaacccagggcgaccaggctcaaggccaaagcttagcccagtagagtgaagaagaggccgtgcttccaattccacaggcacattgagaccccatagacccttcacgattaccatacccttacatgcccactgacaagaaggactgaacggagacctagacgggcaatgtcagggcaccaggaaacttgttagcttggtcatgaattcacgcgcaatccattcatcgaccacaaagcaccatacacacagagagaggaccgtaggaccttgaacaaacatagtagaaaacaacatgcatagaagtcaaacagaagaacataacacaaaaagggagcgaacaatgacacacaagactgaagagaaaaacaacaaaggcagcacatgggagccagagaaacatgaccacgccgccgaagcacgggatccatagaaacacggaccacgcgacagacaagacaatggcaaacaagcaagtgccaagaaagggacaacagagaaagaaggaaaaaagagaggaaaaccgcgagagctgggaggcggccgcaggaaggctagaaagagacgcacgggaagaaggacggcagcagcgaacgcacagacgacaaaacaagcacggcagcacgcgcgtcacaagaacaacacacagggacaacacgaggagagagggaggagagggagcgagggacgagaggaaggccgcggaccggaggggagaggatggcgaaggaaaagaaggacggcaggagggagggaatggagagggacggaggagaagggcaggcggggaggagggagagcgagggagcgggggggaggagagaagagggtgggaggagggaggggagagagcggaaaatggagcagagggggaaagggaggagaggaggagggcggggaggagaacagggg

SEQ ID NO: 668928 - DNA, 180 bp, Homo sapiens
ggttttcccaggggggaaaaaagatgttttttccaaccaggccgatgggggggtaatggtgaaaattcctaaacaaggcaggggggggcttttttctttaataaaattggaaggtttttaaatttttttggaagtttggggggtttttccaaaaaagaattttaggattgttttccttta

SEQ ID NO: 668929 - DNA, 357 bp, Homo sapiens
aaattagccgggtgtggtggtgggcgcctgtaatcccagctactcaggaggctgaagcaggagaattgcttgaacgcgggaggcggaggttgcagtgaaccaagatcgcgccactgcactccagcctgggcgacagagcgagactccgtctcaaaaaaaaaaaaagtctcaagtagatagtgtctccagggtcctggcagaagcaaattgtaatcctttcttgaggatggtttttttttggtgggtttttggttttggaggatggagtctcaactctgtcgtccagaactgggcaaaatttacaaatgtgagaagttataaattaaaaattacaaattgtcaaaaaaacaaaaaaag

SEQ ID NO: 668930 - DNA, 516 bp, Homo sapiens
  misc_feature (426)..(426): n is a, c, g, or t
  misc_feature (470)..(470): n is a, c, g, or t
tcagttctacgagtgaaaaatggcttagaactacccacacacataaacacacacaaacaagggcatgtaaaacgggtgaaatctgaaaagctctgtaaactatatcaaagtcaatttccggtactatagtattaggtgggtgcaaaagttatggcagttggccggttttggtggtggtggtggtggtggtggtaggagatggagtctcatggggtggcccagacgggagtataagggcgtgatctcggctcacggcaacctccgcctcccaggttcaagcgattctacggcctcagcctcctgagtagctgggactacaggaacgtgccaccatgcccggctaattttttggtatctcaagtagagatagggttacgtaatgtgggccaggcgggtctggaacccctgacctcgtgatccacccgnctcggcctccccaagggctggggattacgggcgtgagccaccgnacccggccaaaatttttaatatttatgtatagaatgtaagcttttc

SEQ ID NO: 668931 - DNA, 475 bp, Homo sapiens
  misc_feature (17)..(17): n is a, c, g, or t
  misc_feature (92)..(92): n is a, c, g, or t
  misc_feature (104)..(104): n is a, c, g, or t
  misc_feature (135)..(135): n is a, c, g, or t
  misc_feature (146)..(146): n is a, c, g, or t
  misc_feature (148)..(148): n is a, c, g, or t
  misc_feature (154)..(154): n is a, c, g, or t
  misc_feature (157)..(157): n is a, c, g, or t
  misc_feature (162)..(162): n is a, c, g, or t
  misc_feature (167)..(167): n is a, c, g, or t
  misc_feature (173)..(173): n is a, c, g, or t
  misc_feature (190)..(190): n is a, c, g, or t
  misc_feature (194)..(194): n is a, c, g, or t
  misc_feature (306)..(306): n is a, c, g, or t
  misc_feature (364)..(364): n is a, c, g, or t
  misc_feature (385)..(385): n is a, c, g, or t
  misc_feature (399)..(399): n is a, c, g, or t
  misc_feature (403)..(403): n is a, c, g, or t
  misc_feature (411)..(411): n is a, c, g, or t
  misc_feature (468)..(468): n is a, c, g, or t
gggacaatataataagngaaattaatgatgatgtccattaatgctttaaaaaacattaaaaatattaagtatcctgttttaaaagtagaganatatttttaaanaactatttctatttcaaatagttacaatgangtaactcttantncttaanaanataanctttnattatntggataatccatttgtntggncatctcatttattttccaataatgtaggataagatggggcgtatcaaagtaactcaaaatcaatggactaatcaatttatgtataatgatatggttcatcagaataaatgtnatgaatttaaaaatcaccaccaattcctttattttctatattatattcttttaaagtncccttttctcctgtacttgantatgccataaaaanatgnactttttnatttagaatatccagttcattttgcatctttaatatgctattatcatactggattcnttcaagg

SEQ ID NO: 668932 - DNA, 331 bp, Homo sapiens
caggcgactctagttgatccaccctagctatatgtcgtgcactctatccttgacttactgctagatcctcctttgggtgttagtttcataaaaactttcgcatgggcgttattcttatgtagaaaatgcagcccatttctttccaacccataagctacaccttgacctaacgtttttatgtgttatgattgtgcttactattgttcctttttagggcttgctgaagatggcggtatataggctgaattggcaagggttggtaaggtctatcggggtttatcgattatagaacaggctcctctaggtggatgtgaagcaccgccaagtcctt

SEQ ID NO: 668933 - DNA, 1088 bp, Homo sapiens
  misc_feature (700)..(700): n is a, c, g, or t
  misc_feature (734)..(734): n is a, c, g, or t
  misc_feature (770)..(770): n is a, c, g, or t
gggctataaacgtagggtttttgaatggtcctcctgtgctggttgaacccggctattttcatggtttccaaacagggtttttccttctccccagagttcctcagactggctgtgtgtgtggctcacggagaggtcagaatctgtgcactggatgggtaattccaaggcaacaactccgggccaatcgtctgtgcaaagaacgaagaaacggttaaaacaagcacgcacggaagtaagcacgcaaggtaaacacggaaggtaaacgaagaagaagaaagaacgtttgagattccaagcgtctcttccgtccgtccttccaacgtccgtctcctttaacaaacgccacgggggaaattccgggaatctcccctttcacaacctcggtctccttctggccctggaggggtttcaggtgggctggctatccagacccacggtatccggaatatcagacagaaaggctggcggtatttggaagcaaacacccctgggaagagtttggtagaggggtattggaatggcgcaaagaaatgggctgtgagaggaaatctctctctctcgttcctctcgtccctccatccttccaaccaaactgtgctgcgaaccatcctccaaggaggcagcgcaactttataaacattcagagagtatattaagtctccttcctggtggccttccggggggcatctcatgcgcaaangaggcctaaggcccaatccttcttaaccaacggnctcttaggctttgggttaaccaggcaaaacctgggngtctggctacagacagtgtaggcgagtcacggaacctttacaggattacgcctaaatttaccggaaaaatttaaccggaatgaaaccctggacaaaaactggaagaaagccgtgggaaggtattacgaaatagtagtctcagttaggtcccctttgaaggaacctctcagggtggtcctcgggtcctacgttcgggcactttccacacgtgggcacactcgcgacaaccatcagccgcggctatctaccaagagtgctgcagcagtagcttttccacacgaatatcgcgggagccagcacaatactcggcccgttgcg

SEQ ID NO: 668934 - DNA, 420 bp, Homo sapiens
  misc_feature (5)..(5): n is a, c, g, or t
  misc_feature (347)..(347): n is a, c, g, or t
ccttnccctaaggtaggggtgaatgcctaaaagacgggttggagaccacgagaggaactcctgactttgcctcctcccatcccttcctatgaggttgacacaaaagtaattgcagttttttcccattaaaagtaatagtaatggccgggcacagtggctcatgactgtaatccccagcacttgggagactgaggcaggcagatcacccaaggtcaggggttcgagagcaaccctggccaacatggtgaaaccctgcctctactaaaaatacaaacattagccgggtatggtggcacacgcctataatcccagctacttgggaggctgaggcatgagaatcacttgancctgggagacagaagttggagtgagccgagatcatgccactgcactccagactgggtgacagagataagactg

SEQ ID NO: 668935 - DNA, 273 bp, Homo sapiens
tgcattcattttactcatttagcagtgtgctccctgatcccatcccaaggcagaattaattccaaacccttttagttctttctcaaattcctaatcctagccctactggatccggtaagatcactcattatttacatgaaattctctcagttatctctcaaatacatatctatacttttgcatctcttcttggcactcttctctatcctagctagatagcttctctgtgttcaagatttaggtttccatttgcatccttggcggtaaaagctt

SEQ ID NO: 668936 - DNA, 418 bp, Homo sapiens
gtataaacaagctcacgatacggtacatcatgttgaacttgacaccgtgagcggtgtctgtgaaggtgtgcaacaagacggtgctctagcaccaatgaatcaagtgacgttggcagcctatgaatatgacgctaatagtggcggtttcgacagcgctgatctacagcatgatattgtcctgcagatagagccctattgtgcctagttagtgcatggtgatacaggtttcagacaacttagccggcagcagttctccatgactatggatatgctcggtaggcagtatctcttcgcacagccatctgcatagcataagcaacagcacgagcggtgaccacctatacgtctcggcagtcaatgtgccgcacaaagtatcaatcgcgtgccagtctagactagtagtcagtgcgcgcgtgtt

SEQ ID NO: 668937 - DNA, 684 bp, Homo sapiens
  misc_feature (1)..(1): n is a, c, g, or t
  misc_feature (43)..(43): n is a, c, g, or t
  misc_feature (98)..(99): n is a, c, g, or t
  misc_feature (156)..(156): n is a, c, g, or t
  misc_feature (172)..(172): n is a, c, g, or t
  misc_feature (190)..(191): n is a, c, g, or t
  misc_feature (221)..(221): n is a, c, g, or t
  misc_feature (248)..(248): n is a, c, g, or t
  misc_feature (296)..(296): n is a, c, g, or t
  misc_feature (301)..(301): n is a, c, g, or t
  misc_feature (320)..(320): n is a, c, g, or t
  misc_feature (363)..(363): n is a, c, g, or t
  misc_feature (379)..(379): n is a, c, g, or t
  misc_feature (423)..(423): n is a, c, g, or t
naatggtcctccatccttctcactgttaggtgttgctccagtnatcctatgaattcacatatgctctcttgagtcttctgatgaatcatgtaagtatnnttggccttcattcatagaggatgtcaattgctccatagaacgaatcatatcactatnctcttccagaatctgngtgacttcttctggaagnngcatggctcgaacactaagcgtggcaagtntattggagttagttatggtgattagcncgtcagagtcaacttggattccttcagggattatgctgtgatcttctntcatntggtgtatgactgcaactntatgctgtatgcctatatcttcattgaccatgtcaacttatgngggttatgtgattgtntctctgaatggaataataggttcagatacactgatatgaatctntgcaaacctttcttataagtcatccaggcatcgctgaaggtggacttctcctgctgtgactaaaacgtgctctcccgtctccacgagctgaggcatttcacttggatgttttggttcaacagcaactctcacaataggagtggcttcgaagttgagtggtataaatggtgggcaggatggcaggctacacagtgttgcagatttcagcacaaaatcttgaaggcctcctattcctagcacatttcctcgtgccgaattcct

SEQ ID NO: 668938 - DNA, 1010 bp, Homo sapiens
gggggagcgcatgtcagccatggcaagccgtctccggtctcaactagcggcgcctagatgcccatcctggggttgggtacctggaagtcccactccagggcaggtgactgaggcctgtgaagggtgtgccatttgagcgtcgaggttagcctgatcacattcgagctgttgcccattgtgtgaccagaatgtactaatgaggtgcggtgtgcgcatgtctaggagaagctcagaggaatgacaagcgttgagtgcaagcgatgtagagatcatcttgcaatcgatcgagcaacgtctgttgtgtgtcacgataaccattgcaagcataggtgcgctggatgaaacagcagtagctctgtcgcagcaacggacaacttcagtcagcaccttggatacgctgcgacatacgctgggaacgctctgactctgtcattgcaacatggagccagacgctgggctttctaaagacacgtgtggcacagagcaactatcttgtcaccagttgggactagagtcgaggccacatgatggttacaccgagatgactcaccagaccacttcatgagaccacagatgggtcgggccactggcacaggacgctggatggactgaccgggcctggatgaacagctactagagacatctcactgagattatcaacacagtcctccgaccgatgtacgagcatgagtcgtgtacagccaagacacgtgagatcatgaaatctactaaagcgtgcgagcgttatacgcagacttggcagtggccaaccactatactcctcaggtcgagcgaggcacggtgacgtacaagtaacttggccaggatccacaccgggacataaggagggatagagcaggcataacaggcccacacgtcggggctccaccatgcagaggaccctggagccaacaacccgaaggcaccattgaagaccaggaggcatcccaggaatcaagggcgaacacaagcagggagacaaacaacaaaaaacagcgcacgaaccaggg

SEQ ID NO: 668939 - DNA, 944 bp, Homo sapiens
tggacgcgtgggttactatgggccacacaaaggccatggataaccctacccgctttatgtgattacccatgggaaacacaagaggctacttctgttagggtacatggaccttggtcaagcatcttaaaaaaaggcaaccctagatagagagctgtcttggctgaatagatctgcaccacaagttgtgatgtcctagtcgctaccactaaagtgagcaatggttacagccgtgtgctaaaagtataataatggggtgtggcaagtgctctatctagtgtctggaggggtggtctatatagctacgagtgtgacgagtagtgcatccgggatgggtgtggaaaaagtaggacaagagatcagagaatctgcatgatgaggtgcgcttacttttagtgactttatgtacttatattaacagctggaaataggttgtgggttttgagcaggctgttatagtgaggaatgttcatttttaaatgttcctaacagatttgcttttgaaaaatgcttgttacatgaataatttgtggaccaggattgcttttctgaaggcagtatagggaacatgaatattcaagatgaaatacaaaaattatgtttaagggtcatagtgtataagtagcttcctaggaaaccctttgtgtatcttttcagactggggtgggggctgagcatgcttgtgcagaaaagaaggcatagcagaaaggacagaatctcttccccaatcccttggccaattaacaaaataagctagcaagtcttggtctaataaatggaattacaatagggtgaagtaggcttatattcaagggacgaagtctgggagagtaaatagaaagggaatagaccctttatttggagggttggaattggtaaaatatggaaattgggggctagggcaaaataaaccgggttacaaggttttaaaaaaagatttgtaacag

SEQ ID NO: 668940 - DNA, 486 bp, Homo sapiens
  misc_feature (447)..(447): n is a, c, g, or t
  misc_feature (465)..(465): n is a, c, g, or t
cagaagcagctggccgcctggtgctctctggttctgtccttctgccgcctgcacaaacagtccagcatgacggtgatggaagcccaggagagcccgcttttcaacaacgtcaagctacagcggaaacttcctgtggagtcaattcagattgtattagaagaactgagaaagaaagggaacctcgagtggttggataagaataagtctagcttcctgatcatgtggcggaggcaagaaagaatgggggaaactcatttaccaatgggtttccaggaagtggccaagaataactctgttgtttactctgtatgaacttgacgagtggggaagacacagaggatgaagagttccatgggctggacgaggcgaccctgctgcgcgctctgcaggccctacagcaagagcacaaggctgagattatcactgtcagcgatggccgaagagtcnagttcttctagcagaganctggctcctttacttcttacc

SEQ ID NO: 668941 - DNA, 135 bp, Homo sapiens
atctgagacaagaccatttaactgcaaactgttgtcgttagtcaactggagttgtcttcctgaagatatgaatccggtatgtattgtgtgcgcagagagcattaccgtattagaatcttcatcactaaaacaggg

SEQ ID NO: 668942 - DNA, 554 bp, Homo sapiens
gagagagagagagagagagagagagagtgagagagagagagagcgagagagagagtagagagagacagagatagagagcgcgatatacagacctagagagtctctgtctcagagacacccagagttgcctacctctttagagcactcgcttctcagtactttcagaccgatactgcctttggcacggacctcgtggattatgccaagagcccacatgtttctgcctaggcccagacttactctgtgacgtcacaggtgtccctctcacccctcatcatgagcgcttgttcggagctgcgcatactttcgagctatatctggcaacttggcacactacctgacaccctgtgttacgcccacacctttgtctttctaccccggctggcctttaggacacccactggcccttgctttagcttctgtccctacccactctctgcttcaatacatgctgaacggatccacagatgtgcttcgagttccatattcagcttgatgtctccacatgtttattatcccttttttgcatcatctttacctccgattatgctcgg

SEQ ID NO: 668943 - DNA, 131 bp, Homo sapiens
cctgagggaggatacgatcatagaggagggaagcgagccgagatcaggtagcctggctgggcggacaacgcaaacagaaagaccccaaaaggggcagccgcgacacacgccggcatgaaagcaaacgacgg

SEQ ID NO: 668944 - DNA, 120 bp, Homo sapiens
  misc_feature (31)..(31): n is a, c, g, or t
  misc_feature (49)..(49): n is a, c, g, or t
  misc_feature (78)..(78): n is a, c, g, or t
tatatgatctatacatcatgggcgcgttccncgtctgacgggaaaccgncgttaccaataatcgcctgcacacatccntttcgcagcggcgtatacgaaaagccgcacgatcgccttcca

SEQ ID NO: 668945 - DNA, 641 bp, Homo sapiens
  misc_feature (343)..(343): n is a, c, g, or t
ccccggaccgcatcttcaacttccggcctaatggatcccccgtcgagttcccgtacgccgcctttgcccccagatttccacccggtaaccgagccaatttcccggtgtgtacaactcgacacagaaccgtagggttgcaaacgtagtcccgtcccctctaacacactcaaagtcaaattggccaggccaattaggtatctgaaacctatcgagtaacaacacgacatagcggctggagcataaatctatcaacgtcactatcatagcttgcctcaccatttattgcctaggaatcgcagggcgaccatgcgagcgtccttgaatcgattgagcaacttcagangtagtaagctctcacggacttgaagtcctccacagttcgtatgaataacttacagtcaacgatacgacgtcattgcaactcagtgagtctgtcgcccagcattaacggcttaagaaacagatgcaattcgccggacgtctaaaccaaaccacgtttcaccgctacactacctgggggtatactagcggtcaatgctctgaaatgctgtggagcaaaccacagtttatgcccatcgtcctagaataattcccctaaaatcttgaataggccctaactacccataacccctacctgctcg

SEQ ID NO: 668946 - DNA, 374 bp, Homo sapiens
actcgagctcggtaccgagtgactcgactcgggtactggaggatctctagagtcgacaggctccagtgtaaacgagtattaggagggcagcacggtgctcacgtgtcgacggaacttgtacagggaggcatgcaccgcagtggtgaatacacgtcgaccaggatgcatgtatgcgagattgggaggtgagcgaggagctcatgtattgaaggaacttgtatagggaggtatgcaccgcagtggtgaatacacgtcgagctggaggcatgcatgcatgctcgggtactggaggatgctctaaagtcgaccaggctccagcttaacgatattgggaggtcagcacggagctcaccgtgtcgacggaacttgctaca

SEQ ID NO: 668947 - DNA, 247 bp, Homo sapiens
agtgatgcagtatatgtgtgaagtgtgtacagtgggtgcttattagtggggtgtgtgtgattaacgagtgccgtgagtagagagtggtgtatgtagtggcaggcatttagtggaattatgtgtgagtggtggagtatgtagtagtgggttgtatgtgtgtaggggtgtatagtagtatgtttttagtaacatgtatttgtaagaagtggggagtgtgtgaatggtgggtatgtgtgctgagtggggt

SEQ ID NO: 668948 - DNA, 405 bp, Homo sapiens
  misc_feature (305)..(305): n is a, c, g, or t
  misc_feature (347)..(347): n is a, c, g, or t
  misc_feature (356)..(357): n is a, c, g, or t
  misc_feature (386)..(386): n is a, c, g, or t
  misc_feature (398)..(398): n is a, c, g, or t
gagaatgaatagaaaacagtaacaaatatagtagatattaatccaatgatatcaataatcactttgaatgttaatggtatgaatgtaccaattcaaaggtagagattgtcagagtctatcaaaagacagacacatcttgtttcactgcactttgctttattgtgttttgtgaccatgtgttttacgtattgaaggtttgtggccaccctgcaataagcaggtctcactggcaccattgttcctacagcacgtgctcacttcacgtctctgtgtcacatttcggtcattctcacagtattttaagntttttattattggaatctgttgtgggtgatctgtaatcagtnatctttaanngctactgttgtcattgttttgggggaccnccaatcacaccnggggtta

SEQ ID NO: 668949 - DNA, 955 bp, Homo sapiens
attcctgggcacacccacaattcccctaattctttgaaaaccctttttttttctgcgacacctcgttgtaatacctccctgaaatacagttatatcccgccctgtgtcccccccccactggggtggtaaatttggcagattatcacacccacccacatgcgttggtgtagttacacatattcgccataagttgccccaaccagcttgggaacagataacctgttttgctgggctgtcatgtaagaatataagagaccgccgctccctatatactacctcgccctctatgtttgaatacccgccccgtccgaaatttcatatattaattggagaaggaatgcgattacgttgttattctcttcccctcctaagtattgattcgatattttcttatctctacgaaacaaaaatggaaactctggtccgctcctctcctcacacctcaccccttttgcgtgggtgtctcgcgactcaacaatgaatgttgataccctcccccgccgtttatagacgtaataatcacaacaagagcccctccctttagagaaaggacccctttcgcaccccgtaatttgtgttcttttttcaactccccatctaagaatacgctattgataaataaaacaagagcctcacttagtttaaaatccatagcgcgccccctcctaagccatgagatgcccaactcgtgggggcatcaccacacaagagcgcccccaagattcttttccgagcgtgttgtatcaaaagtttactatctgtatcgtcagcggccagtagatggggtggtttgtttagtatttcatgacaataggcgtgaaagggaaagggcggtcatgtatctatgaaagacacgcttaacgccctacaggctggggtttatggccccccactcccccagaatattttacttccttggagacaaaaaacatggggttttccacccacaaaacaa

SEQ ID NO: 668950 - DNA, 1079 bp, Homo sapiens
caggatgagctctgctgtctctgggtggatcatcacagatttagccgggcaggcacgtaaagggtgtcctcttactattcaacaaagtgtagactttcttacatattcgcgaatacgttcagcagtgtgtgcactctttacaaataagttctgtcacaacggagctaagctgacacatttcaccgttgagtgcaactggcgcatcatacatatagacttgagcaagctcctgttatgacgtaccgtgtccagctgacttcaacaacatttgactaacgggacaacgtcagacttttaagcacgttattactatacgtgtaaccgaacaacgcctattcctattgggacttaactactaaggtaaggaatgcgtagccttgtcggccaccgcaaatgacttaccgcacggctcattccccattctgtcaattccctcagacagacaattctatgacagtcacccaagtgtatcacttttacgctggctcatgcggcattatatatccaagtaacacttacgaaccgcaaggactttctgattctaacaactatgttcaaacactcttggttctcacatatatttaccctcgataaccaacttacaccgactctatttcttcttcacttctattgatgacacactacgatcatccccttcatttcaacatgtgcctcctacagcactcttacattctctacgcacacagacctttctctacactaagttggacctggtcatcatttcctcctttatgatacgactcccaacccatcattggcattcttggtatacaacacccctcgggtccctacgaacacaccccacttcacgtcacaagccattttggcaccagtactgagcttcaagacgcgacgaaggattatcaacgtcctcaaacacgcacccctcccgtgtgaattagatacgggtcaacgacagtcacatttatcacgccactctggccgtctcaccttcccgtccacccgtatatgaccgtctgagcactttccccatacccgtggcaccttcgcttccacggtacgcatcgatatgcaccacttacattagcataccagtt

SEQ ID NO: 668951 - DNA, 109 bp, Homo sapiens
atttgaacaagccgagcttttgcggcctgggatcgctgaaagtgatggctgtcgtcccggcgtctctctcaaggacaaggacgtaggatcaatttgcatattcttacaa

SEQ ID NO: 668952 - DNA, 121 bp, Homo sapiens
ctcgggggtggggaaaggggtcggctgtccatgctcatttgttggtccgtgggccggtgcccaaaccaaaggctgggttcatttgtgtaacgccaataaacggttcttgtcctttcgggca

SEQ ID NO: 668953 - DNA, 108 bp, Homo sapiens
ggctggcgaagggcttattgaagtatattcccaggcagttaaaaatcggttatattccactttctatcttacaaaatgtgaaaaggcacatggttttctattcactcc

SEQ ID NO: 668954 - DNA, 454 bp, Homo sapiens
gtctcatacaggatcccccttacatctcacattgataattactggttgaaggacttgattattatcccccattagatcatgcgaatcaaggtaaagtaactattcagtctcacactgctattcatagcattgtactgtaagctatagctagcacaataaggcgaattaatttatagcattcagattcttatggaagaagttaagcatccttattcacagatgacatgatcctgtatcttataaaatcctaaggaacccacaaaaaaaccctactagaatgaataatactagtttactcaggtttgcaggatacaaaaaccaatatatagaaatcaattgtatttctatgcaaaaatgaaattgtgagaattccactgacaattgcatcaaaaagaatagaatgtttaggaataaatctaactgagagaaattaatgatctaaataaatagtccg

SEQ ID NO: 668955 - DNA, 124 bp, Homo sapiens
agagtcgatcactaacttgaatgctttctggaagcgtcggctgccatttcccattagtagcaagtgtatccaatgcatcaacacgagtcaatgagtagttccctagtacatcattgatgttcag

SEQ ID NO: 668956 - DNA, 780 bp, Homo sapiens
cttgaacccagtaggtcgaggtttcagtgagctgaaattgcaccactgtactccagcctaggccaactaggagctaaggactcctgtctccaaaagaaaaaaaaaaaaccccgacgaggtattaacgacctctccaaggttccaacattgaacgggtttcacctacacgtacaactatattgtttttttgattacaccacggtttacccgggtggaagcactcacttactgttgccgggatgtaattcttttccgacaaacataagtgccgggggggtgaaaaattaactgttattgtaagcaccaaagaactgttactgtctggaagttgacattgaagaacattgtttcccacctaaattcccgtattgaaaattagttaaatttcctcttccagctcctcaagttcattaggcaaagtacacctctttaaaccctacttttggctcaccgtggaatgtattagtcgccaggtgtaattaaggtggccatacagttgttcatactcacacaattaccccacgatttaaattatacattttttgcggcagaatttatttaaccccctttgggttaatactaccaggggaaaggccacaccatttgggcaactgggctcctgtggaacagcatcaactggcccactttttttgggaattcccttcaaattcatgttccattcaagttttacataagggtaaaagtgggtccttggcgccaaagtttacctgggaccccaacttggttggtctcctagaagttcgacaggatacccggtga

SEQ ID NO: 668957 - DNA, 473 bp, Homo sapiens
atttctgttcctcagtaggatccttgggtgtgctcatctcatccctccatttggtcaaggtttgcccatcaatgtgcaggacccaggcaagttcacggcctgtcctggagaaggggggaagcaatgacattaacggcagtcccctcgctccttgccagtgacgctggggtcttaaccaaggtgtttgcaagtggtgacttcgaaactggcagggcactcatagcaaaagaagccgcacaccacggaggttccttggccagcattatttgcacaacagggggtggcccgttcccgtaataacttatagggtacatcatagcctcagttttttgtagcccgctgtatccacctcccttatatttggtatttttcctcctttcctatatgtctcgatggccttagttcttatgtattaatcctgtctttcgtctatgatatttcattttattctcttccctcttatgttaacattc

SEQ ID NO: 668958 - DNA, 777 bp, Homo sapiens
gacctcaacatttggaagttagaagtaatacaaaaatttgcttcagtatataatacatatgtttttcagattcctacaaagcataaaaattataactttcaaaggccgggtgcattggctcatgcctgtaacactagcactttgggaggcccaggcaggcggattgcctgagctcaggagttccagaccagcctgagcaacatggtgaaaccctgtctctactaaaatacaaaagaaattagccaggcgtggcagtgtgcgcctatagtcccagctactcgggaggctgaggcaggagaattgcttgagcccgggaggcagaggttgcagcgagccaagatcacgccactgcattccagcctgggcaacagagcaagactccatctctaccgaaaaaaaaaaaaaaacaacacaaaacaaacttttggggcgggcctgggcctagaagagaaaggttttctaaaacccattccggtgtgggcgcgcgcgcagggcccccaagtagggggtacaagtgcagacacgtgtgcggcaacagcgggtggtctccccaaagagagaaaaccccgcggccataggaacatcacgccgctggggtgtttttctcacccccaatataaaaaaacaccgccgcgggggcgcaccccccaggcgtgtcttcggacacaaactcccgaggaggggaaggtgccgaaggggccgacagcacgaccggggcgctctcccacacagacgggggccccaaggaggaggcgcaggaaataaattacgagaggg

SEQ ID NO: 668959 - DNA, 504 bp, Homo sapiens
agatgaatttctttacctgcagaatgggttaaactgtgcttaacagctttaaggtttttgtgagattaacagattgtgaaaaattaaacttagccaaatctcatgtgaggattaaagaaagcgatgtcccagataagtcaatgtgacactaaagatctaaacaattttttttaacttttaagttttatatcaaatttcagcacccagcaaataataggcactgttaatatttgcttaatataacgtagctgtgaatttttacccacatttaggcggacgggaaaattaacgccagaatatcccgaaagtcaaattttgtcatcttacacttaggaagttacgttaaaaaattctcaagtctcgtagtatttttcttaagcgcaatttgggaatttccagttacctcgtggtttccgtcatcaggttcttggcaaagattgcaatacagtagttttagaactatattaactaggtattccattaactaggtaaaaaccactcgac

SEQ ID NO: 668960 - DNA, 127 bp, Homo sapiens
ctaaactgccccttctagcacgtgggcctcactaggccagtgtaggtgcactaggcaaacgtaacctagtgttgtaggctcagacagtagttgtatctcaagatagttaactcttacaggtagtaag

SEQ ID NO: 668961 - DNA, 682 bp, Homo sapiens
gggggatcccgccgtcggtgttgaactataagagctcgtggtgtgtccggtctggctttatagggtcggagatgcctgcctctcagttgcagaagtttgtgcggtagagaacaaaccccgtgatgtgtactcgacgccccaggagggtccttgttggaggtggaaactcaaggagaatttgccctgcaagaaaaacatgaagaaaacccaggaatttagcaaggtgagagaggaaagaggatagcttgattggctctcagaggaaagctagagggactctgaggatcatgcaagaaatgcagaaggcagctattgagaagaagtctatgcatgaccaagagaaaagtgaatgactgcgtatttgaagaaacgtggggtgttactggccagttgggtgtatcataaggactctaagatcaagatttgggtagagtggacaagtcagttacgatatgttataatcttatcctttaaaaactattttaaactttatccttttcagctttacttagtggatgttagaagcagtcttcaaagaataaaagtaagcatgctgtgacatattggtgaacattatttgtattatgagcgttcatatttattattaggtactatgatcagatactaggactctattataaagaacttttggcggtcaggacagcagtgctgaccaaacaca

SEQ ID NO: 668962 - DNA, 303 bp, Homo sapiens
gccatgggataaaatgacataccaccaatgggtttcccccctggatatttttttaaagacttttttcctgtttcccctacataaaacccggtttgataattggatgtttgggagataaattggatggtgagcccttaaacccaggggggctggagaaaatataatgggggcatgattttaatttaggggcaggttgggtgatgtccctgaacccaaaggggtttttctgagggaagggaagggaaaaaggaggtttttggatttttttgggaccaaatataaatgaagatttttttccctgga

SEQ ID NO: 668963 - DNA, 117 bp, Homo sapiens
ccccttaaaaaggtttttttctctttttggggggccggggggggcggttcccagggtcgggggtttgggcccctttggggtaccggggtgaattcctttttttttttaaccccccca

SEQ ID NO: 668964 - DNA, 624 bp, Homo sapiens
agagcaaacagacgccccccccccaatcgcatgggcatgagcgaaaaagcgagggaacatggagtaacgacgggcactaaaggaaacggggcgtaggagcgtataagagagacagaggataagagagacacacgacgagacgacagtggggaagcacgaagagagaaaagacgaacaggaagagcgagggaaaacacgagaaagagagggggaggacacacgagaagagcaacgaagaaaagaggacgaacaagcagagaacggaggagagaaggaaagaagacaacagagagaagcgatgaacaggagacaaaagaaagaaaagagagaaagagagacgaagaacagagaagaggaacggaggagaagaacggcacgcagaaagcagaaaacagaaggacgacacgaacaggagaaaaggagaggagaaacaaagagaaagaggaaaagagaagaaaggcacgagagcaacgcagaggaaggaggcagacgaagaagaaaagagaacagaagagaaaaaagaaagaaaaagaggcagaaaggagaagagaacggagaaggcagagcaaggcacagcggagaagagagagaaagaaacaaagacgaaagaagaaagcgacgcac

SEQ ID NO: 668965 - DNA, 854 bp, Homo sapiens
cttagaacaacttcacaaatggagcatccaagaagtaatatgatgattgctctctaattgggtgagcgagtcggatacatgtattcatccatgcaaccgatgcctgcagaatattctctgcgcgctcgtatctgtcgcagggtgctgtgggcgcaggacgaagtccaagacagattacgatgcctattttcttgaagtctttactctagagggagacatagaatataattaagttaattttaaaaaatcaaatggtgaacatgctatgtgagtccaactatatgacattcaggcaccaagtcaagcctatagaacaatatcagtggtgggccagagatttcagagaaagggccacgattaggtaggggacagcagatacagggcagtgaaactatctattttctgtactgatgactacatgagcattgtgaattgtcaaaaacctgtacacaggtatgaagaatgagctctaatctagaatatctacactatggacttaataataatacatcaatattggttcatcagttgcaccacatgaatcacaaccaatgcccagatgttcatacccgggacccctgcagagatagggacgcacgggtatgtgagaaccttggatttctgctccgttttctgtaaaccttaaaatactctacacaatagtattttgaatttcaacacctccactgctgtcagtgcttggacgcagaacaacacaacacacaacacaaacactgtcgcgccccgccctgaaactctcacccgtctggcccgcccacaggcctgtccctggcagcaccggctaattcgtcgcacaaacccggcggctcaccacggtcgctgtcacggcacaa

SEQ ID NO: 668966 - DNA, 472 bp, Homo sapiens
cagacatgtagtcttttctagttattgtatttaacgggtattgtgtccttgcatttcttcttagaaaaaaactaattttaggtgctgattggcatgtctggtacacagtctatgcaagtcatgctgaatactggtcctctcttctcttgggccctctcccttcctgggcccagtctgggtcactgcttcgcttctggtatctggcgttctttggtacacagttctggtgttcctaccaggactcaagagacagcccttcctgctgacattcccatcacaacattcctcagacaagcctgtaaactaaaatctgttaccattctgatggcacagaaggatcttaattcccatctctatacttctcctttggacatggaaagaaaagttatagctggtgcaaagatagatggctgaacatcagggtgtggcatttagttcccttatccgtattacaactaaaatggtagtagta

SEQ ID NO: 668967 - DNA, 154 bp, Homo sapiens
ccccgtattatcaatcgcacacattggatgaatgacagagtattaccatatacacaaccatacaatctaaaacattatttataaacctgctggccgctcctgagtatattatcttcagtgaggcggcgggtattataacacacgtctggcggct

SEQ ID NO: 668968 - DNA, 784 bp, Homo sapiens
taattctaaattacagagtcatttgagctttctccccatcccgctagtatctttacaggagcagggaacgagcacgtacgatggctgtactaactcttttggcgcgaacgttaacattacaaatttacttctgagtgttattccctacaaccgtcatttacttctggcttgtcttttggacggacgatcacacactaagagaacgttgattgcctcggctatatgtgcttgtgcttggacacttatggtcactttttgaacgcatgttaataaatgtcactgattaaaacagctggagcatttccttccctttccagtgaatggagcagcatagtgaaatcctggcacccctcaccttatttgtgatgacaagatggctgacagtcacggagtccaggagaaggtgctgctctccttgctttctgagtacaacagagtaatgtacaactttcttattttcccaaatgaaatgaacacgggggaaactatatacagtatgtccagaccagccaaattctgtcatgatctttacgtatcaacctgctgtatattagagcaactgaatctcaatatggcactaacgttgaccgtggtccagtttcaggcattacgtgaacttcctttaccaacagttctatatatctaccatctttcctagttatattccaacttcgactgatccatcctgtgcaacactccagattacgtgatggcggcctacttgacgagtattacccgcatccctctgttgcatcctgtaaagacctgaaatttatgccctcta

SEQ ID NO: 668969 - DNA, 572 bp, Homo sapiens
  misc_feature (443)..(443): n is a, c, g, or t
aaatattagaaagtcacactcgtatgatttaaaagtcaaagtagtagtatttatccaaataaactttaagcagatttcatatttcctctattggagaaagcatttcctaatgtgattttcctgtgactacttgttttccagttcatttatttttcagctcccaccctgtcacagtacttaccaatctttattagttaccaaagttaaacacattttttgaatcaactagccatgtgtatgtttttctctgaccagctttccattaccaccataaaacaatgataggtaaaccactgctaaatttgaaaagtaaatactatgcaaaactacactcagagtgagaagattaattttacaagagaccactttaccttagtagcaacactcaagtcttcatcatccaatgtaggcaatgaatccacacacagttcatgcaaaatgcntgagagcaaaaatacacaatgaaaatgagcaagttgatttctttacaatttttttaactgccagtttatatccagcttccccctcaaaaaaaggaaaacattatctggggaaaggtcagtggccatctg

SEQ ID NO: 668970 - DNA, 544 bp, Homo sapiens
tcaataaatccttatatccttgtgtcctaccacatacaactaaacctaaatgcacattttactaagtatattgcttcactggattgatatggtttggtatgtgtccccacccaatatctcatcttgaaattgtacctcaccataatccccacatgccaagggagggacccagtgggaggtaactgaatcacaggggtggttaccctcgtgttgttctagtgagagtgatctgatggttttataagggacttttccccgactttgctcagcacttctctctcctgccgccatatgaagaaggacatgtttctttccccttccaccatgactggacgtttcctgtggcctcctcagccatgctgaactatgagtcaattaaacctctttcctttataaattacccagtctcaggtatgtctttattagcagcatgagaacagactaatacactggtctacaaatgtttaagtaacagattgactgaatattttcaagtacaatttaaacacttatctgtaactcccaaagtaagaacaatgcatta

SEQ ID NO: 668971 - DNA, 536 bp, Homo sapiens
  misc_feature (420)..(420): n is a, c, g, or t
  misc_feature (456)..(457): n is a, c, g, or t
  misc_feature (501)..(501): n is a, c, g, or t
  misc_feature (508)..(508): n is a, c, g, or t
  misc_feature (534)..(534): n is a, c, g, or t
atgggtacaaacataaagtagatagaagaaatatattccagtgtttgatagcacactagggtgatgatagttgtaataatttattgcatatttaaaaatagctagaagatttgaaatgtttccaacacaaataaatgataaacgtttgaggtgatgggtatcataatcaatgtgatttgatcattgcacattgtattcgtgtgtaaatatcaaaatacgacatgtccccatatataggtcaattattcatatccatcgatcaactaggggggcattctcacctcacgcacttctcctaactattgccgcttccagaaccttatcttgctctgcagtttatttcttattctaatacctattctgacttcttttatgtgctttccttctggtttcccccgtgatatgtctccctaccctgcnaactttctgaaaggctgcattgctcacttccctgcnntcgtcctcttgactgagtggatttgaccccatactccttcatcntaccgtnccacttgcctcttatctgcgcggctntg

SEQ ID NO: 668972 - DNA, 108 bp, Homo sapiens
gtgtgtctggcctgtgctctaacttctccaccaaattcagattcctttacttctttgggtgttgtgggaaacaaccacacacacacacacaaaattaaatatagatgg

SEQ ID NO: 668973 - DNA, 522 bp, Homo sapiens
tatggccgaattgcaaaggatgtttcattcctcatgttctaattatggacaggactgaacgccttgctcgagatgtgaggaaggagatggcaggccatcacattgtagccctctgtgtgctcaaggggcgctataaattctttgctgacctgatggattacatcaaagcactgaattgaaatagtgctagatccattcctatgactgtagattttatcagactgaagagctattgtaatgaccagtcaacaggggacataaaagttattggtggagacgatctctcaactctaactggaaagaatgtcttgattgtggaagatattcttgccactggcacaacaatgcatactttgctttccttggtcaggcagtataacccaaagatggtcaagggcgcaagcttgcttgtgaaaaggccctcacgaagcgttggacttaagccagactctgctggatttgaaattccaaacaggttcgcagcagatatgcccttggctataaacccacttccaggatgga

SEQ ID NO: 668974 - DNA, 190 bp, Homo sapiens
gatacggaggctagtatgaggagcgttatggagtggaagtgcaatcacatggctagtcccggaggtcattcaggagggctgagagggccctgttagggtcatgggctagggggtttttacgtatatgataggccattgtgattggtgggccattatgtgtagtcgtgccagtagaggcttaactagaaag

SEQ ID NO: 668975 - DNA, 248 bp, Homo sapiens
  misc_feature (221)..(221): n is a, c, g, or t
cagaatcatatatagtacatgtagcatgtatatacatcgtcttcagtctggaataattcctcattcctcccttaacttcaaaaaaaaaagaaaaaggttggaatcgaagcccagtgggtgaaccacccccgtatgtccccagccttttggggagggctagagccggccggagtcactaaaagggccagggattatcaaacccagcccgtgatcaacatggncaaaccccccgtactctaacaagacaa

SEQ ID NO: 668976 - DNA, 212 bp, Homo sapiens
aggatccccagactctgatttggctggtagagacttggatgtttggtgttgataactcactgttatcgttggttggtgggaaaaagttcgaagttcttctttgtgctcttgcattgctgttactaggaacggtagtgctagtgctgtggatgattggtacattggtaaaactggcgaatgactgtgagattactgctttggctccatcttct

SEQ ID NO: 668977 - DNA, 403 bp, Homo sapiens
  misc_feature (91)..(91): n is a, c, g, or t
  misc_feature (391)..(391): n is a, c, g, or t
gccaaaggtcccttccccaagacatctggaacactgggcatagatttctcaagaaggaagactcccctgcctcccccagggcctctgctcncccgggagacaaagcaataataaaaggaagtgtttgtaatccccagcactttgggaggccgaggtgggcggatcacgaggtcaggagatggagacccatccctggctaacacggtgaaaccccttatctatgcgcctgtagtcccagctacccaggaggctgaagcaggataatcgcttgaacccgggcggcggagattgcagtgagccgaggtcatgccactgcactgcagcctgggcgacagagcgagattctgcctcaaaaataaacaaataaattttaaaaataaataaataaatntaaggaagtgtt

SEQ ID NO: 668978 - DNA, 248 bp, Homo sapiens
cgacactacctgtctgctgcacgatcacgatgaacggctgcatgaggctgtgttcctccgtggtttgtacttttttacacgcctgctgcctgacccttgccatgtgtgcctgccctgcccagctgacagctgagccctggaactcctaaagctttgcccctagggcttccatcccaaccagtgccaaggacctcctcttttccccttccaaataatagacgtctatggtaccattggcctttttctta

SEQ ID NO: 668979 - DNA, 675 bp, Homo sapiens
gcatcacccgcctcaaactgctgctccagaacattctgaagagaacacagcctgtgctcctcggtaggaggcatgatggccacgaaggcacaccacgccctggagcagctgatccgggactgcaataacaatgtccagagtatgcgacggacagaggagctaagtctacctgagccatgaagattgagtttcgagtgcagaaatattcccgctcatttctcagtcacgctggctggtgaaaagtggggagcgtgacagccttggtagttcaggtgcttccccagggctacgaaggaagctgaacactgcgtccagtcacacactgcgacctcattcagatgacttgtctgcttgctgtcgtcggccccgtagagggtagccgatttcctggtatttgacgcatgctacccttctccgtcctattcgtggggtgaaaagtgtgtaaatgaagctacatgggagcctctagtaaaaagtcttgttccagactctttctgctggctagaacagctcagggctgcccatggccgagttcctcttccgcacggagactcagatgagatggggctgggcagaggagctgggggtgggggaagatgggcagccgagaaaagaagtgagaccaaggcagaaaatgtgtccaggaagacagccaaagcctcatgttagcccatc

SEQ ID NO: 668980 - DNA, 553 bp, Homo sapiens
  misc_feature (147)..(147): n is a, c, g, or t
cctcacagtattggcttgcaacacctccaggcgcactgatcacattctacctggcattatttcatctgagtccctgtcctagcccttctgcccattagactgtaaccttgtttagggaaagatctgtgtcttactcatctgtgattngtgatgtggtgtttgagacagggtcttgccctgtttgcccaggctggagagcagtggtgcaatcttggctcactgacagcctcaaccttgttggggtcaagccatcctcccacctcagtttccaagtagctgagactacaggcctgtgccaccaaacccagctagtttttgtattaagtagagatggggtttgtgccatgttgccccaggcttctctttgaactcctgagctcaaggggatctgcctgcctcgtgcctccccaaagtgctggggattacaggcgtgagccattgtgccttgaaccaactcacctgtcattggtagtacttaaagatgccttggtcattttattggtgcctgtgcaattaaatacacccttgattttggttatacaaacacacaaac

SEQ ID NO: 668981 - DNA, 115 bp, Homo sapiens
ggttgcatctgagcccagtctcattttttgtcatgtgtgacaaagcatgccaattcattgttacacattacgtaatcactccagacaacttccatagctaaaacaaccaccacac

SEQ ID NO: 668982 - DNA, 583 bp, Homo sapiens
  misc_feature (426)..(426): n is a, c, g, or t
  misc_feature (503)..(503): n is a, c, g, or t
  misc_feature (518)..(518): n is a, c, g, or t
  misc_feature (537)..(537): n is a, c, g, or t
  misc_feature (557)..(557): n is a, c, g, or t
  misc_feature (579)..(579): n is a, c, g, or t
gtctattcctggacagctagccatcgcgtagattatgacttagttgtgtatgcctagagtgaatccactgctctacaatggagagtcatggatgcagttttcagccttgctctcagcctttctttaagcaacaaagcacatacacgcatcgtccctttgcgttccagggactgatgatgtgtcactcagggaacctgtgaccacaggttaggcaagtctctgtcctgctgcttcctctgacctatgtacatagtcaggggagggccctgtcaacgtgcccacaaggttcctttatcctttgtcattacgtcattgtccaaggtgacaggaggaactcagtcgttaaaatgacgagccttattttcatgaaataaccaggctcactgaggtaaatggtgctgcctggggaaagagttatttattggnaacccctagcttccatcggccttccctctcgagcctgcctagcctgctttcgggaagggcagcctgcttgcctcccntggccatattgcccnggtccaatgtcccttcagntgatgggtcagttaaagcanaagctgccattgttaaaagccnagtt

SEQ ID NO: 668983 - DNA, 290 bp, Homo sapiens
  misc_feature (67)..(67): n is a, c, g, or t
  misc_feature (104)..(104): n is a, c, g, or t
  misc_feature (120)..(120): n is a, c, g, or t
  misc_feature (199)..(199): n is a, c, g, or t
  misc_feature (239)..(239): n is a, c, g, or t
ttcggacgaggacaaccagaggagggagagttttccaggaccagtttggagagccatgtagaatggnatgtttggagagaaagaggaactttcaggtacatgtnacagcaagaaataggnaatctccagggagaagccaagggaatacacaccccaacctcactttctgccctcactctgatctcctgccacaactctncatgggccaaactcgaccaaaaagccagtgagctagaagnccctgttgatgtggttcattcagttcaccttttccagggcaagagagtaaa

SEQ ID NO: 668984 - DNA, 1252 bp, Homo sapiens
cccactccaccttactaccaggacatttcttaacaaaccagtatacccaaataaagtataggcgatagaaatagaaacctggcgcaatagatatagtaccgacaagggacaagatgaaaaattataaccaagcataatatagcaaggactaacccctataccttctgacatacaatgaatcaactagaaagtaactctagcaaggtatgagccaaagctaagaacaccgaaaccagaccgagcataaacataagcaacagcttaaaaagagcaacacccgacgtatgctacgcaaaacatagcgcggaccgcaatacaatacggatagagagcgaccaacaccatacacagaagacctgcgtgactacgaccggatagaccaaagacatacgcacagtccaagagaaaacaaccactataccacccacagcccacacaacgaacagcccttcgaaaagatacgcaccgtgcaaaaacctgccacctggacacgaacccaaacacaggaaacaagaatcaacacgcaacccacaaaagagaaaaaaccaccacagaaaaaacgaaagaagatacccacacaagataacaagcaccccgaagaaaaactaggaccataaaataacagacaggcaacaacaaaatccacaggaacaagcaggaaaaaagacaacaaaaagaacccaaaaaaaactaaacaccagcacaaaacgataatacaatcgaaaagacagtcaacagaccaacaacgaacccaacgcaaacaacaagaaccacaacaaaaaaaaacaaagacacgaaacaaaaaaaaaagaaaaagacgcacaaccacacacacaaccacaggagaccaaccacacaacaaccgagcagacgagcgcacaacaaggcacaacacaacaggcaaacacccacaaaggcagacacaaaaccacaaaggaacaccaaacaaacgcgacatgacccgcacgccaagggaacaaaaaagcaagacaccagacccgtaaacccaccgaaaaacaaaaaacgaacaacgaaagaacaacagaaaagaagacagaaaacaaggaaaaagcaaaggacacagaaaacaaagagaaaagagaaaaaacagacaaccaagcgagacaggagacacagagaaagcaaaacaagaaaaaaaccgacagccaaaaaacaagaacacaacaagaaaaacctaacggaagccacacaaaggacagacaagcagctagagaagcagacacgaaaccaa

SEQ ID NO: 668985 - DNA, 184 bp, Homo sapiens
  misc_feature (50)..(50): n is a, c, g, or t
  misc_feature (154)..(154): n is a, c, g, or t
  misc_feature (170)..(170): n is a, c, g, or t
gaaagattgccaaggaatcatcgaggacgtcatcctgctgggtgcgcctntggagggagaagccaagcattgggagcctttccggaaggtggtgtccgggaggatcatcaacggctactgcaggggagactggctgctgagtttcgtgtaccgnacatcctcggtgcagntccacgtcgccggc

SEQ ID NO: 668986 - DNA, 234 bp, Homo sapiens
gctgtcttgaggatcccgaggtgtctggtgcagaacacggagaatggggcccaatgcagagcatgctgctggcagcgtgctgaaggcagagctgcccagctgagcagcaggagcagtgggaagccttcgtatcggggcccctgtgtggagaccaacaatgaagaacatggtggacctgtgtgaacacccaccaccttacactctctccatgtgacgatgatggacgacctggct

SEQ ID NO: 668987 - DNA, 463 bp, Homo sapiens
gccatgtataacatgtgataacaatccttacctcctagggggtggctgagacggcctattaacacccttatccattttcctttcctgtatgttgtaatcctcccaatttttaagccaaaggaaatgactgcccaaaataaagactccatttcccatcctcccttagagctgggtgtgtccacgtgactctgcccagcatcccttcatcctcctaccctcggggtgtgcactgtgggtgagggtgagctgctcagggccttgcagatgaggacactctcctcagggggacacgcacagcaaggcggagggagctggagcccctgtggactttgcagatcagagcttgggcttccatgagcgagagaaatggacttttgtttattggagtcttggttagacgcggttcaaaccatataatttctaatgcagatttttgaggttaagagcacggttatcataattt

SEQ ID NO: 668988 - DNA, 954 bp, Homo sapiens
  misc_feature (372)..(372): n is a, c, g, or t
gtgaatgaggaaggaaacttgtcgatgtgccgggcagctcgaaagtggaattagtatgggtgatgtagaaaaaggcaagaagattactaagtgaatgtccccagtgccagtagcgtgtaatagggaggctgagcactaagacatgggccaaatctctcatttctccgcttcgagccgggaagacagtgtctgagcccctggattctcgttatacaggcgccaatgttggaacaaaggcatcatctggctgcagagggatacactgatgggattatttggattaatcccgaagcaaggtactatccctgtgacacgagaaatgatctgggtcgcgattaattaccaaggatatgacacgcggcaggacttaantaggcttatctcaaaagaggtactactgagatacataggtagtccactgcctgtatttattacaatagtgagaacatgtcctcatgcacttttagagtgctgtaccatcctttaatagatctcagtactccagaattcggatcatgactgacctgcaccgactacattgtgtggtccggcctgattataactaagactggctggtgtgtaatgactatgtccgggtgcttgaccttgtacctggtcaccttccgactgcagttaattgggtatactgtgtataccccctttgtacagatttcatagaactcgaaggagtgtcacttttcccatgatggtaagtgcatctaaaaattactgcgattgctaaatttctcatgttatactgcacgtgggtacgagacagggaaagctgcttgtcaaccaccaatcctgaatggggagggcatgcctaaggagggtcaacaaaggtcagctatctgggacacaataaatccgtatgttggtcaagtctgttgaacataacacttcagcaagtgaatcagaaaaatgaaattaatatacacacttaaaattacttca

SEQ ID NO: 668989 - DNA, 212 bp, Homo sapiens
  misc_feature (204)..(204): n is a, c, g, or t
ctgcccctactactaccagaagcagcgggtctcacaccctccagaggatgtacggctgcgacgtggggccggacgggcgcctcctccgcgggcatgaccagtccgcctacgaacggcaaggagttacatctgcgcctgaacgaggacctgatgctcctgtgaccgcggctggacacctgcggctcagaatcacccacgcgtagntagtagtg

SEQ ID NO: 668990 - DNA, 127 bp, Homo sapiens
taatggtgatgcataacttgtggtttctgggattgagccacagaccttgtgtgagaaggatggagcctcctgccctcagtcgtgctgctagtagtgggtgattcagtgctgtgctccatgcatggtc

SEQ ID NO: 668991 - DNA, 337 bp, Homo sapiens
ttttttggccttaaaagggggtgggcccccccccccccccggggtgggggaagaccccctcccgggcagggggggcccctccgccctgtggtttcccccccttttgttttttaaagggctgtcccttttttgtttctccctaactccctgaccttggaaccctgggggctggggggggttttggccccctttcccttttttgggtggctccccaaaccctggcccctggggggggccaggtgtgtttgtccttggggcctgggggggtttttttcctccgctccctccccccgccctgccccttttggcccttttaactgcccttttttgggcccca

SEQ ID NO: 668992 - DNA, 166 bp, Homo sapiens
tccactaggaaaaatcccaggaagttcctccatcattcacattggctccacatcatctagtccgtccttcatcctcactcgctcctccgttgtcctccctcattctacctccatactgccttggcaccttcctataccgctaccctgtgcgccttggacagtacca

SEQ ID NO: 668993 - DNA, 387 bp, Homo sapiens
  misc_feature (17)..(17): n is a, c, g, or t
  misc_feature (39)..(39): n is a, c, g, or t
  misc_feature (48)..(48): n is a, c, g, or t
  misc_feature (157)..(157): n is a, c, g, or t
  misc_feature (341)..(341): n is a, c, g, or t
  misc_feature (345)..(345): n is a, c, g, or t
  misc_feature (348)..(348): n is a, c, g, or t
  misc_feature (353)..(353): n is a, c, g, or t
gggggttgcaaccgccncgtttaacccgcccgggaatgncccggccgncgcgtgcctgcggaagcgaaggatgtgtcgggctcaaatggaaccgtccacgcggcgcccacggatgcttccaagtcgatatgcggtgcgttttcgtcgcgcgggaatntggcgccgatgctcctgccacagttcgtcggaaaacagcgccgcgacgatgacgagcggcagcacgaggaatattccgagtatcacttgctcgaacacgatagcctccttgcggtggcaggaacccttgctcccattctaggctctgaacctcgcccgcgttcattttcttacagtgcgaaacngtgnccngtggnccgtgccgcgcggcgttcgcacgtacgccggcat

SEQ ID NO: 668994 - DNA, 112 bp, Homo sapiens
caggtttccggtggtcagctgggtgacgacctcatggaccgtgacgcctacctcaagctcacgccgagtgatgatcatgactgaccacgctagaatcggtgcggcctcgaag

SEQ ID NO: 668995 - DNA, 237 bp, Homo sapiens
ctcatcaggaatgtgtatacaacatgagagaacttttctaaggactgatacatagaaaagattttattttacaatgagttgtaacgcttgtgttatctttgtcgctgcacgctatctgcccaagttaatgcaactggacacattttttatgtcagaaaaacacacacacacacacacacacacacacacacacacaaaacacacagaaaacaatgcttgacgctttctcatacactt

SEQ ID NO: 668996 - DNA, 357 bp, Homo sapiens
ctcctctctgtctcgtctttgttggtaatcaagcctactactgttgtgacgtctgcaaacttgattattgagttggaggcatgcatggtcacacagtgagtacaggagggggctgagcacgcacccttgtggcaaccaagtgtcgaggatcagcaaagtggagatattgtgtcctaccttcaccacctgagggcggcccatcaggaagtccatgacccaattgaacagggcggggttgagacccagggcctcaaactgatttctgccctgtgtactttgggctggttagacagtatttgtacatgctctgtgtggtcatactgaaggtatggtatctaatcacttactggtcgacgc

SEQ ID NO: 668997 - DNA, 860 bp, Homo sapiens
agacatgaggagttactagtctcgagctgtcggtctgtcaatttatcacccttgacacactccggtggcttcattattaacggactgccatacggcacctttcccagaaaccgcgctaaaggcgggcgcccagaaggcagcaggacactacagctccttcctctggggcaaaaaggagggtgcctgggaagttcgagggctgcagtggggcaggcagaggctcccagcaacatggctcaagggcaggcagcggcaggaggggcgaggcgtgggcgagctccagtgagctccagtgaggcggcgcgacatcacatagaggcggtagaaaaccgtgcgctgcatgcgagagcatggactctcgcagagccgaagcatgagctgcaagaacaccttgtggaatggcgtgaccaccggagatataaactgctagggtagaagccccttgaatgatgccatgatgctcagaccaccgtgggagcccaatgtggcacagacggccgccttgaagcatgcattctcgaatgcggctcagcaatctccgggtccactgtggctggagaagcccctcacaccccatgaagagagggtaccgggacaaggcagcttccaaggtggaccacttgagaagagccgcaggggcctcactccaaattctgcctctgtggcaaagggctgcagatacatcttgctagaaggcccacggaggggcacaagggccccagttggccggcaagtgatggggaattcggaaccaggagcatgcccctctgaggtagagggccccgccgatgaaatagcgtctaccatattagaccttgggaagcgggcactttatgagtggaaaacttaatggagaaaat

SEQ ID NO: 668998 - DNA, 826 bp, Homo sapiens
agtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttgggagagaagttaacagatgaagaagttgatgaaatgatcagggaagcagatattgatggtgatggtcaagtaaactatgaagagtttgtacaaatgatgacagcaaagtgaagaccttgtacagaatgtgttaaatttcttgtacaaaaattgtttatttggcttttctttgtttgtaacttatctgtaaaaggtttctccctactgtcaaacaaatatgcatgtatagtaattaggacttcattcctccatgttttcttccctttatcttactgtcattggtcctaaaaccttattttagaaaattgatcaagtaacatgttgcatgtggggcttactctggatattatcctgaaggccccttcctgcccatctaaaacttagaatgggggttggggccaaatgggggcgacctccc

SEQ ID NO: 668999 - DNA, 456 bp, Homo sapiens
  misc_feature (1)..(1): n is a, c, g, or t
  misc_feature (49)..(49): n is a, c, g, or t
  misc_feature (180)..(180): n is a, c, g, or t
  misc_feature (422)..(422): n is a, c, g, or t
  misc_feature (438)..(438): n is a, c, g, or t
  misc_feature (443)..(443): n is a, c, g, or t
  misc_feature (451)..(452): n is a, c, g, or t
naccctcatttcactcttttcccccaatcttgggaaaaattcccagccnaattctggttttaaagattccatatcaaattcaaagtcccctcccctcccttttggccgaggaaagacaacccctttggagcgaaacacaaaagagcaaatgtaaaatcccatctggggcggggccattgngttgtcacgccctgtaatcccagcactttgggaggccaaggcaggcagatcacgaggtcaagagatcgagaccatccctggccaacatggtgaaaccccgtctctactaaaaatacaaaaattagcttggcgtggtggcacatgcctgtaatcccagctactcgggaggctgaggtaggagaatcgcttgaacccgggaggcagattttgcagtgagtcgagatcatgccactacactccancctggcgacagggaangttcngtctccannaaaa

SEQ ID NO: 669000 - DNA, 606 bp, Homo sapiens
agtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttgggagagaagttaacagatgaagaagttgatgaaatgatcagggaagcagatattgatggtgatggtcaagtaaactatgaagagtttgtacaaatgatgacagcaaagtgaagaccttgtacagaacgaggaaaaattcttgaccattgtttatttgcctttcctttgtttgccttatttggggtttctccctctggc

SEQ ID NO: 669001 - DNA, 519 bp, Homo sapiens
  misc_feature (300)..(300): n is a, c, g, or t
  misc_feature (317)..(317): n is a, c, g, or t
  misc_feature (320)..(320): n is a, c, g, or t
  misc_feature (329)..(329): n is a, c, g, or t
agtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaatgagncaagcagtgagagaatnggnagcatccgntgtgataaggatggaaggtatatagtgctgagaattcgcagtgagacaactgggagagtacgagagaatgatgatgatcggagcgattgtggtgaggtagtaatatagagtgtcatgagacagaggagactgtgatggtaatctgtaatgtatgcttctgggtatattgaagtctcctagaaaattgtga

SEQ ID NO: 669002 - DNA, 267 bp, Homo sapiens
taaagaaagacttttaaaaggagggtggaaaaaatttaaatagagggtagttggaattactatgggtagtctaaggcatgataatattatgggggtaaaggaaggaaaattgtcctggtcccagggtgatgtctccataaaggagaggaggggtggcaatatgggaccagtaactgggcgagtgcctaaggaaaaaaacacgtctgggggggccgggggggtgtgagtgagtgtgcgggggagtagagagggtgggtgtgtccctcc

SEQ ID NO: 669003 - DNA, 314 bp, Homo sapiens
  misc_feature (17)..(17): n is a, c, g, or t
  misc_feature (96)..(96): n is a, c, g, or t
  misc_feature (105)..(105): n is a, c, g, or t
  misc_feature (121)..(121): n is a, c, g, or t
  misc_feature (124)..(125): n is a, c, g, or t
  misc_feature (133)..(133): n is a, c, g, or t
  misc_feature (136)..(136): n is a, c, g, or t
  misc_feature (142)..(143): n is a, c, g, or t
  misc_feature (145)..(145): n is a, c, g, or t
  misc_feature (151)..(151): n is a, c, g, or t
  misc_feature (154)..(154): n is a, c, g, or t
  misc_feature (164)..(164): n is a, c, g, or t
  misc_feature (176)..(176): n is a, c, g, or t
  misc_feature (182)..(182): n is a, c, g, or t
  misc_feature (312)..(312): n is a, c, g, or t
ttgtgccttggagagangcccagctcctccaccagtgtgagaacacgtggcccaccaggcacctgctgtggggattgtgtctttggttggccagancttcatccngagctcactggaaggnggnntggcaggnagngggggnntncctacngcnctcctccccnggggacagaggntggggncagagaaggaggcatttaagctttgctagcctcctgctgcctctgaggctgtaggacacgtcattcaaacctaccatcaaagtaggcttctgatttcaacttggatctcacggtagcccagtgataccgnag

SEQ ID NO: 669004 - DNA, 1112 bp, Homo sapiens
agtccgagtggagagagcgagctgagtggttgtgtggtcgcgtctcggaaaccggtagcgcttgcagcatggctgaccaactgactgaagagcagattgcagacattccaacagtacagctttttccactcatttgcaccacaagcatggtgcatggcaactcatcacaccacacacacaggcacatcgggcaactgctaatgcagcatctcatatgggccagcaatccccaccagcaagccagcagttcccaggcaccatgcattcaatgcacacgtcagcattgctgcatggtcacttggcccacaattggcacttcccttgcaatttcctgcacacatgcactggcccagcacacaccatggcacacagcaccacagccacagtcgcaccgcacatgcaacttcagcagcacagcccattaccgctgtcgctactgcatcacagcgcatgaggccacctcggcatcatcacttccacctggcctgcccagcacacttatcagccccaactgctggcacctgcacccacacacccatatgccgccacaccgaacagtttcaccccatgcacttgcacacgcacaagctactcgcatgcaacacgtaggaatccaagggcgcacacaacacagcaatcactaccgccatgcgctccactcacgtccacagctacagcgacctaaattggaccacacggttcaatgcaccgccacacctcgcaaattgaaccactacataaccaaaacgcaacgaaccccttcagcgaccacaacaacatgccacataccaacaactcacaccccgctattcacatatacccaaccaagtacacataaacacatcacggccaccattctatccatctacgatcaccacccaaacaaacataaataactcatcaaacataccaccacgcatacacaatacaccactaccctccaccaacactatcaaacaacatttaaactcacacacacaacaatcacccataccacaaccaccacacaccctcactacatactactcatcacacaaccgtcctacacctcaatctacccacccacttcaaaccacacaaccacaccacacaaaacttcatccaatcacata

SEQ ID NO: 669005 - DNA, 259 bp, Homo sapiens
agtccgagtggagagagcgagctgagtggttgtgtggtcgcgtctcggaaaccggtagcgcttgcagcatggctgaccaactgactgaagagcagattgcagacggagcttcactctcttgcccaggctggagtgcagtagcatgatcttggctcactgcaacctttgctgtccaacttcaagcaattctcctggctcagtctcccaagtagctgggattacaggcgtgcaccaccacacccggctagttttgtatttt

SEQ ID NO: 669006 - DNA, 194 bp, Homo sapiens
gcattgaccgtagtatacccccggtcgtgtagcggtgaaagtggtttggattgagacgtgccggtgaaattgcatctgtctctataagctctaatgtgaggagagcagctgcatgagatgcatagtaggtctctgtgatgtaactgcatctatgacggacatgggggcttcaaatcgggagataactaactcga

SEQ ID NO: 669007 - DNA, 140 bp, Homo sapiens
gcgctgctgagcatcaggtgtacaaacacttcacagacattgtctacaattggtccctgggcttatttaaagatgaggatggacacaccgtggcggggccgatggggaactttttctatgcagcgtaccccctgacggag

SEQ ID NO: 669008 - DNA, 775 bp, Homo sapiens
agtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaatgataaggatggcaatggctatattagtgctgcagaacttcgccatgtgatgacaaaccttgggagagaagttaacagatgaagaagttgatgaaatgatcagggaagcagatattgatggtgatggtcaagtaaactatgaagagtttgtacaaatgatgacagcaaagtgaagaccttgtacagaatgtgttaaatttcttgtacaaaaattgtttatttggcttttctttgtttgtaacttatctgtaaaaggtttctccctactgtcaaacaaatatgcatgtatagtaattaggacttcattcctccatgttttcttccctttatcttactgtcattggtcctaaaaccttattttagaaaattgatcaagtaacatgttgcatgtggggcttactctggatattatcctgaaggccccttcctgcccatctaaaacttagaatgggggttggggccaaatgggggcgacctccc

SEQ ID NO: 669009 - DNA, 910 bp, Homo sapiens
gttattattctcgtcgccctccacataacccattagatgtagcttctctcacttctctactactaaggggcctccccgccgtctcctcgcggggtggataaaatgtgtgttccgcgggcggcgcgccaacaaactacctcgtgtgtcggcgacgcagaattattttgtttttgcgccgcgacaaggagagcccccctcctcgagagaagagagaaaatatttttttttctctcgttggtctcttcttgttctcgccccttctctcttcgctcgagaagacctcatcttgatttttgtcccccccacctttttgtgagcctctcgtgtgatcgcccacgcgcgggttttttgctcccccgcgggttataatgagagcacacacgcgcccacacaaaaaaagagtgtttgctcccacacgagcgcgcgtgtgactgctacacacacgcccctcgtggggagcgcacctggtgtggacacacaaaatgtctccacacgcgccgcgtttttctcagcccccttgagaggggtacccgctgtacagacgggccgcccacacagtgtttttgtggggggggaggcaccgcggggtgtacactgttctagaggtttctatatagacccctgtgctctctctggtgtggggacacctggcgcgccgcccacacctctctctcccccgcgggtgtttacaccctctcgcggggacacgccctctctcctggtgacaagattttctgtgggttttgtggggacccgcgggggtagcgctctcccacaaacccgttaaactggggcctctcgcgggggcacacgattttttgccccctggggcttcccccccacccctttttccctttttgtgaccccgaccccccgcgggttttgtgaaaaaatttgggggggggggcca

SEQ ID NO: 669010 - DNA, 122 bp, Homo sapiens
acgcgtatctatagaggtgacgtgtctctccattcctctccaaccctgcccaccaccctgtaccagagctgtgatctctcagtggggggcccatctctgctgacctgggggcgggcagaggg

SEQ ID NO: 669011 - DNA, 858 bp, Homo sapiens
  misc_feature (28)..(28): n is a, c, g, or t
  misc_feature (35)..(36): n is a, c, g, or t
  misc_feature (38)..(38): n is a, c, g, or t
  misc_feature (80)..(80): n is a, c, g, or t
aaaattttttttagtgccagtccctgancatatcnngnaagttaattttcttgcattttaaaatatctggattatgaagnaaaagtgatgaaaataaattaaaactgaattaccttttctaatgttttttttttttaagtaatggtaattctatttggtgttttatggtatggtgatatctggtttctggtggagatttggggagttattggaaatctctggtaatggtggtatgggttagaaaatttctggtggaccttaaaattttaccagttatttatagaaagagaaaatgggggaaatggtttataggctttttactagcagtatcagtgaacactgtgaactccattattcatgaaaataacacgttaggatgggaatacgtctattcaaaagtgaaagaatataaagggtttagtttttggtttttactctaaagatagaatgggggagtaaacttcaagtttgttagagtggtctgaatatttaaaatcctataataatttcggaatcttcattcttggagtatgggatgtaaaagacaaatatatcctacaggtagtatcatcatgcagtatcaaggtccctttgcttcttactggaaaggtatcacaaactcataaaatctattcacagtacaaagagtgattgcaaagttggttttttcctagcgttcatttcatcattacgacaatggaagttaaagtccggtggaatggggcgagaaaaagtgctgtttgacaaatgattgtattagggctgcttaaatgtgaaaatgtaggatggtggcaaagtggaaatgtcggggtgtatagaaaagagaggtgcattaaaactgtcttgttttttattttt

SEQ ID NO: 669012 - DNA, 578 bp, Homo sapiens
attggatactctggtatcaactcatcacagctgatccatgatgaacaacggcaggacatagaataagatgtaagtacataaatataacttgtctcaaaaagtgctccaagggagcccgacgaggactaactagcaatgccctgacatccaactgaccttctacagaaaagtgattgactagacaagtggtcttcccagtcataagtagaggctctatgtagacttctccatactcctcttgggtgatgtcatcagggtttctggtccaaataggctatggtctatgtaatagttcttcctgatcaatgtatttctcttagatctatcttagtatatcttcttcttatccttaccgctgtcatcctcctcatctgaacccacatcttcgatctatggagttaaacttcatcatctttatcttcctcttctttctcacctttctcttcctctgactcatcatcactaatatcctatctctcgttccttctccaaataaagggtgatgggatagcctatgaactgcgaatgcttcttcactacttctttgacccgcctctctactaggtactctgtctgat

SEQ ID NO: 669013 - DNA, 212 bp, Homo sapiens
caatctcgttcaggactctgtagaagtacagatcaggcatgacctcccagtgtgtgtacactgggaaatgtgtgccacgacatgctcaagaacttcccgagccagcatccaccacatcaaacccagtgagtgaggctcccttgtttgatgcatgggaatggcaaatgtcccacatatgcgcagagggacgaatcttgtgttacacaggcgca

SEQ ID NO: 669014 - DNA, 405 bp, Homo sapiens
tagctgtcagaggatccaagcttacgagggacgtgacagaaattaccaaaaaaaaaaaaatctgaagaccagtacaattttattatctcatgagatttttattctggacaagtcaaggaatggatgtctctatattagaagctaatgggtatttctctaagctctagattctgtgtaacgcagatatcaaacccagtcttagaacatttaccaattatgaaacgcagttttcacccattttggtatccagagcgcctcggggacccaggcagaactatgggcagggttaaagggttccagtttacggggctgacggtgagtctatcattcagtaattcaaaagttaagtaaaatgaactcacagtatttatagagttttcctagtgaaccctgcctcgtatagct

SEQ ID NO: 669015 - DNA, 309 bp, Homo sapiens
  misc_feature (39)..(39): n is a, c, g, or t
ttactacttagtccctcctatagtctgtcatgccaaccnttagatccctttggagatgacactaaaagtaatttcagagttcttttacagtggatctaagatgtgatagaggaactttggcaccctacgagagagggggctttccctcagacagacaaaactcctgcgagataccacggacaagatattaactcgtatccaggctcttacagctccacacgtgaaattacagtgctgatgaaaatgaccaacttgatactgaagaaattagatagagtgtactgtttgttactgcttctacatctgaat

SEQ ID NO: 669016 - DNA, 1095 bp, Homo sapiens
gatgatattaaagatgaatcttcggagttttcaagccattcaagtcagtccatcttgaagacaaagctctgatggcaccaaatcttgactcctttggacgcgatcgggcactgtatcaagagcatgcaaaacgtcgcattgcagagcgggaggccaggaggactcgtcgtagacaagccagagaacaaaccggtaaaggactcgtcgtagacaagccagagaacaaaccggtaagatggcagatcaccttgaaggcctttccagtgatgatgaagaaacttctacagatattactaatttcaatctggaaaaagatcgaatttcaaaagaatccggcaaagtttttgaagatgtccttgaaagtttctattcaattgactgtattaaatcacagtttgaagcatggcgttcaaaatactacacatcctacaaagatgcttacattggcctttgtttgccaaaattattcaaccccctcatacgacttcagctcctcacttggactcctcttgaggcaaaatgtcgtgactttgagaatatgctgtggtttgaatctttgctgttttatggttgtgaagaacgagagcaagaaaaagatgatgtagatgttgccctactacctaccattgtggaaaaggtgattcttcctaaactaacagtgatactaaaattaatcaatggatatccttcagtagtgaatgcagaaaataaaaatacacaggtatacctaaaggcacttttattgagaatgagaagaactttagatgatgatgtatttatgcccttatatcccaaaaatgtcttagaaaataaaaattctgggccttacttgttttttcaacgacagttttggtcttcagttaaggtcataaaacccccattccagagagggtcctgccccatacccagaaggaaagaatgctgctcagagaggccaagaagaatctggacggacaggccttgtgttgtcttctcttgagcagtagatcatacctttttgtccagtcatgtttctgcatgcctgtacatatttcgttaaacctaaacatagtagacaatttctcctccatctttgggtcttcattctgaaggctg

SEQ ID NO: 669017 - DNA, 113 bp, Homo sapiens
tgtcccgggctatactggattgtttgagagaggatactagctcaaccttatcaggcagctgtatcaccccttgctacagagcggtctatcaaggtgcaggaaggtctatcctg

SEQ ID NO: 669018 - DNA, 553 bp, Homo sapiens
  misc_feature (36)..(36): n is a, c, g, or t
aatcgagctcggtaccggtgtttcctttgtctcaanagcaaaaaaggaactcaaacaacctaacagtgagaaaacaaataatccaatattaaaaaatgggcaaagggcccaggtgcggtggcgcatgcctgtaatcccagcactttgggaggcctaagtgggaggatcgcatgagcacaggagttcaagatcagcctgggcgacacagggagactctgtctctacaaaataaaaaaacaaaaaattgactgggcataatgatgcacgcctgtaatcccagcaacttgggaggccgaggaaggagaatcacttgaacctgggaggcagaggtttcattgagccgagatcacaccactgcactccagcctgggtgacagagcaagactccgtttcaaaaaaaaaaaaaacaaacgggccagatgtggtggcttatgcctgtaatccagcacttggggaggctgaggggggaggatcgctggggatcgggagtccaagacaagccgggcaacataacgggactcggtctctacaaaaattgaggacacggggaaac

SEQ ID NO: 669019 - DNA, 621 bp, Homo sapiens
  misc_feature (67)..(67): n is a, c, g, or t
  misc_feature (80)..(80): n is a, c, g, or t
  misc_feature (99)..(99): n is a, c, g, or t
  misc_feature (437)..(437): n is a, c, g, or t
  misc_feature (495)..(495): n is a, c, g, or t
  misc_feature (562)..(562): n is a, c, g, or t
  misc_feature (580)..(580): n is a, c, g, or t
ctcaacgctttatactctcataaaatttatcccagtagcactatttgtcacctgatctcttataganttcttgatatatnaaatcagatcctaacattnatcgatttttcaaatatttacttattttcctcaccacaatattaattctagttaccaccaacaacattttttcaactttttatcagatgagaaggtgtaggaattatgtctggttttactaactggctgatgacacagctgagcagatgctaatacagcagccctccaagcgattctgtataaccgcattggcgatattggcttcattttagctatagcatgattcctctcatcttacaatacatgagaacctcaacgagcatttatcctaaatcctacccctgatctgccattaattggccttctcttagcagcagtcgggaaagtcagctcaattnggcctctacccctgacctccttccgccatggaaggtccaaccccagtctcagccctantccactcaagcgctgtagttgtagcaaggaattgtactgcttatccacttccaccccttaaataganaataatatgttaatccanacccttaaaatgtgtttaggggtgaagtataaagcgttgag

SEQ ID NO: 669020 - DNA, 91 bp, Homo sapiens
gcggccgcctactactactactgctcgaattcaagcttctaacgatgtacggggacatgccacagtatattaaaccaagaagtacaaatcc

SEQ ID NO: 669021 - DNA, 959 bp, Homo sapiens
gatgagttgagccaggcacggcataatggtgaaggcagttaccactccctctgctgatttcggaaaccaatatatatacttccgatatggatactgaatgtgcgaaaggacttgtaccttcagaccgctctgaatcaatgctacgccttccgaagtccctagagctgagctgtgaggtcaataggtctccgatcgaggaaaaacctggctgacgttcaggagacacaagggttcatgtagcagaagctaaatcgacgaatagtgtgacgcgtatgcataattcttaagtagtgatatctcacctgacggggatcgtcgctttgacgtgactagcctattcgacgtgtgtcggatagtttttgcatcagtgtatattttgcgcattctctagaaagtgcactactatcattcccgtcgaccattggtctattcagtactactggagttgagagccaactcatggaaagaaatcgccctgaactgtgtggcaaccgtattactctacattctacaagcccttgatatggactctcatgtccgatttgttcagtcgcagcattaattgtaccgaaataccttgaccatcactacgcttctgcaacggaaaaacattggtattatttactcaatctactctaaatggctacgctatatctttggtcgtttattcaactgacggcacaacaaagatggttgattgacctgatgcgtcacaaatggacattgatggcattcaaatgacgatataggacttacataggcctttgtatcgaacagttgactttccctggctttatgggacgtacctcgtacctaagtacccgtgattcgaattggggggagcgaaaacggcaacggtgtcgggctccgtttactctggcccttcgcgtggcccccattgtcagcccatcttgtcgcgtgatatggcgtggtttactggacgcttcaaaaccttcatg

SEQ ID NO: 669022 - DNA, 419 bp, Homo sapiens
ctgtttcataaaataagcaaacaactgccaggtgagagccacaggtggagaaggctttatacttcccatctgacgatggaattcttggaatggaggagacaattttatagtaagacaaaaggatccctgaaatgggaagaaaaccaaatatagggatatctaaaatacataatatgttattgatgatgctgtcagaacaggcaaggttgagaagttgagatgggtcacagaaaaaaaattatagatttccacattcttgaagaaggtgagttgtgtaacacaatccagctgtgcagctgggaatccaacaggctaaggaaaaaggacaccaaaactaagaagacacagaggttgtggtgagctgagatcacaccattgcactccagcataggcaacaagagcaaaactccacctcaatt

SEQ ID NO: 669023 - DNA, 998 bp, Homo sapiens
gcatcaaatggcggatgacgccgtgtgcatgggtggggcccggaggccctggatggtcctgctgatggtgaaccgcggtggcttccgcggaggtatcggcagtgccctttcggggtcgggttcagttggccgtggacggtggccggggaccgacggccggtacgttcgttgagagagaagtgccgtatgataattgtcgtgttagtgcccgatcatcgaaggttggggccgcattgcgtccagaggcacgatgcaatgattaagatcctctctggcaagggacgaatctagtcattcttctactcatgcccacatgtatcgcggaatccaggatggaatccattgagtttcctttgcttggcgcgtacgtcttttccaagggactgagtcggttttgcataaaattactcgccatctgccaagatagcgagacccggagccctcgcccagtggggaactcaaggtacattgcgcgattttgtgtcgctactcgtggtaactaaggaatcggtccaggttcagaggtgcattgtgagatggtttaatgatggtttcactactgggaagtgttcggggaacacgggactatactcgctagggtgcgcattcactcacttgtacctaagacatacttcccattccgcttgcccgtagccggggaaggaggattaactgtaggggaactaaaaggattcgggaaaggcgcccctatcacctggttactttgatagggatgacttcggccctgatgtagtgattctgtgcttgcgtaccgcctcgattcccgttgtaccgccagagggagtagcgtggaaatccggcgtccgcacctgttgacttaaaaagtttgctcaatgaatgggttggaaattcgattgaacttgataaagcattagcacggggcatgctctgacaccttgttgtacctctgctaggccgcactttgattccattgtaaacgcacggttacttaccgcgatctctggaaggggaggggc

SEQ ID NO: 669024 - DNA, 695 bp, Homo sapiens
  misc_feature (444)..(444): n is a, c, g, or t
  misc_feature (464)..(464): n is a, c, g, or t
  misc_feature (548)..(548): n is a, c, g, or t
  misc_feature (556)..(556): n is a, c, g, or t
  misc_feature (560)..(560): n is a, c, g, or t
  misc_feature (572)..(572): n is a, c, g, or t
  misc_feature (584)..(584): n is a, c, g, or t
tcgtttgaaaggcacaggtaatgcttctgcctgtgcagcgggtgtgctggtacagtggctgctctctctctctctctttttggggggctcattttgctgtttgattcccgggcttaccaggtgagaagtgagggaggaagaaggcagtgtccctttgctagagctgacagcttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgtgttttattttttttattttttggggtaaaatgcatgacttggtgttgtgatgagagaatgggagacagagtcccggggtcctctactggtttaacaacatgggcttcctnatttcggttgcgacatggtnaattcacagaatagcacaaactacatattaaacactaagcacaaagccattctaagtcatgggggaaacggggtgaaactctcnggtggtgngganacagaatagagngaaggaagcgtnggcagaaactcctttggcactggtgtgtgattagacggcccggacggggcatggggcgcctctcgaaagggcgcaaccttaaagatggcgaacggggaagggcgcaagcgg

SEQ ID NO: 669025 - DNA, 238 bp, Homo sapiens
gaatgttggaccgcacggagggggaggagttcatggccaaggcggtggccattgaaaaccagtatatgatgattccgaggaccatggtaaacgtcactgcaatcattaagattatggaaaccaagttagtgaggtagtttttgaaccgatctctccatgtcaccttcacttatgtagtctctctgattctgcactctttcttcagagactcccctgaaggcccatgggctatcctgta

SEQ ID NO: 669026 - DNA, 102 bp, Homo sapiens
gacagaagacgtggccatccagtagacatgtgtagctcagaacacaaaggcccaccgttcctgacggatgccagcttgggcactgatgtcatactgatcccc

SEQ ID NO: 669027 - DNA, 212 bp, Homo sapiens
cgggggggggggggggggggggggggccccccgtttttttcccccccccttccccgggggggggggggggggggccccccccttttttttttttccccaaagcccccgggcgtcccccccccgtgcgtggaggaaggtgggtttttttttttcccccccggggggggtgggcccccccttttttgccctttttaagggggtggggggccccc

SEQ ID NO: 669028 - DNA, 235 bp, Homo sapiens
cgatctaaaggatcccttggggctccattcaggaaagaccgggttcatggagtcgagggagcgggagatggagctgcgggggctggcctgtggaggaggagcggcggaggcgtgagcaggtagaagggaggctgcagagtgagagtgccgggaggcagcagttggttgagaaggaggtcaagatgcgggagaaacaattttcccatggcacgaccccttgacccggttacctggc

SEQ ID NO: 669029 - DNA, 615 bp, Homo sapiens
cgctcaagccgaacgttttcagcctccacagccggtcttgcctcctgaagatttacgatcggcgtccaccttatcgaagatcccctgtcagttgccttcacgtttggagcgggtaatggggaagccgtcggtggatatgccgcagagtgaggattgcctactgctggatatcactttgccagcgggcaacgttgaaaaccgtgcggtgatggtctggtttcatggcggtggctacttcagtggcggtggaggaatgccctggtacggggctgaaaagcttgcgcaggaaggtaacgttatcgttgtcaatgtgagctatcggttgggcgtattcggctacttgatgctggatggagtctgccagggcaaccatggggctgctggatcagattgaggccgttcgctgggtgaaccgccatatcgcaaaactggggggtaaccaaacaacatcacattattcgggcagtctgcgggcgctcattcgattgcttatatgatggcgatgggaaaagaccgtccactgttcgcccatgcattttgcaagtccaccatggatcccacagatcaaaactgccaggcgtcgtacgtttccagcatctggcaagacgccaggca

SEQ ID NO: 669030 - DNA, 146 bp, Homo sapiens
acagtgggagtggaacctggcgattaagaaggagtggacagaatgaatgcatccagccccttgccccacccttggcacctggaagaattctctcaggcgtgattcagcaccctggtccctcctccctggtccacagcgtgggtccc

SEQ ID NO: 669031 - DNA, 373 bp, Homo sapiens
gggtttttctttcaaagtttgggtttttcccccccgtcccgtctatttattattcaaataggaaaaattcctttccaggttgttttcctggagcttataatgaaacgggagttattcccgttactagtttactgtcagagggccccctttttcaaataaaaattgccaaaaaaaccgaagttatttttataagaaaacccagtatataaatctaggaaaggggtcttctagtttttgggttgtttagacccaaaaaatcccaaatttgcccgtaacagggagttgtttagttataattcagaggggccagaatggtaaaaattcccacccgtcaaaaagggccaatgaattaaaaggcttgcccctttttcca

SEQ ID NO: 669032 - DNA, 142 bp, Homo sapiens
  misc_feature (19)..(19): n is a, c, g, or t
  misc_feature (84)..(84): n is a, c, g, or t
  misc_feature (116)..(116): n is a, c, g, or t
acgcgtcaagtaacatttnaacatcagagaaaggggataggaaaaagggtttaacaaaccagtccaggaagagccacgaagatnaaaagagtctcctggtgtgagctgggtcattntgtcggtcttgccgcgggaacgagtt

SEQ ID NO: 669033 - DNA, 267 bp, Homo sapiens
aaactcatcctctaacgcatcgtcaagcactgatctaaggcagctctgacggttcgtcatcgtcttgtcgccgaccttgtactggggaaagccggtcacgcacatgctttcgcgatagctcacccagcgataagtggccgaacatgggtatcagccgaccatctatcatttccgggtagtgtcgggaggtgctggagttgagctgagcctttttctggtccagccactcaaccaagtaaacgcccaggctctggctatctaaatcta

SEQ ID NO: 669034 - DNA, 391 bp, Homo sapiens
gctggaggaggcccctcaggccggggatttggggagggctagcccaaaacctcccgcatcgggcaggcaccccctgaagtacttccttcagggtttcccctttgtgagggggtcgagtagcctccccggcctgtttggaggaacaactggctttgcttttaaaaactttggccagtgggcgcccatttttttgcccttagagattccctgctttttcctacaaccgccaggcctggggtcctgaaaggaccttgggtggtaaaactgtacttggtgggagtgagggggtggggaggaaccatgccaatccccctccatgggttttaaatgcagtaaataacctttttggatgagacctggttcccaaataaacccgctatatctgttttga

SEQ ID NO: 669035 - DNA, 262 bp, Homo sapiens
  misc_feature (12)..(12): n is a, c, g, or t
ccaaattgttgntaatggcgcggctacaggtaccttgtgactatgaagattgacgaaaagttgacgggcacgatgaattctctctcagaacttacatcccagaagggccttccctaattcgggtcctcctagaaagtggagaagactgctggccttgaagaaagcaacaggcatgttgtgagctggctaaggctctaggtcttgagggaagcttaccgtttaaaaccagcaaaaggccagggcctacatcgcttatccaatg

SEQ ID NO: 669036 - DNA, 128 bp, Homo sapiens
  misc_feature (117)..(117): n is a, c, g, or t
tggtcagagttgaatggagataaaacacacacacacacacacacacacacacacattttaccttatttaggatctcccagaagataattttaactactttgtcatttctatatattnttaaatagctg

SEQ ID NO: 669037 - DNA, 121 bp, Homo sapiens
cctggcaaatggagatatgtgtgaggagggtaccccagcagttgagcgagggcactgtgtgcagctccgatggcaatggcccgggtctgaacaataaacagagtcagcttcatggcggccg

SEQ ID NO: 669038 - DNA, 291 bp, Homo sapiens
aaaagggagaaatacgaggaagggaaatagaacctgaaccgtacccaaaagcagtcaagatgggaaataccccaagcaagacagggagcaagggagatacagatggtaacaaagacatccccctggatatctccctaggtctcatgctaataacactggaaggatggcgaaaggactaaacttaggaaaaagcaacaaatgataacaatattgatgttatatttggactcagggacccaccttcaaaccctcaatcttctgaccaaactttgggtcgaatgaggatgtaac

SEQ ID NO: 669039 - DNA, 383 bp, Homo sapiens
  misc_feature (9)..(9): n is a, c, g, or t
tatgcacanattgtgttgaagatatgaatgaagaagtttccacacctttatgtggagactgataagtaagcaacaataaggaagggtccccaggttggggagagccccaagttgagaacaataatgaacaattattgtatgaacaattgttagagacagctaatcacaaacaacctgcgggcacaatgacctcattccacacgtagcaccctttagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 669040 - DNA, 234 bp, Homo sapiens
ttcttttcccctcaaactccatgatatgcttctgttcacttattaaaatacactgggccagcgcagtggctcacgcctgtatcccagcactttggtgagcccgaggtcgggcagatcacttgaggtcaggagttcaagaccagcctggccaacatggagaaaccctgtctctactataaatacaaataaattaaccaggctgtggtggtgcatgcctgtaatcccagctgcgtt

SEQ ID NO: 669041 - DNA, 1045 bp, Homo sapiens
gagcgaaagacaaggttgtccaagaatctactgcgcatgaagtttatgcaaaggggcactggcatccagcaacaccaagcaaaccaactcagcacagcaagcacagcacaacagcacacaatccattcagtgcaagcagcacgtggtactttggcattttgcccagcagcttcacaagcagcaacagcagcagatttccatcaatcagcacagcagccagcagtttcattcactcatgtgcacagcatccttcgtcatcatggcacagcacatgtccattccagcaggcatttcacatccgtgcagcgttgcagcacacattggcatagcttccagcatgcacatgcatcaagccaccacaagccagcacaagcacagttgcaagcatgcacacaccagtcagcagccttgcatcgatagatcaagcatgcacagcagcatagggctcagcacagcatcatcgcaagcaccgtgtggatggggagcaccacattcgggcaaacacagcttggcccagcacacagcagcagaaccatgcccacattcatgcacagaagcatgcaacacatggcagccaccatcaacacccaattaacagccaacagccacagcatgttctctcaacagccccaaggcattccagcatggcatgccttcaagctgcatgggcccagggagtgccttggtgagaaagtcagcgagggacatcatggaagcttcaatcgccaaaaaggtggtcatctattaggtagattaaatacctggtaaccggtttactatgatacaggaagatatatcactttataggaaaagcaatgctggtgtacttagacaacacgaattgtgtcgatgggactgtttgtaccactccctgtgtgctgaacaaggaggaatcccattcacgacgtgggatttttaagaccccatggagttacacaaatggtacattggtaacatcagacttgcgttcctacaaacttgtataaacacacaagttcctcatacacaacgttctccagatcaatggacctgcacttggcttcaa

SEQ ID NO: 669042 - DNA, 335 bp, Homo sapiens
tccactctagaagatcccccaattcccgctctctgggtgctcgcgcaggaggctgcagcgggggatgggtgcatcaatattacaactcatcaccagaaggtgtacgtgccaaatttgcacttgctgacattgacttctggccagaaacaaacttctttgccgcatttatgatatcagcattagccactgaatcaatctgctgactgactgtggatggtggcatgtaagaaccagcaactagagcctgggacccgacttcttccaggaaacactcagacgactccactgacattaggtatccagctatcagcttgttcttggcagcttggacatct

SEQ ID NO: 669043 - DNA, 188 bp, Homo sapiens
cccccccccccggtttttttttccccccccccccccctttgccgggggggggggcggggggggggccccccccttggttttttttttttaaaattcccccgttttttttgggcctttttttcggggggggcctttttttcccccccttttttggggggtttttttttttttttttttcttggaaatta

SEQ ID NO: 669044 - DNA, 1722 bp, Homo sapiens
gtgacctgtgccacctagccctgccctgcccgctcgctcgctcgcccgccgcgccgcgctgcctgacctgccagcatgctgccgagagtgggctgcccctgctgctgcctgctgcctgccgcctgcctgctgcttgccagctgctgcctgctgctgcattgcttgctacttgtggctgctgagtggctggctggctggcgggggcgcgctgcggaggtgcttgttccggcttgccctgctccttgcagcagccctgagtgctgccttagtgccttgccttgcagtgtgccctcctgtcactgtgtttgctgccatgccactgtcctgctgggattgggcctgcattgtttgtgcactgggaatgtgcagcgcctgcagttgccaattggcgctgtgatgcatctgtcactgggtgaaggtccttggtggcttgcggagtcgttggcttgcgtctgtggttgttgcttgcgcctgtgactttgcggagggctgtcgatgtggctcgttgcagtgccggttcgtagctaactcgctcttgctggcttgctggtgtcccattgggtggcttgcaggcttgtctaagtacgccccgaccccctgggtggccttccctggatgtgctttagtgcccccgtttggccgagggtgcctgggcttgggtacagtttgtgcgcccgcagggggttgccatccttttggttagaacggagattgtctggctctgtggtgtaacttgccctggagtggttactttggggccagcgccaatgggccctctgtggaaggggccgagggtggtttttggcgcgatggaagccagagttaagaggcctgagttagaaggcgcaaagacttacaagggaagaatcgggggaagtggccctatggggctttgggcgacggcagaagcccaagtctggtttttggaacccataggctaaccccatttcgaacagccagttagtatatgggggggctcggtgctgggtggaatgtggccacagcttttggctttggtgcccctggtgaaatggcccccctttccaagcacgtacccggggcgcttacgtccacgatctgcggacggccttagggccgcctggttggttatcccggtctggcgagggagcaccgtcgttccagccttttgagtgccaatggcaagccccgtgggccgagcgaagtttgtgtgcgcaacattggttgtttgggcgcagagatgccattatcaaccccttattatgtggcccttttgggaatggtgaatgcccccaaatgaaacgtgtctttgcgcgaaacgccaagcccccccgccttgtgccaagatggcacctatcccccgtcgtcccagaacggggtgtagaaactttggctagccccaagggttgcctgttgggcaggccgtggaaatctttccccaacccgattttcctgcccttctccggggcatttcacgctgggggtccccccttcttgttgatgtcgccctatattaagttaccctgttggcgcatttccactctaacttggttcgacaagtccttgtggcctttgttacgaaccctcagacgcgattgccagggagagtgtactcttaggcacggcgtcacgagttgtgggtgggagtggatcctgttgtgtgatgttagcacccgccacacgacgtgcaggagctgtaaatccgggtggcgctcccgcacgaccggtgacggagaccccgaa

SEQ ID NO: 669045 - DNA, 194 bp, Homo sapiens
ccacaaaggagtatccctgaaagattcgggggtccccaggtgggggtctgtccagggggtgagtagacaggctccagcgagtgaattcctccgcaaagtttgcccacatccagcgtctgagctggaggttggtggctcggaagtggggcgttggagtcgttccgtggtcagcctagagcccacccaagtcgatg

SEQ ID NO: 669046 - DNA, 340 bp, Homo sapiens
  misc_feature (11)..(11): n is a, c, g, or t
ctgcgatatancgtaaatatcattgggcacaggctttactcggattacagttggattcatatccctaacatattagataagaatggaagccacagcacagagatgggtagtcctgttcaaaatctgtatctttttgggactgcccgtggcaatataacaagaggtgcagggctagtatggtggtgtatggcgtggatgctgaatacttaatgaacttacgataatgaagccctagacaaggttaaaatatatgagttaacttcgaggacggctagcgtagcctctttttttgttcttcaaattattgaacatattcgcacggtggagggggtaacccccg

SEQ ID NO: 669047 - DNA, 362 bp, Homo sapiens
tcaagcaatcctcttgccttgacctcccaaagtcctgggattataggcgtgagccactgtgcccagctgatgctgattttccaaactctcaagaaatacctggagagagacattttcttaaaagtctgatgatttgagggccgggcatggtggctcacacctgtaatcccagcacttcgggagaccaaggcaggcggatcacgagtgcaggagatcaagaccatcctggctaacacggtgaaaccctgtctctactacaaataccaaaaattagccaggcatggggcacctgtaggcccaactacttgggaggctcaagcaggagaatggctgaacttgggaggcagagcttgcagtgagcc

SEQ ID NO: 669048 - DNA, 1174 bp, Homo sapiens
gcagcacttcactatgtcaccggcctgcacaaggggaccacactacatcttccggcttgttgccaatgaaccgtggcgtggcttgaggtgacggacgttcgatgaatggagagtctagggacctcccgtaggatctgcccagtcgtgctttccccgcaacaatgcatgctactggtgagcatggactgactctctctcttagccactaaggatacgtgcccttgtggaaccctggtcatttgccttggacgcgacgatgcgaatctgggctgtcactctagttcgatgggctagccacctgtgagttggttcccggatgcaacacttcatagcatgtctaatcaggtgtagtcttgcaagatagcagtcagcgaaacaagtagctatcccgagcatgttacccttttagctgtgcctcataggccaagagcaaccagtgcttacgaccagtcagaggtttccgccgtccagttggaccaggcgaaaggggctcttggccacaccttctatgcgctccaagcatttccatgtccctggactcaaatgccgtgtgcgaggtcaagggtgttatgccaaaggaatctatcctgggttgtgctggctttgcacacttgacacgaacgttcttgttgcctgactcgagctaggcgcagggttcccctgaactttccttattaaagttcacgcttgtaggcccctttcacagatttcttgtaccaattgggtgcagcacgtcgttcgcgacggttgggacccggtcgccagcttcgcaattgccgcgcaaggtccttgacttcgccctggcactccgttgcatgtcccgcagcctcaccaggatgttacccttcggtgtcgctgccttgacctgaatcgcgttgtggtcatgtcagtctgtccagggggcgccttgcgaggcaccctgtggtggtaccattcgccgagcaccaggcccccccggaagaccttccgtttggccctccacccaagtgacccggccttggcctttgccatttctttggcctacacatttacgcacggcatccgcgggccctggttttctggactgcctcttcctcattgcgcctcctcttgtgttggcatgcgagtgccccttgagggttcggtgtccagcagtcaggggacctcaccctgtcgtgtcctgaggtgtacccca

SEQ ID NO: 669049 - DNA, 219 bp, Homo sapiens
tgtgggtgacgagcgaaaatccgtctcaaccaagaaaaaagaaaaaaagaaaaagaaaacttaactggcctttggggcacatgcctgtaatcccagcttcttgggaggctgaggcatgagaaaaaaaataaacctgggaggtggaggttgcagtgagttgagattgtgccactgcactccagcttaggcaataaaacaagactgtctcaaaaaaaaaaa

SEQ ID NO: 669050 - DNA, 101 bp, Homo sapiens
gttaaccacacacacacacacacacacacacagagagagagagagagaacgagctcagtgtattgtccagtgtcacgcactgatgagggagtaacaggaca

SEQ ID NO: 669051 - DNA, 962 bp, Homo sapiens
gagaggcttctgggtcaaaggaccagtctggagagggatcctgtggcctggaagcgaggaggatccacacggcgttgcagctaccgcagacaggatctgggcatccaggcacggacatgacccctccgaggctcttctgggtgtggctgctggttgcgaggaacccaagggcgtgaacgatggtgatcatgcggctgggcgatgggggctgccacaaaccgaggggcgcgcgtggagatcttctacagtaggccagtggtggcactgtgtgtgacaacctgtgtggactctgactgatgccagcgtctgctctgacgggccctgggtcttctgagaacgccgatccgaggctctgggcagagctgtcttcgggcaaggatcaggccccatcatgctgtgacgaggtccagtgcacgggacaccgaggcctcactgggcgactgccaagtccctgtggctgcgctgacatgagcaattgcagggcggacgagagagacgctggtgtggtctgcaccaatgaaaccaggagcacccacaccctggacctctccaggagctctcgtgaggcccttggcagatctttgacagccagcggggctgcgacctgtccatcagcgtgaatgtgcaggctgaggacgccctgggcttctgtgggccacacggtcagtcctggagtgcaaactggagggccaggccctgtggaaggagctggcagaatgtccccatgaagtgtggatgcctgtgtgtttgccctggtctggggccttcaggactctaatccgaaggattgggttccctgtgttggtcaatgcttcacaagcggccttgcattggccaggggtgcgggactggcgacccttggcacctccccgggccgtgaatccggcgttctttagcggcggacgccggggaatctcccgtggcgggaccgacgcgcgcggccccctctttgcgccgcgtca

SEQ ID NO: 669052 - DNA, 211 bp, Homo sapiens
agacgctaatagtggaaagaggagataagttgaggggaatctatagtgaaggaaatccccctgtgcaggaggttcaagttctgtatcttcaaacgagtcattcagtaataacatgcgattgaatcagacttctcgaacactgtgctatctcttgcctgctgctcgtttcacgggtggtccggagtaccgacgctcgacattcgttaatcac

SEQ ID NO: 669053 - DNA, 401 bp, Homo sapiens
  misc_feature (401)..(401): n is a, c, g, or t
cggagacctgagccttcggagagacgtggactaatgtaagcaatgccgagaactggtgagcaggagtggcgtgcgagtggacacgtatcgggactacatatgctattgcaggaacggatactattactacacacagtggatggagtgcattgataatgactagtgcgcctatgttgaactcggctgagatggcggtcgacgtgtcaacactgacagcgctgatcactgtgcctgcgagccatgactggtgctggatggatcgcagcgccgctgcgtcttcgacgagagccagagcctcgatgacactctatgaggaggctgacaacaagtgacggctgaccgagtacgcagtcaccctctgctgccgtggggcacctaccagagtgctgtgcctgttgccn

SEQ ID NO: 669054 - DNA, 859 bp, Homo sapiens
  misc_feature (149)..(149): n is a, c, g, or t
  misc_feature (607)..(607): n is a, c, g, or t
gggcctggaggagactgagtggcgatctccggcatggagttgaacgtcctcgctgagttcccgctctgcgtggaagaacttgaagaattgacaacaccaagtagtagggaagctgggtacatgatgagcttgtggtgcccttcagggantgaaatgaaggtaatatgacaacttttactcagggtggacgagagcgagtgagtctatgggggccaacccagaaggtacgacaccgttttggaagagcccgaaaattatattaggccgggattaggctagaaagtgttgagccccataaattcacccgagaaagctctctcggtttaggtttgcgacgatcggtgcgactgggaaactttaactaattgtagcgggaataatggttaactttgcgcatggttgccgaagtcgagtggaagattgcccaccgagaatacgtttgacctcgtgttggttcaggtcagaaatagttggggaggaattgcataattacgacctgtttaacaggttttgttggcgttacaacgaaggcttacatggaccggttctcacaatggcctgtgtcccaaagtagacatactttattggaagcctatccaagcgtggnccaactcaagaagggggaggtaaaagtagtaacgaaggcaagtgtaaaatttccacagggtgaggttcctgcaaacaggtggtagtctttgaacaagttcgaccccaaatcccttgcattacttccagtgttccagtgctcatgtgggctcccattttggttcacccattttgtctagaaatacttccatttttacgttagcttagccatttccagttggggtacaggaattgaacctggcatgattggggc

SEQ ID NO: 669055 - DNA, 608 bp, Homo sapiens
aatgactctcagcctaataattttggttagtgggtgataatgtattggaggtgaggatgagacacatacatccaaaatctaacagcttggaaaggatgtggtccaacagtgctattttatttatttatttatttgagacagggtcccattctgttacccaggctggagtgcactggcatgactgaggctcactgaagcctaaaccacctcaggttcagttggctttcccacctcggattcctgagtagctgagactacaagcatgtgccatcatgcccagttaagttttgaattttttaatagtgacggggtttcaccatgtttcccaggctggtcttacaggcatgagccaccacactaggcccataaggaagagttcctgagatgtgcgacagtgattaggcaggccagggcctttttttaggatataattggggccacgctgtggtttctgatatttgaggaatttggaattctggattatttatgcctaagacacctaattttttggaaacaaattccacatttataaatgatagggttggatctgatggcctgggctttgtaaacccttttgtcctggagtcccataaatttggaatttgggt

SEQ ID NO: 669056 - DNA, 375 bp, Homo sapiens
  misc_feature (353)..(353): n is a, c, g, or t
gaatttatttttctacaaaattatttagatgtagtaaagaaaattgctttactcagtgcaggtgggggtgtagtgggctgttgactttgaatactttattaagctctactttttttttatgggaggtattgatttaaggcattctaaatcatttattagatcagtatattgcttggaaactaaaagatctggagagtttgtgcttctgtacaagtctacagataaaccgagattggaaagtacagtctggtgtttggaggcagacgtgatcttgggcagggcgaaccagaaggctgggtttagcttctacttacaccagcactgctagctgtgggctttggatctattacttntctttatcaccttcatcttccc

SEQ ID NO: 669057 - DNA, 267 bp, Homo sapiens
  misc_feature (146)..(146): n is a, c, g, or t
  misc_feature (226)..(226): n is a, c, g, or t
gacaccaatgtttcatgagtatattttgtgttgagcagaattgtgggaagggagtgtctctgggtgatcatatcaagctagagctgagattctccttcctgctccagttcaagtctgactctcagtcaatccttaaagccacctgngctggtccttggaacctgaagaacagagacagaggttatttgtgagatgcagggagtgtgtgcccggggtaggggggtcnagactaaatgtgtgttccaggaaccatcccatgggtgtccc

SEQ ID NO: 669058 - DNA, 194 bp, Homo sapiens
taagcgagagtcttttcatgtggaaacgaggctaggtgattaagagagaaaaagggagagtctaaaaacaggattagtgaaaacaaggttggttattacaacacaaggaacaaacttttgtttagaatcacgaggaaagagattttggagcaaacgtaatggaaccagttttgagggagcaaagaagaaaaagg

SEQ ID NO: 669059 - DNA, 459 bp, Homo sapiens
gccattctcctgcctcagcctccagagtagctgagactacaggcgcccgccaccatgcctggctaatttttttgtatttttagtagagatggggtttcaccgtgttagccaggatggtctttatctgctgacctcgtgatccgcctgcctcggcctcccactcgggaggctgaggcaggagaatcggctttggccggggaaggcagaggttgtggggagctgagatgacaccgatttgcagtccagcctgggcaataatagtagaaagtgccatctcgaaaaaaagaaaagagaattaacccaggcaatggggggacgcacctgtgagtcccagctactgggggagagggacggtggcaagggtctaggatgcaaggatcatttgagcccgggaagtcgagggctatcagaggagccaggtccctggccacttggacgtcaaagccttgggtagacggg

SEQ ID NO: 669060 - DNA, 658 bp, Homo sapiens
  misc_feature (38)..(38): n is a, c, g, or t
  misc_feature (108)..(110): n is a, c, g, or t
  misc_feature (112)..(114): n is a, c, g, or t
  misc_feature (130)..(130): n is a, c, g, or t
  misc_feature (136)..(136): n is a, c, g, or t
  misc_feature (138)..(138): n is a, c, g, or t
  misc_feature (144)..(145): n is a, c, g, or t
  misc_feature (164)..(164): n is a, c, g, or t
  misc_feature (166)..(166): n is a, c, g, or t
  misc_feature (170)..(170): n is a, c, g, or t
  misc_feature (182)..(182): n is a, c, g, or t
  misc_feature (191)..(191): n is a, c, g, or t
  misc_feature (213)..(213): n is a, c, g, or t
  misc_feature (218)..(220): n is a, c, g, or t
  misc_feature (225)..(225): n is a, c, g, or t
  misc_feature (233)..(233): n is a, c, g, or t
  misc_feature (235)..(235): n is a, c, g, or t
  misc_feature (242)..(242): n is a, c, g, or t
  misc_feature (246)..(246): n is a, c, g, or t
  misc_feature (248)..(248): n is a, c, g, or t
  misc_feature (250)..(250): n is a, c, g, or t
  misc_feature (255)..(255): n is a, c, g, or t
  misc_feature (264)..(264): n is a, c, g, or t
  misc_feature (267)..(267): n is a, c, g, or t
  misc_feature (277)..(277): n is a, c, g, or t
  misc_feature (280)..(280): n is a, c, g, or t
  misc_feature (292)..(292): n is a, c, g, or t
  misc_feature (295)..(295): n is a, c, g, or t
  misc_feature (300)..(300): n is a, c, g, or t
  misc_feature (319)..(319): n is a, c, g, or t
  misc_feature (325)..(325): n is a, c, g, or t
  misc_feature (335)..(335): n is a, c, g, or t
  misc_feature (337)..(337): n is a, c, g, or t
  misc_feature (362)..(362): n is a, c, g, or t
  misc_feature (368)..(368): n is a, c, g, or t
  misc_feature (372)..(372): n is a, c, g, or t
  misc_feature (415)..(415): n is a, c, g, or t
  misc_feature (471)..(471): n is a, c, g, or t
  misc_feature (489)..(489): n is a, c, g, or t
  misc_feature (498)..(498): n is a, c, g, or t
  misc_feature (506)..(506): n is a, c, g, or t
  misc_feature (526)..(526): n is a, c, g, or t
  misc_feature (560)..(560): n is a, c, g, or t
tttggtaaactgtacagggagaactcacagctccaagngcttccctccaaattatgatgaagttcctgtaaataactagatttcctacagcctggtcctctgcccatnnnannntggggttttggttgtnaaaagnantgtggnntgccctcctgtcattcatngnttcngttctgggcacngctcgtgtnatctaccagttcctcagggtgnaacannngccgntttccttntntgctctntccncngnttcantgccatgtntantgttcctgcnaanttgtttgcggangtntccangggtggtcccagggttggngtttgnggggttggtntncccgggcttgatttggcccgttttnaccatntttngcccctcccagaccatggcaactaccggccctgagtgcatgtntttcaccaggccggcaaagaatggacggtccttcaggtcaacgtagttgtccttgngagagatcttgcggaagnttgcttgantttcagancaacaaggcggaatcctttntgctcaaaacgcttgttaatctctcccacaagancccgctggtccccatttggtttgatcgcaatgaaggtacgctcacagttggccatggttccttccagctgcttaggtttgaactccggctgcagcgcc

SEQ ID NO: 669061 - DNA, 212 bp, Homo sapiens
atgatcagtaatacacacaggctatggcagaagagcattgagattgctcaaaggtggaatcgcttaatggcaggggattgacagatgagtggagtttggctagtgtagaggaagggaagagtgtcccaggcagagggaacagcaaatgcaaagtctcttgcaaactttctgtttcctggccccctacaaaatgtggattggcccttatcgag

SEQ ID NO: 669062 - DNA, 1173 bp, Homo sapiens
gtatttcatgggaggtatattttgatagagctttttgggctttcttatttttcccacagtcaactgccaatgaaggactgaatccccttttttaaaaaggttcgttgattgtcgtgtggttttacttgtgacttttgatgttacgtgacgcggcatagactatgatgagagtccgatttgatagatagatttatcttcttaagaaaagctaagacgagaacgtaacttagtgctttccgtgtgacccttcgtcttgtttactaggcatcttatcgttgttcctactttgactgttagtcaaatttgcgtcgtaatacggtggggcttccatatttcaacacgtggaacgcttctcttctactgaacgtcagatcattatggtttctgaactttactagcaggctttggtcccggtgatttgcttccctatattgtcacatgagcggcaccacttgagaactgcgtgcactcacgtgagcctctaagaatatcgcaatatttaggcagggcctcaacaagtacacgcttccctcatggctagttcctttccccccttatacttaccacatttctcagtcttaaataaacgttcaattcatgctgtcccgtgcaatattttcccactcaactttttccaggagttcattctaccaaaacactttttttcctttctccttcaagcaaacaagaagctttcctttttgccctttgatttcctttaatgtctttcccccaacttggctattggaggggttctcgactcaactaccacagttgggtaaggaacacaacaaatactgctaaccttcccattagaaagcgaaaagcgctttcaccccaactcaattttccaagtgttgcccaacgtggctaaagccaggattattatttccaacgaacttggctcaacttgtcactgttgcaacaccatgttagggttctaattcttacaacttaaagccctcttatcctaaacttagaaaccattttaatttttcccttgttccaccatttacacatccttgttccttcttctaccctgacaaattgggttttctacacacaatacttcttgacactatctctctaaccaaccaacttattaacctaatccctctatttttcctgatcacatttcgaattgcataacaaatctaatttcctactattcca

SEQ ID NO: 669063 - DNA, 394 bp, Homo sapiens
tcgtaccaggactgctgagacacatagtgagacttcatctcttaaaaaaaaaaacacaaaaacccggcacgatggctcacgcctgtaatcccagcactttgggaggccaaagcaggcggatcacctgaggtcaggagttcgagaccagcctgaccaacatggtgaactctggtctctactaaaaattcaaaaatcagccggaccgtagtggctcgcacctgtaatcccagctactcaggaggctgaggcaggagaatcgcttgaacccgggaggcagaggttgcagtgagttgagaccgtgccactgcgctccaacctgggtgacagagcgggactccgtctccaaaaaaacaaaaaaagggtgaaaaccccttaaggcggcttgaaaactgca

SEQ ID NO: 669064 - DNA, 437 bp, Homo sapiens
  misc_feature (55)..(56): n is a, c, g, or t
gtcgaccgtcgtaacccaggttgccaccgtcttcgatctgcaggcggacgccganntggtgcccaggccttgtaccggcggaggcggaagatcgccatgtaggcttcctggatcccggcgaacttgccgttcagggaccggcaatggcaccggcggactggctcgggtccttgcgctggtcgaaaggcttcagggtcacgaacacgataccggcgttcgggctgttggtgaaacgttgatcgacaggccagggaaggcaccgcgctttccacgccaggctgtttcagggccaggtcggacatgcgcttgatcacgtcttcggtacggtccaggctcgcgcatccggcagttgggcgaaggcaccaggtattgcttgtcctgggccgggacgaaaccggtcggggtgctggcgaaaccgaaccaggtcaggacgtcga

SEQ ID NO: 669065 - DNA, 310 bp, Homo sapiens
  misc_feature (191)..(191): n is a, c, g, or t
  misc_feature (197)..(197): n is a, c, g, or t
  misc_feature (228)..(228): n is a, c, g, or t
  misc_feature (242)..(242): n is a, c, g, or t
  misc_feature (258)..(258): n is a, c, g, or t
tactccagtacttcctgccctggaggaagttgtggggagatccattgggacccccaacattttgccctcacctttgtgcccagcctggaaacctacagacaaggaggagttcccccatgagctcacccgtgtttatgacgcaaagatccccagccatgggccttagtgtcctttttaacagactcaaaccncatggnccccgaatattctttttgtccagaagggctnctttccccatatanagctccagggactgtnttttttgtattcgctgttcaataaacattgagtgagcccctccccagatgga

SEQ ID NO: 669066 - DNA, 251 bp, Homo sapiens
  misc_feature (1)..(1): n is a, c, g, or t
natagctgcagcgactctcttaatttccccgctcagctcaagttatgaagtttcaggatgaattggaatctggaaaggggaggggaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagggtggtccgaca

SEQ ID NO: 669067 - DNA, 404 bp, Homo sapiens
  misc_feature (345)..(345): n is a, c, g, or t
cccagcctgttctgcagctgggtgcaactgtgtcctgtccctcctgaattgcgacaagccaaatggtcaaggaagggcccgggcaggggcttagaagtggtatatgggtttgtgtttgccttgaaccaataccgggttcccttgaatagcacctttccagggtcattgtggaagggaccacccaaaaggccttgttagtgttccttaaaccaaggcagctccatctgtcaagatggcaggggccggagtgagggggctgctggcttaacagcaggcatctgggccaggccagtcctcaaagcagctcctgaaggtctgtgttgcactgtcaccagtctcaagctntgcctctaatttcaccagggatattgactaagaagacaataaaatctttttctttgtgt

SEQ ID NO: 669068 - DNA, 259 bp, Homo sapiens
gtagatgttttttgctgggaggaaggaattttctaattgacgtcttctccccacagaggttgaagtatagctcttacagtggagacatggttgatgtgttaataccaccaagatagcaggactgaaggcatggaagaaagagtgttggaatgctatttaaggctgttttggcttttttggtgttgcaccatgcctgttaaactaaaaaaacttttccagtgacccatctaatggtcttaggtcctttaaggagagtcag

SEQ ID NO: 669069 - DNA, 303 bp, Homo sapiens
cagtcagctatcgctggccgctatgtcctcgactggacgaaatgaatagtgagcgtgtcgaaagccatgacggacaaaatacaccccatttctgaatcacctaccttcagcatctgtatatacgaagaattcttcgtacgcttgtcttatttgctatagaaaacaatacagagcatatgggaatggactcactgagttttggggcttttccatctctttcctcctagactctgtgatctgagggtataaagacatctccaccaagtctgagccctcaaaatgtccttgataagcgcgtgctgt

SEQ ID NO: 669070 - DNA, 117 bp, Homo sapiens
  misc_feature (58)..(58): n is a, c, g, or t
aattagaggcatagcttgagactggtgacagtgcaacacagaccttcaggagctgctntgcctctaatttcaccagggatattgactaagaagacaataaaatctttttctttgtgt

SEQ ID NO: 669071 - DNA, 187 bp, Homo sapiens
cagggactcggcacagctgagtagatatgggggcaatggcaccagcacgggcagcagctggcaccttattgcccagcaacatgtaccctagatctacagtagaggtcctccttaggtgaacacaaatgcccacatatccccctggatatagaggcagcagtttctaccagaagctgggtttgttttc

SEQ ID NO: 669072 - DNA, 373 bp, Homo sapiens
gtgatacatgggactgtgtctcagtaggtgtatgggatatgggagggctctatttattcaatagagtttctcagttattttcctcccttgccttgcatctccagcaaaaggtgggatctaggaagaaagaatccagtgtagaagctgagaagaacttgaacgttttggttctggataaggtcactgtcctacgtgctacgtggaccgagcaaaagactcagtggatgaactggtgcagtgcctgacagaataaagaacagtattaatccctttgagaaagcatagtccagcaggacagtggccatttggacagaagcccacttagtttcttgggatgcacagcacgtatcagaagccagacttgctcttcggt

SEQ ID NO: 669073 - DNA, 168 bp, Homo sapiens
aggggtatgctatgtgttctgtcaggaggtttagaatgagctgtgacggcgtattataccatagccgcctagttttaacagtactgcggcgagtactattgacccagcgattggggcttcgacattggctttagtgagtcttacttgttccccgtttagaagtatctt

SEQ ID NO: 669074 - DNA, 631 bp, Homo sapiens
gtcgactcttagcttgtcgatggacggtgacaccgtggtacccggatgtactggctcctgtcgccttcggctcctaatccctagaccatcgatgcagtgagtgcatctgccatccaggttggaccagggtgagtgtcgcaaattggcgaggcctgctgggcagctcatagcatgccatggtacactacagtgctatccagacccagaatggaccagaaatgctcactgtgacgagaccgtcgggggagtgacgatgactcgttcgacgccttctatcagtgagacgggcgctggacaaggcgacggtggccccgggctgtggtctgtagacgttggacacccacaggtcatggatgaagttcgcaactggcgacgctatcgtgcagtctcattaccaccctggaagcgagctcgatcacaggcaaggacgatgctgccgataagtatgcccgagggcactacagccattggcaaggagatcagttgaccttgtgtgggaccgacattcgcaagctggctgaccagtgcaccggtcgttcagtggcttcttggttttccacagcttatggctgggggaactggttctgggttcagcctccctgctcatggaagcgtctctcagttgatcatg

SEQ ID NO: 669075 - DNA, 217 bp, Homo sapiens
agctgggactacaagcgcgcaccaccacacccgactaatttttgtatggtttagtagagaagggatttcactatatgttggccaggctagtttcgaactcctggcctcaggtgatccgcccgtctcggactcccaaagtactgggattataggtgtgagccactgtacccgtccagcccacctttttcaaggccctaggaatacttgctcgtccggg

SEQ ID NO: 669076 - DNA, 953 bp, Homo sapiens
atgacccaccaatcgcatgcctatcatatagtaaaaagccagcccatgacccctagcaggggccctctcagccctcctaatgacctccggcgctagccatgtgcatattcagcttgcccgacgtccatgaaacgctcctctatgacctaggccgtactaaccgaggaacatcactgaaccgatataccaatgtatggcggcgcagggtatcgcgagaaagcacgataccaaggacacaccacacgaccgatgctgtccaaagaaggccttcgcatgacgggataaggcctatgtattagctcagaaatttgtttcttcgcaggatatatcatgaggcttttaccactcgcagcctgagacccctaacccgcccaaataaagagaagggcaacgaggcacaccaagatggaatcacaatcattgttaattcctcctaagacatggtcgcattccttaaaacagtatgccgtattactcgcaatcgtgggagtatgcaatacagtggatgactcatctgacgtctaatagcagaatcaaccgaggatagtatgaatgtcaagcgcgtgctttatgacattattacagggggcctctattgtaacctgcctagcgaggccgcaacagttacatgccgaaggtcctccctatcgagcaatcgccgaggcgccactctacgagactcaaccagggggtgtcgcccacagggcatcctagggaatttgaggacatgcatggctcgattcccccatgacggtgttgtccgccaggtaacattgcatgacgtgcgcgatcagtgaggctaaacgcggccgagagggtcgtgcagggacggataggaggcaccacggggggggctcgaaaacagaaggaacgggagccggccaatcacgggggggcggccaggaaagaacaagagagaccagaggccaaacgggaggaacgggacgaaagga

SEQ ID NO: 669077 - DNA, 705 bp, Homo sapiens
gctcccccagtgcagacacctgcagtccctggtctcctctattactcagggcgcattcatgcctggagcttagacaatactatgttatcttcttcttttattttgctaatgagtgtcgctgggcagagatgtgaataaggcctcgttccgtgagttccatactgtcctaaggcgtgcttttcattgcaagagtcactgacgttgctgctctaattgctatcgcccgtcgagggggccctgtaggatcgttgtctttcgcatgcacagagaatctaaaagctttgggctttctctgatggggcggagcgagggaacttgtgcagagctctgatggggcgcggtctcagtgcagtgcggaacgggtcaacctccttggctcacgaagaagagccaagtctcttgggcgtgtgtgcaagttagctgcgatgacatttgtcgctcgctgattgatgaatggtaggggtagacatttaaattttcggggtgcgttgcagtaatcgttagattgaaggaaaatttatctgcgtgtaccccctatacacagaagtattgccagcttgagagcgaatcgcttttcgcgtgcactaacatactatctatccctattggggaagcacaggaatgtaataagctcgtgagatgacgtggctgaccaggtgactccgctgttgacgagggatgggcgtcaaagaggctacaggggaa

SEQ ID NO: 669078 - DNA, 126 bp, Homo sapiens
agaggaccccggcactgttcggatggagggaggtgtctaggacaagtctgtacatgtctgtacactttcaccctgtgtctctttttcttccttcttactcattctctgctctacctccaagtagtt

SEQ ID NO: 669079 - DNA, 2196 bp, Homo sapiens
aaattatgcataccctggagttcttctgattggcactgactcccacacccccaatggtggtggcctaggaggcatctcgattggagtagggggtcgtgatcgtgtggatgtcatggctgggatcccctgcgagttgaagtgtaccaaggtgattgcgatgaagctgacaggctccctctctggttggacctcacccaaagatgtgatcctgaaagtggcaggaatcctgacagtaaaaggtggtacaggtgccattgtagaataccatgggcctggtgtcgactccatctcctgcacgggcatggcaacaatctgcaacatgggtgcagaaattggggccaccacatcagtgttcccatacaatcacaggatgaagaagtacctgagcaagactggccgagcagacattgccagtctacgtgaagaattcaaggatcacctagtgcctgaccctggctgccagtatgaccaagtgattgaaattaacctcaatgagctaaagccacatatcaatggaccttttacccctgacttggctcacccagtagcagaagtgggcactgtggcagagaaggaaggttggcctctggacatcagagtgggtttgattggcagctgcaccaattcaagctatgaggatatgggacggtcagcagctgtggccaagcaggcactggcccatggactcaagtgcaagtcccagttcaccatcacaccaggctctgagcagatccgcgccaccattgagcgggatggctatgcacagatcctgagggatgtgggaggcattgttttggccaatgcctgtggcccttgcattggccagcgggacagaaaggacatcaagaagggggagaagaatacaatggtcacttcctacaacaggaacttcacaggccgcaatgacgctttccctgagacccatgcttttgtcacatccccagagattgtcacagccctggccattgcaggaacccttaagttcaacccagaaaccgacttcttgacaggcaaggatggcaagaagttcaagctggaagctccagatgcagatgagcttccccgatcgagctttgacccagggcaggacacctaccagcaaccccccaaggacagcagtgggcagcgggtagacgtgagccctaccagccagcgcctgcagctcttggagccttttgacaagtgggacggcaaagacctggaggacctgcaaatcctcatcaaggtcaaagggaagtgcaccaccgaccacatttctgctgcgttcccctggctcaagttccgtggacatctggacaacatctctaataacctgctcattggtgccatcaacattgaaaacggcaaggccaactccgtgcgtaatgctgtcacccaggagtttggccctgtgcctgacactgctcgatactacaagaaacatggcatcaggtgggtggtgattggagacgagaactatggtgaaggctcaagccgggaacatgcagcactggagcctcgccaccttgggggccgggccatcatcaccaagagctttgccaggatccatgagacgattaagaaacagggcttgctgcccctcacctttgctgacccctctgactacaacaagatccatccagtggacaaactgactattcaaggcctgaaggactttgcccctggcaagcctctgaaatgcatcatcaagcaccctaatgggacccaggaaaccatcctcttgaaccacaccttcaatgagacccagatcgaatggttccgtgcaggcagtgccctaaacaggatgaaggagctgcagcaataaggaaggtcccggcaagctggctgtcatgtcccactctggacccactctggaccctgctggatgtcagaagtacaggtccgtgtgcatcctcagagccagagctggtctatccagcatggcctagctctgagatgacgaccagacctgcttcctgctctctccatcctcagccactgagtgatccaccgtggagggcacttgagattaagtcccagcccctgcctttcagcttggttcttccttcaaaaatgccatgcaacctgtatttatttttaatgacagcactccctctaaaaaaaagttttcatcctgcctgatcatttcactggtggctgaaggattttagagaacctttgttctcataagaaaaaaaaaaagccaaatccattgac

SEQ ID NO: 669080 - DNA, 143 bp, Homo sapiens
ttttttgggccccccttgtttttttttttcgccggggggcgttttagtttctttgtttttaaaacccggccttttttttggggaaacctccccccaaaatttttcccccgtttttgggccccctttaaaagttttgtcgggga

SEQ ID NO: 669081 - DNA, 848 bp, Homo sapiens
ataggctagaactccaaggaattgagaattgaatttgtacgcgtcacagattgaacttttcaatgacaaagagtaatactcatgaagttgtagtaaaactagtgaaaagaactagccttacctggagaactgactcattagcagaagttatgattttggaatttcatgcaatagttagaaaagccagtatgaatcttacatcggtgccaatgtccgcttgaggtattctcttaaagtgacgatagtgagaagactagacagatttaggtcaaagagagtatgatcttattgtctcaccagcttgccacctatcctgatgttaacagctctattaagatggaagtgggcattgaagattgtctacatatagaatttgaatataataaatcagaagtatcatttaaaggatgtgattgtggaaaaatttacttcttattagtaagaagtaaacaatacaacatatggagttacagctgatcaaagaagagatcacaggaattggacccagtaccacaagcagaaacaagaaacaatcgccaaaatatgaaataatggattggtgcacccagtaaaaggttgaatccaactctcgcaataaagggctattgtttaagcctaggactcattgtacccaaactcccaaacaatagagcaagatgtgaacaacaagaatcttgcaggtaacgcgttacttttgtgaaattttacgtgcttgttgatgaaggaaagaccgggaggttacttaaaaacaaggcaggccgcatacttttattggagaaaagctccctgaaaaaactgagggaaacagagaacaaacttttcaccaaagcgatttgaatctcccagag

SEQ ID NO: 669082 - DNA, 996 bp, Homo sapiens
gggtcctcggagacacgcggcgggttctgtgtgggccgatgggcgactaccgtgattagtgggggcacgtcctacgtgccagacgagggactcacagcacagcagctcttcaacctgcggagacggactcacctacaagtgactttactcagttctccctgggtacatcgacttcagtggagaccaaggtggacctgacttcatgctctgacctaagaaaatcacgtcttaagacccaagtggtttcctctcccatggacacagtctacagaggctgggatggcatagcaagtggcgcttcccaggcggtagttggcgttcatccaccgacgaagtgtacacctgaattccaggccaatgaagttcggaaagtgcaagaaatatgaacaagggcattcatcacagaccctgtggtcctcagcacccaaggatcgcgtgcgggaatgtttttgaggccaaggcccggtatggtttcttgcggtatcccaatcacagacagcaggccggatggggagccgcttggtgggcagtcatctcctcccaggacattgattttctcacagaggaggaaccatgactgtttcttggaagagataatgacaaaggagggaagacttggtggtagtcccaggcgaggcatcacagcaggacggaggaacatgaagattctgcaggcggcaagcaagggacagtgcccatgctagagtcagaatgattgaagctgtgggaccaacatcggccgaaaggaacctgaagaacagaatgggacataaccataggcgtccaagatgcacgaaaaccggggggaggtgccgcatggcgccacgaggcaaccaagattcgcggctgcacccacgcggtggacatagggaggagcacaaggagcacacgacgcaaggacggactcagcaaacctatacacactaagagatagcggccagcaaccatcgcggcacgagcgaaagccaccaaagcgcgccccacaaggcacaggga

SEQ ID NO: 669083 - DNA, 663 bp, Homo sapiens
ctgtttccggtgtcttaacgccgcggaccggtgattcctgtggccttggtcgtcctcctatcccctgtgcaacgcgggactctgcttgctctcttgtcccttttctgcttttcgctcagttcacattggctcaacctcaatatccatgtcagtgcccacctccatccacccttgtacctccagtaccccttctcttcaggaaggcttccatgttaactccagctgagttaaactcagctacctttggatggtcaaactactgtttgcttcaacctctgacatagcccatggcctactttctgtgggaggaatttctgtccgtgccaagtactctcacagaatgtaactcctacaaggcaaaaacggcttacgacataatcacattttccaaatctcttatactttccccatagtgggtggagaagaatgtgaattataattctttcctaacaactggttactaggtcaatccctctatcatgggaaaatccctctggagagttctcccttcctttaacttaagcagcttatgggtgtacagactcctggcttatggaatgaactcgaatcatgaggatgggagttagcccatagactaatgctgtctttagggagctgtaaccttaattcattttcccttcagatcaggggaagagttgccgt

SEQ ID NO: 669084 - DNA, 409 bp, Homo sapiens
gaggatccggcgctgggtctgtacatgactgcttgaataagctctattgtcacacaaaagcctaagggaggtaatcaattctctccaaattcctgaaaacagttccccttttcctgtccagtcaaaccagtcactcatggacttcatcaagatgggtggtgaacacgcctgggacagcatctgaacgcacagaaggatatgggatgaatgcaggggctctggggaatcacgactaacattttctaggattccgctgaggctggttttatttgaactgcactggggccacgtgacccagaactctgtctctgagtgtgcacccagagctgtgtgtcagagagcaggtgtctgatgaggcgggggcctcaatcttcaggggttccttccaggttcctgatgagctgttggt

SEQ ID NO: 669085 - DNA, 507 bp, Homo sapiens
  misc_feature (19)..(19): n is a, c, g, or t
attctgttgtgttgacttncaaccccagaaacagacatcatggtgcacctgactgatgctgagaaggctgctgtctctggcctgtggggaaaggtgaacgccgatgaagttggtggtgaggccctgggcaggctgctggttgtctacccttggacccagcggtactttgatagctttggagacctatcctctgcctctgctatcatgggtaatgccaaagtgaaggcccatggcaagaaagtgataactgcctttaacgatggcctgaatcacttggacagcctcaagggcacctttgccagcctcagtgagctccactgtgacaagctgcatgtggatcctgagaacttcaggctcctgggcaatatgatcgtgattgtgcttgggccaccaccttgggcaaggatttcacccccgctgcacaggctgccttccagaaggtggtggcttggagtggccgcttgccctggctcacaagtaccactaaaccccctttcctgctcttgc

SEQ ID NO: 669086 - DNA, 357 bp, Homo sapiens
  misc_feature (82)..(82): n is a, c, g, or t
  misc_feature (233)..(233): n is a, c, g, or t
  misc_feature (238)..(238): n is a, c, g, or t
  misc_feature (242)..(242): n is a, c, g, or t
  misc_feature (250)..(250): n is a, c, g, or t
  misc_feature (258)..(258): n is a, c, g, or t
  misc_feature (357)..(357): n is a, c, g, or t
gcggcggcagcggcggcggcagcggcggaggcagcggcagaggaggtaatggcggaaggcggtgcgcagggtggagactgtnacagcgcggctggtgaccctgacagcgcggctggtcagatggctgaggagccccagacccctgcagagaatgcccaaagcctaaaaatgactttatcgagagcctgcctaattcggtgaaatgcccagtcctggccttaaaaaagcttcanaagcnatgntatagatnaacccaanttgataaggaattcagcttttggttaatgccattataagccctacttgccaagatccagacttaccgccagatggggtgtgcatggcccttgggggggn

SEQ ID NO: 669087 - DNA, 651 bp, Homo sapiens
agctgggcggactgaggcagggggaggtttgcactcgtgtgtggcgcgggtgagccgcgtgctctcgggcacccggccgccagtttcggatgcttccgatcctcggggagccggggcgctgcgccggagtcacttcagcccatgttgttcaggttgacaccctggggcaaggagcatgactccagttgtgctaaacactgtttcgcgcggtttcctgggcctagcggttccgggcgcgcctcgcgggcggcgtgcgcataactacaacccccaggctccctggcgtggcggcacgtgggccctgagccgggcggcggggatatacaagcgcggcgtgcggctgccgcggcggagcggctgcacggacaagagcggaggcctggacaggggaaactgaacgcagaaacgaggttacttaatgggctcaaaggtcaccgtacctgacctaccagcagctcaactggccgttcccaagagaagaaacttcagggtcttgtgcgctgcaaccatcacgccaatgactgagaatggagacaatcaactttgcagtacttggtcacgtatgtggattatcttgtgcaaagaacagggagtgacagaacatttccgtgaatggcacaacaggacgaaggcctgtccctgagcgtctca

SEQ ID NO: 669088 - DNA, 151 bp, Homo sapiens
caagcataactgccccccccagagcaaaaccaatacaaaagaaacccatcatgtgtatatgataaatatatacaatttttatcacatttagtttttaaaacggaataaaaatcctgttttgtatgtgactattaaaaatggaagatgctgg

SEQ ID NO: 669089 - DNA, 344 bp, Homo sapiens
tcccctttaaatgggcacagaaattatactgtgagagcactagtaaatagttaaaccagatactgagtcatgccttcgtactactagacataaggtgattcctcttgattcagcaacctacaggaacgtagaaattcgtgaacatagaacaaccgtgacgactgtctaacttagagcaacgtctggagaaaagtcagaatgaacaagaagcttttcgcaataacctgaagacactcttagaaattctggatggaaagatatttgaactaacagaattacgagataacttggcacagcttactagaatgcagctcagggaagttaaatttctgtgcccgtttcaa

SEQ ID NO: 669090 - DNA, 114 bp, Homo sapiens
tcccgagacatcaccactttattgtagtctttcaggatttatgtagtaccccacacagttgagtaccttacctggacgtgctggtcggcagctgtcagtcctggtggagactcc

SEQ ID NO: 669091 - DNA, 287 bp, Homo sapiens
aacacgaagaaaaatataaaaacaggggaactggctgcgtgcagcagctcatgcctgtaatctgagtactgtgggaggctgaggcaggaggatcacttgaagccaggagttcaagactagcctggccacacatagggagaccctgtctctatttgttgcaaaacaagactatataaaggcaaggtctttttaaggttttgtaaagcaactccttaaactgggttttcattatggcttcggaattgggaccatatcttaaaaaacaaattcagctttcaggccaaaag

SEQ ID NO: 669092 - DNA, 1465 bp, Homo sapiens
gacgtgaagcgtgatctagctcttccaagccctgggccgcacctcacactgacgcacagcaatttgcatgcacactcatgttttgcacatttggtctggcagcttgcatgcaaattcacatctgcagcacaggcaacatcaatcaagtcaacagcacaccaaggtcaatgtcacacaggccagccaggcagcctcgtgatgttgttcctttcaccacaacattcgcacagtacccatgccccaatcagcatcatgcatctacctggtgctctggcacagcgcattaggtatcgcagggcacttccaggatcttcaaaagcaacaggcatcaaaggcttccagatggtataaacaccgggctcaattgccgttgcatgggcacacacagatcccagcagacatgtgcatatcatcggaccagcacagcagcaccagctccaagcatcaccggtccctgtataagcaagggtcagcacagcccaagtcttctcgcggtacaagtcatcacaaacgtttttcagctcacaaagcaatccggacatacgtggaacgaggcgttgcaagtatgacaaccatttcaaggaagaaaaagattacaagttcaagaaacttatttatcgcaagggaaaaaaaggaagacacatgagattatgaccaattttggattaaaccaagtggaatatatgggaaaaacattacggttcgggggacccaagttttagctattaattaccgtggcaacacagccggttcccttaccaaggaattaatcgcacattagcaaaggcccctctacaaattacaaggaccgcaacagagcagatcatacacaggccctggtgaaccctggagtggcacacgcatacttaccacggacacctgggcccacacatcaccctggaccaccattcgattataccagtaatccattcggaaaacaccaaatcgccccaggtaagtcgcaagtataacagacttgaactcggccacaggggtgatacgagcacctagacaacgtgccgtacccaatcacatacaacgggggggacatcagcatcccagaaataaacgaggacaaataagatcgcagaccactacaacaaggacacggcccgcgagaaccaggaagcaaccaccaggaaaacaaaggggaggaacaataaaaggacccaaggacagaggacacaatgggagggcacctacaataatgacgacacacagcacgaccagccaccaaagggaaaagcatgaccagacgaataacgacatcaacgacagagcagcagccacacaccacaacggaaacagaaaaccaccatgacaccagacgagacgactcacaacgatgaggaccaagcgccacaccaacccaccaagcaacgaagcaagagaaccacaagaccaccaacgacactggcagcgagcggacgatggagtccgtggcgcagacaagggaaagagcaag

SEQ ID NO: 669093 - DNA, 140 bp, Homo sapiens
gccgaagcgggagcggccaaaatgaagttaatcctttgtgacttccgaccgaggaagatcgcaaaaggcatttcaatgcaccttccacattcgagggaggatatgtcttccctcttttcaagagctagacagagtacacg

SEQ ID NO: 669094 - DNA, 657 bp, Homo sapiens
  misc_feature (522)..(522): n is a, c, g, or t
ttttctgtactggaggcctcctgaggccaggaacgtgcaaatttgcaggtgctgcatcccaagcccctcatgctcctgccttcctgagggccagaggggagccccaggacccattaagccacccccgtgttcctgccgtcagtgccaactgccgcatgtggaagcatctacccgttcactccagtcccaccccacgcctgactcccctctggaaactgcaggccagatggttgctgccacaacttgtgtaccttcagggatggggctcttactccctcctgaggcccaggaaccctttaagccacccccgtgttcctgccgtcagtgccaactgccgcatgtggaagcatctacccgttcactccagtcccaccccacgcctgactcccctctggaaactgcaggccagatggttgctgccacaacttgtgtaccttcagggatggggctcttactccctcctgaggccagctgctctaatatcgatggtcctgcttgccagagagttcctctacccagcanatatgagtgtcttcagaagtgtgctcctcttggctcagttcttctcttttggtacaacataaaaacaaatttatttttctacccctctggggatatctgctcacccaatggaaaaattgggttcaaccagcccct

SEQ ID NO: 669095 - DNA, 711 bp, Homo sapiens
  misc_feature (1)..(1): n is a, c, g, or t
ngattcgccagccttgaaatccggcaacaggggttaaactccattttggttctttgaagagagaaaacctttggcataatgtgactcagcccccagaggtcttttaaccattttctcttaaattaaaattaattagcctcgcgacgccaggtaaaagattttagaatatggtcgggcccccctacggttgtcttttgtcaggaataacatggggcatttttgcatagggacgtgcaagtcaggcttggcattctagatttacttatcttactatgaaacatggcctgtttgggagtgagggattcacaggtggtcccgctgctgcccttcttgcaaatggcagtttactgcttatcttttggcttctgcagatggttgcaattgatccttacacaataatggtcagtcctcatctctgtcccgcttcataggtgccgccatgtgtgtttaaaaaagggaatctttgtacctttagagtgtaggtaaaatgaatgaatggcttggagtgcactgagatcagcatatgatttcttgctttggggaaaaagaatgatgctatgaaattggtgggtggtgtatctgacaagataatctgggcctatgtcaaatgtagctgattttgataacacctcaaaattcagctatgaagcgctcggcaagtttgctttttttctgatgttacatacatctaacaatcatttaataaattta

SEQ ID NO: 669096 - DNA, 301 bp, Homo sapiens
  misc_feature (66)..(66): n is a, c, g, or t
cctgatacattcatatctcaggccacaatctccctgcttttcacttacttcctaccatctctaggncctacatcaccattctgttatccatatttactacccttctattacagttgttttgcctccacagcatgcatgctagatttccacaaattctttatgtcttatgtagccaaacattctcaattcatgacagaactaaatgtccaaaataattaatatcggggaaaaggaaatagtttgattacagaggaataataattataacatggcttgatcataaaaatatttttatattaaa

SEQ ID NO: 669097 - DNA, 136 bp, Homo sapiens
gatccttcacctcctaccccacgatactgacgaagaaggctgtgtggcaggtgaactccttgattttcctctgctcataggtccactgctgcgccgtagctgccttccacatcgttgatccagcggtcatcccagt

SEQ ID NO: 669098 - DNA, 328 bp, Homo sapiens
tacaggatacacacatccttggctgggtgcggtggcccagcactttcggaggccaaggcgggcggatcacctgaggtcaggagtttgagaccaacctggccaacacggtgaaaccccgtctctactaaaaatacaaaattagccgggcatggtggcgggtgcctatagtcccagctacttaggagactgaggcaggagaatcgcttgaacccaggaggcgaaggttgcagtgagccaagatcacgccactgcactccagcctgggtgacaaaagcgagactctgtctcaaaaataaataataataaaatccaatgcaataaaaaagca

SEQ ID NO: 669099 - DNA, 175 bp, Homo sapiens
taccaatattcccagttggaaataagcaagaggccgaagagcattagaagaacagcatccatcaccttggtcacctgcagctagtcctcaaagcagatgcatatagcgatacacatcaaagtggaggtagtgacattgaaatggatgagcaacttattaatagacccaaacatgt

SEQ ID NO: 669100 - DNA, 500 bp, Homo sapiens
tgtctatgaggatccctgtatctccgatatcagtgcagcaagggtgcatcgtgcgtgggtatgcatatcgctgccggcaagctccgcctaatcgagttgcgtgcgaacgcgaaaaactcttcgcaacgggttcgacggagggccggcaaaagctcaggaactgtcagatctgaccacgctcattgccaccctcgataagcgggttggtgatctcttggcgtcgcaaacagaacgcctatcaaacgctgccagctatcaggatggtgcaagcaaacaaatttggcactgataggacaaatttcactcaattcgttctgtgacaatttccttgcctggaagagatcttccatgttgtccgcttgcgtaaatttgaccagcgcaatgcagaaagagctcgcacgagatattgatgacactaaccaataccctcctcaagtcgaatgccaaactcttgtatcaggagctctgtcgataccgccccccggaagggttccagggta

SEQ ID NO: 669101 - DNA, 324 bp, Homo sapiens
aaaggcttgccttgttcctgcagggctaagtgcccaggttcgtcctaatctagctaaacactagtcactgggttccacgattctcttccatgacccacagcttctaatagagctataacactcgccgcttggccaagattccattccttggaatccatgaggccaagaccccaggtcagagacacaagacttgccaccatctcggaagtggccgtcaccatcttggaagcgacctgccaccatcttgggaacttggggagcaaggaccccagtaacatagtgaccaggaggaatcttccttacagctaatgcagcaggatctta

SEQ ID NO: 669102 - DNA, 450 bp, Homo sapiens
gttttgttcactgtatttagtagacataactgttgaataggtagttgatccatgatgtaaagaatatgtgaccatcttcaggtatgggatttctgaacgtttcagggttcggtcgatgaggcgctggcaacgcccacaggagagaataaaacgacctgtgcaaaggtgtattgtggtgtgtgtaacttaagagtacagggctgtttgagagttgagtgatgtcatgggtcaggtggtatgctgcttgcaggattttgttatgtgctgaggggtacccatttgtgttgtctgactttcgtatgatttaattgagccaaatttgggtcagaacacaaatttgaagatgacttttcagtatatgatgggtatttacatttgaacactagaattttaggtctctcaaataattaagaatagagccagttttgaataaagtctagcagaactaaa

SEQ ID NO: 669103 - DNA, 879 bp, Homo sapiens
gagagcgagtccacgtgcgctacccactgccacctcagggccccatagaagcgcgggagtagctcgtgccgctgaccaagggatccagaaaccataagaaccctccggaatctgagcgaacacaagcgtggtatcttcagtagatgttgtatctgagtgaaagctgagacagtacatatggtatgattacacgtggtacatgggtgtgtacgatcgttgaagagtgttcgcttttatggttccagttgccagtaggaattacactacatatgcacacggaacgtcgaggtatctgtggggataagtggtagtatataattgagatgtcatcgagataatcgatatagatgttcacgtatagacattacttgccagttatctcctatcaggtccttcgtagacgaagtacttagaattagccagatgaacgtgacgtttaggttttcattgttatgttgtttggtccacatggctggtgatgctgagaatacctataagttggcccacaatgcagacatcatagaagcaggctaggaaaatggtaaaaactgagatgaatacacaggtgtataaaccagtttcaagaaatataaaaattgggctagaatctcaagttatgtgtttctatattggtataagcatataagtgaaaagttcttataagtgtaatagagaaaagatttgtcagtgtgtttttttaaatgaaataactagtctgtgctactttatgtcaatataaaaattggtaaacatagaagtaacttgtccacaaccctcagttatgatacttatgtgcgtgtttttttttttccaaagtttttcccataggagaagatacaaatatatggtagctattgtttaaaaatacttcgatggact

SEQ ID NO: 669104 - DNA, 137 bp, Homo sapiens
tgatgggagcagcccagtcttgtatcagcagcatcaccctgtgtcttgtacactgaccaaagtccacaatttgtcaattgttgaccgttgtgcagacgctctggttcctctttaagtggtaatgcttcatcacaact

SEQ ID NO: 669105 - DNA, 668 bp, Homo sapiens
  misc_feature (262)..(262): n is a, c, g, or t
  misc_feature (355)..(355): n is a, c, g, or t
  misc_feature (409)..(409): n is a, c, g, or t
  misc_feature (518)..(518): n is a, c, g, or t
  misc_feature (529)..(529): n is a, c, g, or t
cacatacagacatgcacacacatagtacttgtcaggtcagcttgtcttctgagatttgtttctgaagtctggaagcagaggtttcactttgccccaaaccagtaactcccctacttctcactctagtccctagacactgcccccccaccatttctccaggctgagacacatcctgatcctgggggtccctgagcccacacatggtgactgactatggccacctggaacaaggttgggaggtgggaaatcatataaggctgangcagccataaataggaagaacatatgtgaggtgtgggctcaaacctctgctcaactggacagtgggcataacccccagacaggggcctataanttctcataatggtgggagaagtgagtccagtcctgcctgttgatgagctaacangccttttccacattcttggtcataccatgggggccacaactaaacaccccaatcttccagacctgttgcatgatgaataaatggaggctaactctttactcagaggcanggataacacantgttcagaggaagggggtactccctaattcaagacccacctaggcaacattacaacatcccttactctaattttttatgtttaaatacccaaccatagtagtacacctctatattcccactacctaggaggcttaagca

SEQ ID NO: 669106 - DNA, 247 bp, Homo sapiens
ggtccaaaacagaagctatatttggcatattgggactcagccatccattaagaacccatgtggtcctcgggacatatttatcaatataatggggttttaaatagtataaaagaaaactggtgatctatataatttatgtatcaccttcatggtaaatttagcaggaaatgcatcacaattatgatttttttttttggcaccagtggaaacaatcaaagatggctatggaaacttctaaaaactgagg

SEQ ID NO: 669107 - DNA, 336 bp, Homo sapiens
gtagaaccttctcgctccccttcctaacctctaaattctggagtgagcacagttcagggctcttcgagtcatttattcctgagggaatctcttctcatttgtcaatactaaaaaaaattttatatatatatatatatatatatatatatatatatatacacagagacaaatctctaagcgagagggttttatttgagagaaatatacagagagtgggctctctatatgcacacacacacagagaccagggcagtttacagtgtgtccaaaaaacaaagaaaagggctggtgttttattgagaaaggagagagaagatgtatgttgtttacaaagag

SEQ ID NO: 669108 - DNA, 319 bp, Homo sapiens
cacttaaatggagctgtatgaggctaaatccattactcagtctgagctaggcctcctacagtatacttgcctttaccaagaggtgcttccttccactgcccagcttgccatgagcatttctcttctaataccctatatataataacttcatggtgaggtttgccctgtgttatagcagctatcaaatccagttcctttgcttcaaagaaaatacagtttttattcatatctaactttattaggagatttatcaagcataccaaaaagtgaagaaagtatataataaatccccgagtatttatcatctttaaaaaaaaaa

SEQ ID NO: 669109 - DNA, 346 bp, Homo sapiens
tgttatcgaatgccaccacttagccaagcgtggactagtggtgtttatcgatgccactactgatcagcacgggagtttagacgtgctccgtttccgacctgggccggttcaccctccttaggcaacctggtgtgctttgcatgtctttctgtatggtcagtagcaaactttgctgcaggcctccatcttgttttacgtcctatggaagtgtgacctgtaaccatgtggcaatgctttgtttagcctccgccattttacaatggtggcccaggctcaatcctgtgtggcatcgataaacacggtgtctatcgatgccaccataaggtaaggtcctagacctttctat

SEQ ID NO: 669110 - DNA, 679 bp, Homo sapiens
  misc_feature (158)..(158): n is a, c, g, or t
  misc_feature (190)..(192): n is a, c, g, or t
ttgttggtgtgaaacaaaccccccccctcctctcctcttataaaaatttttttgtgggggggggggggaggtaaaacactgggggcgcgcggcgttttaaaaaaaataaaatctttttctaataaaagaaaaaaaaaaagggggccgagaaaaaaaantttttttttaagaaaaagaaaaaagccgcccnnnccctttttttttttttttttaacacgcaggggggggggggggttttttttttttttttaaaaaaaaaaaacacactttcccccggggtgtttttcccccccacccaccccccccttctctccttgtgtttaataaaaaaaaaaggcgtgtggatttttttttttctcaaaaaaagaggaagaaaaagggggggggaatatattatcgccgcccccccacaaaaaaacaattttttgtaaaaaaaaagaagccccccccctccccaatattaacaaacctcccacaaaaaggcgcccctcgaaaaattttgaaaaagaaaaaaaacccccggggggttttaaaaatttttttccccaaaattttaagcgaggaggcaccccctctttgggggggattcccgaaaaacccccccctggaaaaaccccgggtaaaaggaaaaagaagggaaataaagggtacccacctcactggggcaaaagcggtgctc

SEQ ID NO: 669111 - DNA, 272 bp, Homo sapiens
acgaagtaggtagcagatctgctgacttatataaagcttttgattcctactaagctttaagatttaaaaatgttcagtgtgaaatttctgtgaggctctattttagcttgggctttctggtgagagagtgaggaagcattctttccttcactaagttggtcttctctgctcttctggcatagattgcatttaacgagactaagggaaatttacaaacctaaagacttttagctcactctggctggcatagggctggctatcaggggagtacc

SEQ ID NO: 669112 - DNA, 615 bp, Homo sapiens
  misc_feature (565)..(565): n is a, c, g, or t
gttacctgccatcagcaaaatttcccccgatactaattccgaaaattcttgcgttcccgccaaatcttctcatctggatgtcccagtgttttaaacacccttttcacatactatgttcttcttaaccttcctcctagcaccatttattttacgccaatatcccatataagccccgtcctcttgcacacctttaaatttaaagcgagacatatatcctttttatttcccccccgtgcccttcaacagtgttcccataaaaataatatccttctggaaaatataaaataattgccttctattttttcgcgctccccccacgcctataagaattcaccacccccacgccccgccccccttttttcatacgatcgcttacgccatttagccccactgatcctcctactgttctcgccccccggttattctatttgtttctatttgaaccctcctctaatgccaccccgattcttgatatctcaccgtagactcgctctcgcctctttctactcctttgtatattatgaaatgtcgctcccaccatgtcgatctcattaaaaatgttttntacctccaccaccactcataaacccactttttcttcccaccaaagaacaa

SEQ ID NO: 669113 - DNA, 882 bp, Homo sapiens
tagtcacggtgaggcgatggacccacattctctaaacctgccctccctgactcgctcccggaggtcttcgcgtcacccccgcctgtaaggctccaggtgccgctaccgaagcgtgagtaccctggggctcctgcaggggtccagtagccctccatcctctacagctcagcatcagaacattctcttttaagactccgagtatggggtcctccaagaaagttactctctcagtgctcacgcgggagcaaggtcggaaggggtgtgagcgagggtccggagaagcatgggagacccgagttaaaaaatctgatccgtttttactgtggatgcacttaccgggaggtagaccaagggaggatttccgtgatcatcccacatcgcaggtttgaaacagttatccctacctcctgaaagggggggcaagcatgccccatgaaagacttctgtggacacactgtgtaaaatgaccccaggagatttgccaggtgatgacctgcggggccggggcattctggcacgcctgagaatgccttgctcaagaggggagccaagcccatgccttaccaaattgtgggttacttgtgacggacgtccgacgaaagatgggtggggccctcagtacccaggacctgacaagtggaagaaatccctaaacccagtaatggctggtgtgacacggtggcggcccttctggaagacccgggaataaacgccactgttacactcgccacccaccttatattggggttcaatgggtccaggggcacaatttcacctcatctaagggtgggagctctctccgcaccggcgatgttttgggcctcgtgcaacaataccctccacagggggggaggaggccgggggaggcgccacagacatttt

SEQ ID NO: 669114 - DNA, 159 bp, Homo sapiens
  misc_feature (19)..(19): n is a, c, g, or t
ccgagttctggagaacgcnatcagctcgctgcttaaaattaaaccacaggttccattatgggtcgacttgatgggaagtatcatcctgacggccgctgctcaggggattggcaagagctgtcttagcttttgcagagaggtgccaagtcatagccacag

SEQ ID NO: 669115 - DNA, 224 bp, Homo sapiens
cagtcatactaggacctcgggaacaccagccatctcttttctctgatatttagactgtgtatcatccattcgtgctctgcactctctcactaccatcgtctcatcttctccaatttcagacattcagataatttcttcctagatttattttaccaggccctcttcatatcactttcaccaatggagaacatacatcacatggccactcaataccgggcatcctc

SEQ ID NO: 669116 - DNA, 864 bp, Homo sapiens
  misc_feature (487)..(487): n is a, c, g, or t
tgcagtggtatacacttgtagtctcagctacttgggaggctgaagcaggaagatagcttgagcccaggagtttaagcccagcctgggcagcaaagtgagaccttgtttctttgaaaatatttattttttaatatttaaattattcacaaataatgtctattttttacaaatgtgcagttgtgttttatattctaaagtaactagaaattaatcaaaatacatacaaaatccttatttatgggagtcataaccgattccaaaacttattctggaaacttattctggaaaatgaggccacccttgcaagtttaaaaaaatcaaaataaataaaattttcctttaaattgataaacaatgatgtcaaagaaaaatctgcttaaatgctcattgaatgaataactttaggcaagcaacacaaaacagaagcatcttgttaaatgaattagaactttttcagttcagtgactatttttattcatttgttcantcatcaaatatttattgaatgccttctttgagctggataccagaagtacagcactaatgttagacaaaggctgtggccttataggaattacaatcttagtggaagtaattatatagctctttcaaacattggcttccacaacacaaggcagtgttttggccatgcggcactccgcgcgaacctgggtcccttgcggcgggaacacgtggcctcccaagttccagccgtctgggacccttgaaaggtttctccggagaacccaggcctttgagcgccccgagagacacgcgcgtcgcgcagccggcggggggggcgggtgggcccgacaggagagaccccaccttgaggagaaagaggtggcgccacaaggaaagaga

SEQ ID NO: 669117 - DNA, 122 bp, Homo sapiens
ttactctagaggagcgtatgaccttctgctctgctcgaccttctgctcgtgtctctgctctatttaacagccctcatcactgtcttaatttacctgcataagcatctgtttgtttcctgtgt

SEQ ID NO: 669118 - DNA, 263 bp, Homo sapiens
aagacacacaacaatggggatgagttgcatgaacattacgtgaagcactactcagcaggtaaaaggaaaggagccatcaagacacacaacaatggggatgaattgcaagaacattatgctgagccactctcaaaaagatacaagcggccgggcgcggtggctcacgcctattatcccagcactttgagaagctgaggcggcagatcacttgaggccaggagttcgagaccagtctcgtcaacatggcgaaaccctgtctctac

SEQ ID NO: 669119 - DNA, 373 bp, Homo sapiens
  misc_feature (125)..(125): n is a, c, g, or t
  misc_feature (171)..(172): n is a, c, g, or t
  misc_feature (197)..(197): n is a, c, g, or t
  misc_feature (201)..(201): n is a, c, g, or t
  misc_feature (212)..(213): n is a, c, g, or t
cgcttcactgaaagcaaatgtgaacctcttcaaatcccaggatgcagccttagataaataagccaagaagtcagtaacggttattgtcgtgggtaatccagccaatcacaactgcctgcactgcntccaagtcagctccatccatccccaaggagaacttcagttgcttgnntcgtttggatcacacccgagctaangctnaaattgctctnnaaacttggcgtgcactgctaatgcattgtcacagcacatgtcattcatctggggaaccattcctcgcatccagcatcccacatgtcacccatgcccaaggtgaaattgccaggaacggacattggttgtttatgacgctctgcaaacatgaccgctggcc

SEQ ID NO: 669120 - DNA, 224 bp, Homo sapiens
  misc_feature (50)..(50): n is a, c, g, or t
  misc_feature (72)..(72): n is a, c, g, or t
  misc_feature (98)..(98): n is a, c, g, or t
  misc_feature (126)..(126): n is a, c, g, or t
  misc_feature (144)..(144): n is a, c, g, or t
cttttaactgtttggtagcagatcccaggaaaggctccaaaatgtatggnctaaagagctacatcgaatatnagctaacacctactaacactaatcgntctgtaaaccacaggtataagcactttnactggttatatgagcgtntcctggttaagtttgggtcagccattccaatcccttcttttccagacaaacaagtcacaggccgctttgaagaggaattt

SEQ ID NO: 669121 - DNA, 412 bp, Homo sapiens
tctctgctcgtaatcatgcgcctgaggattctccatatctacatacatgatacgatgtttttctctctataaagactcgttgagtgatgatctatgagagcaactgactgtttaacattatagagaagccaaagatgcccctgcaagccaccttcttggtatcttggccaactttaaatacatcttggcaagtaaaggtatcaatagcaaagtatcaatagcaaatacactaaaaaaaaacaaaacaacaacaacaaaaaaacaaaaaaacgcttaaggtaaacaagtattctcctaagcctcagaaattgagtattcacaataacagctaggtgacagagatgaacttaagaaagaaaacgctgagaaataagccctgaatctataactacttggtgttcattagagagga

SEQ ID NO: 669122 - DNA, 425 bp, Homo sapiens
atagcatactatagtccctccttatccttgcaggatacattccaggacccctaatggatgcctgaaacctcagaaataccaaaccctgtatatactatgtttttttcctacacatatatacttattataaagtttaatctataaagtgggcccagcaagagattaacaacaactaataaaatagaactataacaatgtattgtaataagttatgtaaatgtaggccaggcatggtggctcacacctgtaatcccagcactttagaaggcccacgtgggaagatcccttgagtccaagagtttgagaccagcctgggaaaggtagtgagacttcatccctacaaaaaataaacaaaaaattagctaggcatggtggcacatgcccatagtaccagtggactcagaagaggtggaaggatggcttga

SEQ ID NO: 669123 - DNA, 284 bp, Homo sapiens
ctctagaggcataccgctccatacatgtgtgcccatgtggcatgtggctcaacacaggactatctgctttcagttctagatcgctgacagtcggacaccatgatctgaatagaggttcacagttaaggccaggcatggaggcgcatgcctgtaattccaacactttgggaggccaaggcaggtggatcacctgagatcaggagttcgagaccagcctgcccaacatggcaaaaccctatctctactataaatacaaaataagacactgggcacacattatggag

SEQ ID NO: 669124 - DNA, 190 bp, Homo sapiens
atgtaatgttctcagatggtctttccggcaggctatggaggctggactgtggctcagaggccttagtcagctctacaatcccagttttgactgccacgtcacgagcgccaagtgatcctggacatctccaataacacaccgcagaaggtgaagcagcagacggctgtgtcggaaaccttctctgagtcat

SEQ ID NO: 669125 - DNA, 659 bp, Homo sapiens
gcggcggcagcggcggcggcggctagtaggcagaagtactagtagcctagtagggcaggtagacggcggcgggagcaagcgctagccctacgcagagcagcctatggggtacgccggccgctacgcagcgtaatgtaggaggggcgggccggacgctagagccggagcagcctagctgtccacgggtagtgcatatagtagtagtacccaggagtaggccgggagacgagtacccagcaagcagaggcgtaggctaaatgatctcagagctgctaggtgttatgctatacagtccagtggcatagaactacctctatacctcccctagtctttccagggcctagctagatgtcaacctagcagtcaagtctgtcctacaggcactactagcgtgaacgctccaatactgccccatcacataatagcaatctattccacacaacgttcttaatccttagtctccggaacctgctacgcgcaggccctagtaggctcctcattcgcaaccactgtcggcgcgcgcgaaccaatacccgtacgaaagcgggctacatcccggcaaaaccggcaatcgccaaagttgttagcacttcttcgcacatcgtaggcgctataccaacgcgctcataatgcctattaacttgggccacacacaccac

SEQ ID NO: 669126 - DNA, 863 bp, Homo sapiens
gtctatagtattagacatgacatcgccacactccacggaagcaatgatgacaatgatctgctgcagtgctctgagccctaggattcatctttctttgcaccgtagggcggcctgactggcctgtttagcaaactcatcactagacatcgtactacacgaaacgtacctacgttgtagctcacttccactatgtcctatcaatagcgagctgtattctgccatcataggaggcttcattcactgatttccctattctcaggctacacccctagaacacaaacctacgccaaaaatccatttccactatcatattcatcggagtaacatctaactttcttcccaaaaaaatttctcggctatccggaatgccccgagttactcggactaccccgatgcatacaccacatgaaaacatcctatcatctgtaggctcattcatttctcctaacagcagtaatattcactcacttccatgattgagaagccttcgttgaagacgaaaaagtcctaatagtagaaagcaacctccataaaacttggagttgcctatatgattgccccccaactaccaccattcgaagacccggtatacctaaatctagacacagaagggaaggcgttgaacccccccaaagctggttaagccagcccatggcctcagaccttgtcacaacaaaaacggacacaatgacacaccaaaccagtggccggccaaaaaattaaacatatgtggcgggccaaataaaatgaacagccaaaacgcagaaggcctccaaaagcggccgcgcatcaaccacatggcccgaacacacgcaccacccgaggcacccaacacacacacaacaacacccacgccacaccgc

SEQ ID NO: 669127 - DNA, 298 bp, Homo sapiens
  misc_feature (91)..(91): n is a, c, g, or t
  misc_feature (158)..(158): n is a, c, g, or t
  misc_feature (219)..(219): n is a, c, g, or t
  misc_feature (258)..(258): n is a, c, g, or t
tcaggcgcccgagactttaaaagaaatatttaaagcatgtacaggagacactgcagcccctcatgccaaacccagggaaaaatgtcccggnttcttgaaacaaccctatgaagaggagactattatgattcctagtttccaggtgagaaaaccgaggntcagaatcattaaattacctcaccaaggtcgaacagatggaatatggtccagccaggcccngagccctgactatgctggactttaaagttgatgctactnactacggatgagtggtgtgcacctgtgtgcccgtacctgt

SEQ ID NO: 669128 - DNA, 989 bp, Homo sapiens
  misc_feature (10)..(10): n is a, c, g, or t
cctccacatntcttacacaacatcacccctctttcatgtatgctcacgattgtgcattccacactgtaccgtttcacacagaatagcgcctcatatccttcttgtgcgtaaacctatcactcccccgtttttggcacacacacggtttcctgagaagctctcttggtataacgccccaactcttgtttcccaaaactgcacacttgtcccccccaatctcatgttcatttttgcgccccaacccggtgttaacgtttgcataccccctgtcgcccccgtggcaaactcttaagcttgacaccaccctcttcctcaatgggtcgcaccccactttgtgtgaagaccgtccggtttttgccagacgaggtgttgttttgcacagggacacctaccacgcgggtctactatgcccagcgtcgaactactttcccggaaggtttgtttcaaacactggaagtagactacccgtggtgatgtctccagaaaaaaaccttgggccccacaaagaggttctccctgcaattttctgtgctcccctaggtaggagggcccctcccatggcgacacaggttttctccacaaagacactctttggctccccagttactttctgcgcgccatttcaaacgaggtggttcttattatgcacagccccccggcggtttatagtctatagaaaacatcacgcccctctgtcgttaagggggtcaatcctctggctggctcccgcactgttttgtttgctcttgtaaaactatcagggcacacgcctcgatgcgcccgttgtccccactcgcccttatacgttagctactgcgtgaataataaacgcccaggaggattgaatcacgtatgttttttcaacaaaagggggggataatggacaccgcttttccatgctcacgggtgaataccaggagcagcccgtttgttgcagccccgcccgggggtggtcccaaaaaacaaatagaaaaccgaaaaacataaca

SEQ ID NO: 669129 - DNA, 1006 bp, Homo sapiens
ggctttagtgccttcccgcgggcaggctcgggaactggagcccgccatgcctgagatcccccactctccgtgagctactgggcagccaagcctcccccaagagcgccacctcctgctaccaggcgccagtcccatcgacacccaagggctgagaagtgcaggcacagggcgcgggactgacaggcagtccactggatgaagccagctacgctcctgactgtggtggggacgtcgcgagcaactttatgtactagctcagggatatgtagaccacaccaatcggacactctgtatctacctcagaagttgtaaacacaccaattcagaaccctgtgactagcatcagggtagtgaatgcacacaaacccacactctgtatctaagctaacctggtggggccttggaacacctttatgttctagactcaaggattgtacacggcaccaactcaagaaccctgttcaagaaagaccccaatatggcatcctacccaatcagaaacgatgtgaggtgggcgcacagactacgagtatcacaaagacggcgtggccatcaccccgacagagcaaacgaacgcaggatacgtatcccatgccctgtgacaggaaagtatcatcatcgctctcaatgtcaccagcttcagtgatgtaatctatcatggttacactgagtgatgaagttgtaccagtcgtacacaaggggctgcacatatccaatctgcctcggccgcacgatgaagcccccagacacgaggtagcggcagacccaccacaggtcgtgcgagggtatgaatcgacacaccccaatggggacatcaggtgaacgcgaaccacatgggggcaacagggacaaacctacccacgggccacgggcaccagacccatcggcaagctcgcgaagacacaaagaaacagaaaggagccagcaaaaaccaacagaccagcaaacacacacgcggcgaacacagcagcaaaaaagcaaccccctacagcagacacgccgacac

SEQ ID NO: 669130 - DNA, 121 bp, Homo sapiens
  misc_feature (1)..(1): n is a, c, g, or t
  misc_feature (16)..(16): n is a, c, g, or t
ntttacacatatgctnactcttcttcatttatccatttaccttttcgtataatcgtgttccttcgcgtgttcatacactttcacgtactctttcgcgttcgcatacgcgtttttacgtgtg

SEQ ID NO: 669131 - DNA, 325 bp, Homo sapiens
ggggttttccaatttgggggccccccccacccctttaattgggggggggggggggggtttcccctggacccccgggcctttttttgttcaaaaaaaggggggttttggggaaaacccggggcccccccccccggggggttgggggggggtttccccggggggtttgggcccccccctttgggtggattaatttgtggggggtttgggggggggggttttagggggggttttttttttttcctttttttggccggggcccgggggggaaattttgggggggtttccctttcctttttttcccctgggatttttttttttgggggga

SEQ ID NO: 669132 - DNA, 200 bp, Homo sapiens
  misc_feature (99)..(99): n is a, c, g, or t
  misc_feature (175)..(175): n is a, c, g, or t
tgacgcccagcagcctatttatatgcgtgtgcagaccttccattaggatgctgagcggaatcggcctcgctgtcagaaagagctctacagcttgctgantccggactagttcacgagagcctccagatacctcattatagaagatgtgtgagtgaagaggccacatgtctgccgnggcagcaccataatgccgggtaccg

SEQ ID NO: 669133 - DNA, 1012 bp, Homo sapiens
cgtgttcttctttcccagagttttttaagggtacccaattttgtatttgccgggcaatactacctcccggtctaaatccaagtcggtaaatcacgacaaagagggatagacgggtagctgttccggatcgtaaaatagaaattgaaaggatcattaactagcgtgcatttacctaaatttgtcaatcagttaattgtccaatagggaatttactgcgagtattgaacacatacaggagtatggaggcaattctctgcaaaccaattagctagatttaatttgaaggagaggtgggctgatggctgagtgtatgttactacttggtcctgactggttgagcaaccatgcctcatttctttgctacatgtagttaagatatactttattctaatgcaggcctttctaaatttgtccactgcattcttggtatttcagctatctcttctagtcagtcagaacttcgtagaccgacctgaagtttctttttgaatacttgtttcttttagcaccttgtgacagcactagaaagaaccactttgataagtactcagtcatcatcttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggcttatgcaaaaaaatattttgctggtggaccatatttcttaagcatcaagaagagtgctcagtttagcttgcattccttgagaatgtatattatgctgcaaagatcagaagacaaacaatccagatgtataagtactaggcagaagccaactttttaaatttccttgaataatccatgaaaggcataattcaaatccagataaacagagttggcagtatattatagtgataattttgtattttcacaaaattaaagttaaactcttcttttctttttattataattaccgctcttggtata

SEQ ID NO: 669134 - DNA, 529 bp, Homo sapiens
caggctgacaaaagcgtcctcggatgcggcctggttccccacccttgaggggagccagggtctgtgatatatagaaaatggaagaatcagacccggaaagttctaaacggcactgagaggaaaactcccatggaaatccatctttgttttcccagttcggaggcgcgtgggccctgcgtgcgcgggcctcggtctgagcggccggcctcggcagacagcaccaaatctgtaaacggagctaagctcacacgaggactctcggcggctgcttttgttcgtagatgagccagcagtcgatactggagggtctggggctgcagaaacaggcatatatagcagagataattaaaacatttcatgattatgacagccacattctgctgctgcaagctggaggattcatgccacccaaatatttagcaagcatcaaataaaacactggtggcaaaataaaagtaatagaaaaaaaaaacagagcgtaatacatttcaaaggcaaaggagtcaaggggaggaacgggggatcctct

SEQ ID NO: 669135 - DNA, 156 bp, Homo sapiens
tacgcacagacccgtcaggccagtaaggactaagaacattaggtcctggcaaggtgcagccctagagagcagcacgagagagcatcaagctgcacaggcggctccaggatgtcggtccgggagcggggcataagagggttagcgagtgattctcga

SEQ ID NO: 669136 - DNA, 404 bp, Homo sapiens
caggctgacaaaagcgtcctcggatgcggcctggttccccacccttgaggggagccagggtctgtgatatatagaaaatggaagaatcagacccggaaagttctaaacggcactgagaggaaaactcccatggaaatccatctttgttttcccagttcggaggcgcgtgggccctgcgtgcgcgggcctcggtctgagcggccggcctcggcagagataattaaaacatttcatgattatgacagccacattctgctgctgcaagctggaggattcatgccacccaaatatttagcaagcatcaaataaaacactggtggcaaaataaaagtaatagaaaaaaaaaacagagcgtaatacatttcaaaggcaaaggagtcaaggggaggaacgggggatcctct

SEQ ID NO: 669137 - DNA, 684 bp, Homo sapiens
cgcggagcggaacaaggatcccatcttgcacgtgctgcggcagtacctggatccggcgcggggtggcgtccgcgtcctcgaggtggcctcgggctccggccagcacgcagcgcacttcgcgcgggccttcccccctgtgcctgatgtatgcatgcctgtctggactgttggaccagctgctgccatggacatgtgggctcttcagatgcagcaggaggggcttgctcaaacccaagtggcccttgctcatcaccgtacgtggccctatgccatcacatggggaatgatctccccccagagacaacgtggtactttgacctgattgctcagatgcaggaacccagaaatgggggcttcgggacacagcgcctcctggtatgaccttggtaaagtgccagtttgcctgctcctggagagggatggtgggacattgccaggccacacaaacaaataggcttgatcttctcggaaaaactaaagacccctcctttcacccccgcgacacacttagcaatcccctatgcctgggaaggcttcaagagtgaagagcacggaagaccattgggctcccctatgtggagcgggacctttgttggactgaaagaaccccaacacaaatactggtgggtctcagcctgcttggcccgaaagggcccaagcttgctcagaataaagcatgtcctg

SEQ ID NO: 669138 - DNA, 524 bp, Homo sapiens
gatgtgctattgtgtgctagatactatacagtgctcacacgatacttatggatatagtatagtgacacacatctcttcaaggcagatattattcccaagctaaaatgaatatgaggcaggagaatagggtctgtaggcaagaaacctaaggccgagtacatgctgagtatcacagaactagaatcacaaggtaacgcctcgaactttacatgcccaggtaataacatgaccagattttactaacatgagcgacctcccgtctcctaagtgacatatggaaaaattgaaggtgcctctgctttgtcccctctgagaaacaatcaggctggttgccgggcaagtttatcatattgcatagtagtgataactttgaaacttcactatcgagcctctgattggtcactttctggcaccaaacaaaccttagcataaggtgtaactttgtaaccttgcttcagactctgattgtccctctcctgaaatcaatcagactgatctcaagccactactaccttcacctaggg

SEQ ID NO: 669139 - DNA, 686 bp, Homo sapiens
caatgaaggaagtggtcttgtctgcaggtgggctgctgagggtctgggatctgttactggaagtgtgcacggtataaacacaccctctgtgcttgtgaccgaaacgtggcagttaccgtgctcattgctaaccagtgtctgtccctgaattcccagaaccactacatctggcttcgtggcaggtctgagataggaaacgatctaaaggtaggcagaccctggacccagcctcagatccaggcaggagccacgaggtctggccaagggtggcacggggtggtcgaggatctcaggagcccgttgcggtttcctggagggtgacagaagaaaccttaaacatagtcagctctgatcacatcccctgtctactcatccagacccctatgcctgtaggcttatcagggagttaccggttacaatgtgttacagtgatgttcccaactcagtctgctcacgggtgagaagagcagggaggtatggacatttaataaagtcttacaagcacttataatcttccaattcctacagatattaacaaggacagacaccttttgtgtggccgctctttggcaccttaagaagaaggtttttcaatgcagcacattcttatgggcggggggggccccctaccaggttctagttgacccatggtgccatgacggttacacaaggggcatccgggtaca

SEQ ID NO: 669140 - DNA, 566 bp, Homo sapiens
  misc_feature (524)..(524): n is a, c, g, or t
ctccaccaggtttcagctgactgttacttataaccagtgataatgacctgaccgtgatgaggcgctcatgacacagcaagacctgaagaccctatggagctataatctattaatgcattcagaacctagcaaacccacaggtcctaaactaccaaacctgcattactacagacttcaccatgtagcgcgtactactatactcaattgatccaataacttgaccaattgaacatgttaccctaggaataacagcgcagtcctatactagaggccatatcagcactaggatctacgacctacgtggttgatcaggacatcccgatggtgcaaccgctattaacggcacgtatgatcaacgccttaagtcctacctgatctgaggtcagaccgaagtaatgcaggtcgagttctatctactccaaattgactcatgtacataggacaagagaaggtaggtctacttcacgaagtgcctatcaccgtcaatgtaccatctcacttaagtatatagccaacactaccantgaccggtttatatcaatgactctagacttgaagcgagaccc

SEQ ID NO: 669141 - DNA, 137 bp, Homo sapiens
tatatgatatccggccattgatgtattgccagaataactacacaagcgtaatgatgtggccctgtgatttccatgatttcccatctgtgccatcggattccttgcataccagcgtgtacacgcgctttcttacagcc

SEQ ID NO: 669142 - DNA, 890 bp, Homo sapiens
gcgaagacctggcttctgtgaacaaactgctgaaaaagcatcaactgctggaagcagatatatctgcccatgaggatcgcgcgtgaaggacctgaagcagccaggcagactagcctgtatgaccgagcatgctgccttcgacacctcccaagtacaaggacaagcagggacatcctatcagactggtgcgcgttccagaaaatcaagagcttggcgggcctctcgctggcgagccaatgctgaatgaatcccgatcgtctgtgaccagtgtcttccgggacatggatgacgaggagtcctggatcgaggagaagaagctgtcgtgggtagggctcacgaggactacgtgctcgtggatcctaaaccgttgcaggtgcagaacctgaggaaagaaggcacaagcggctggaagtcatgagacttggactgacgtcatgagccgaagctattgcagggtgtacctggacacttggcaatgaagctgtccgatgacgagacgaccgataagcggtaatagaggacgatcctagcaggcgcgactggccgcatgttggtgtgagcactcggaaagagctgagggcaggctggcagctgcccggggtacagctggctggaagatgtccttggaatatcatgcagtttgtatgccaactgtgggaagaggaaggaagccctggactcaggtgagagcactgaccctgtgctggccatgcgaatgatttatggcctgacgacgtctgtgtccgcccatccaggggcttactgaaagaaagcgtgaaggcttatgaagacagactttcaaccgtccagaaggattcggtgttgaatgatgtcttgcaccaaatggggcgagacctcattaagaagcaaccaatcaccatgaggagaac

SEQ ID NO: 669143 - DNA, 122 bp, Homo sapiens
  misc_feature (117)..(118): n is a, c, g, or t
gcagatatttggggagaagagcattccaggtggaaggcccagcaggtgtcactgcctggaggtggggcagagctggcatgttcaagaagagtcagaaagaggggtttgcccaagcanngaga

SEQ ID NO: 669144 - DNA, 304 bp, Homo sapiens
gattttacagaatcctgagttttaagtccttacgttaagaattgactgattaacacagggttgaatgcactatgtctatcaaactgcaggcaggtaatggaaaaacacttttagggtgattttaaccacttccggttggtccaggaagcttagaatcaacacaggtagacctcacactggcctgatggactgttaccaaagacaggttcatacggcattcataacccatatagacttcaggttgaatttaggggtaaaggcaatgtattcctatggggagagagtcgacgcggccgcgaattta

SEQ ID NO: 669145 - DNA, 176 bp, Homo sapiens
tatgatgtatccctgcttatagtggattgcatctgacgacgatgtctcaggtagcccagaaaatctgaggagttcaatcaacaagttcttacataccagaaagactgcaatttatgaggagactaagcaaaggggggagttctcctggggtttcctgacactgtctggatgaatga

SEQ ID NO: 669146 - DNA, 607 bp, Homo sapiens
  misc_feature (554)..(554): n is a, c, g, or t
  misc_feature (584)..(584): n is a, c, g, or t
aattcgcggccgcgtcgacacggctgcgagaacgacagaagggaagtatgaacatacttgaaacaaatagtttttctaaagtcccagcaaagcaatagaaagtctcagcaaagaaatggaaaatgtaaaaaaataaccaacggaaattctggaattaaaaaatataaaaaccaaaataaaaaactcaatggattgactcagtagcatagtgtaggagacaaaggaaaaaataatcagtgaacttaaagatagagtataaaattatacaatctaagcaacacagagtaaataaaccaaaacaaaaaacaacaaaaacacccagatccttaggcatctgtgagactaccacaaaagacctaactttatgtctttgagtcttgacagaaaaggaaaaccagtggagctgaaaaagtttttgagaaaataacgtggtggcactttgacaatgacataaactattcagaagctgagcaaccccaaacagataagctaagaatcccaccagacaatcaagtcaacttctgcaaactaagtgagaagatctggaacaatgngggaaacacttttctataaggccattgttngcatggcatacttgcgtggggcg

SEQ ID NO: 669147 - DNA, 88 bp, Homo sapiens
catggatttgctggtgcagtacaactaggcttaatagggacatgctagtctgcttctggcctttagtaatttgttaaaagcgttagaa

SEQ ID NO: 669148 - DNA, 1013 bp, Homo sapiens
gtgttggctatgtgaaggaatatttcaactacaatggaatggtctgcttttcacccttgaagtttgacgaggctcttgatatgtattaacattatcatggcagggaaatactataacgaagaacaatattactacattaaacctataaactaaaaattcgtcaaatcgaccaatactttcggtctattcatcaagaacaacacttatcgtaatgtatcgtcgtcagtctatatagccagtctgtctgcgactgcctcaaaaagttcaatagtaagccactgctgaagatgatatatgagcatcgcaaactaagactactgaccccattaaagacagcacaaatatactacctattaaactgatcgcatgtcacacggtaactacagtctcactacaacacaaccacaaccacaaaaccacactacaccacacccacccacgcccacaacaccacaagacacccacacaccccaaccccaatatgagcaagataaggatacataggagaaagataaatacagacctcaaaaagagagtctaacaaagaaacacggcgagtatctatcaaagagatagagaatagcacacacaatacagacacacctgtgatcatacaaaataattaaaaaaaatccaacagaacaaaaccagaagaaacacaagacgacaaaacaaaacagagaatacaaaccacacaacaaacacagctacgccagaagaagacacaaaacacagacaacaccaaataaacagaacccaataaaaatgacacaggacgcgcacggaacggacagaggcaagaacaaaaaaagacaaagatgaagcacgcaaaaagccgacaacacgcacgagaggacacggcagaacagaacaatcaggcaagccaagcagcgctagcgccacgagcgaggaaggcgaggcagggcgaggacagagatgagagagcttacgacgcgaggcgcagacggcgacggagagaaacagagatacagaggagcaccgacaaacgaagc

SEQ ID NO: 669149 - DNA, 657 bp, Homo sapiens
ggacgccgcgacggctgcggagccgatgcggcctccgcttaaagttgctgggttgtgctccgtgtgtctcaaacatgattgaacgatctgtggtggaagcacagtccagaatgcagtcagtctgtgatgaaactatagagcacgtatcaatatcataggagcatagatattccacgcttagtgtatcatcatgagaagaaccaaaatttcttcctctgttaaatgaccaaccaccctgcaccaaatttattgggaacaccaagagataaagcagagatgtttcgtgagcgatataccattttgcaccaggaggacccacaggcatgaattatttactcctccggtgataggttctcaccctgatgaaagcgtgaagcaaattccacgcttacaacaatagaaaccttatagggtagtacaaccaaaatcggagatgcgattgttcttggaatgataacgcagtttaacagagggcaaatcccttctggaagatcctactgtaaacagtccaatctacacccttagtaaacgctcagttccatagtgttctatacacagagtgcatgctttgtcttagcagcaccggttcggtcttgacaggatccaagttgttccatcgtccaattgcctttgtactttcccacgccaactgagccc

SEQ ID NO: 669150 - DNA, 112 bp, Homo sapiens
cagtttacagcggggcagtttacagcgtcagggcattaaccagtggccggttgccactctcctcccctccctcagagacaccaaacgccactggttaatggaagaggatgcg

SEQ ID NO: 669151 - DNA, 201 bp, Homo sapiens
ccactagtcagtccatctccatctccatccccatcctcacccactttccagcctttaaaatgagtagggatagcattaggagaaatacctaatgtaaatgacaaattaatgggtgcagtaaaccaacacggcacatatatacatatgtaacaaatctgcacgttgtgcacatgtaccctagaacttaaagtataattaaaa

SEQ ID NO: 669152 - DNA, 1931 bp, Homo sapiens
  misc_feature (387)..(387): n is a, c, g, or t
  misc_feature (1931)..(1931): n is a, c, g, or t
tggtgaaaaacaaagtctccactcctgttctctctacaaaaaaaaaaaacacacaaaggtttcccccagggggaggggagccatcccctctctattgtctggggcacgcatagaaccggtgttccctgtgtgcagtgggactacacaggtggagaggagagcagccgttttatataaattcaccaaaatctatagatatacacaacatatataaaaacaacaatgtagctctctgggggggcatctctctctttctctctttctacctcctggtggtctctctctgtgtgcgcaagagagagagagcggttggcgcgctcatctatctatcatgacgagatgttgtttctcttcttgtgttgtgctcaccgcgcgtgcgctctctcncgagagagatctcccctatatatctctctcgcggtggtgtggtgtgtctctctcacgtgtgtgtgttctctctctctcatctctctcacacccgtgtgtgtctctcacacacacgacgcgtgtgtgtgtgtcgagacgacacgagagagaaaaacaccataacacaaaaaaacacaaaccactctctctcacgagagagcatctcatctctgctgtcgtcgcgcggcgcgtgtgacgatgagagaaaacaacgagagtagtagtactaatataagtagaaaagtgttgttgcgcaccaccacggtggttgtgcaccacactaactggtgtgatgtgcttccctctgctgcgaccaccccccaccctgtctttctctgtgttgttgttgcacaacaagcagggtggtgtcgctcaacacactctgcgcgagcgagagagcactccccctactatatagtgggggagggaagccgtgcaatactataatattatattctcctcctcctaatcataaaccccgcccccgcgtcgttgataattaaccacacccgcctgctgctgactataattttatatgtactcctttctctcttccttctcactcacataacacactctattcctctctaccatcaacaacctcaccacatacacatacaccacacaaccatacttctctcactcacttcacatcatacccatataactctaacaacaaacatccactcacacagcaacctatcacaactataaacctgatacctcacaaaacttaatatctaccttaacatacatactacaatatctaactaactcaataaatcattaccatactatgtcaccacaccataacacaacaatcaacaagacactatacatcacctcacagaaatattaatacatacctacccaaccaagcctaccaatctaacatcaacacaaatccatcactcactaatatgtatccaactatatcatcataacaccaaatacctctcttattttatcaactcgaccaaaatcaaaatataaaacacttactcatacttacacacaaaattaccacaatacacctattatattcactaatcatctcactaccactatctaactatacccgcccacactcatcactatcgacaacacatactttactccatgacatatccctactttctatcttctcatcttctattagcacacatttcactatcatcttactatactataataaagaaaactattatatacaacagtatccaccaagctaattattatataataaccaatattataacaatattaactaaatacataaatccactatcatcaattagtctatcacaactacactacaccacatctagaaacatctcagatttatatagtacattatccttcacaacatccaaactaacatcaacaaatcacaatccagtcataacttatcacacatatcaaatcaactctactaacttcaagattaattcactacatatctaaaaaaatatatctcataacacatacccatatacaatctatcn

SEQ ID NO: 669153 - DNA, 281 bp, Homo sapiens
accccctgccctttttttgccccatccctaccctaaccttgttttcaaccccctttaaaatccctgggccccctgtgattttttaccctgacacccctcccttggactttgcctggggtggagtttaaggctgggggtacatttggtttttgtactggctaaggacaggggagggaattaagttggtttggggtggcctttttttcccctttcagccccccccatttgcattttttggtgggcccccccccctcccaataaagtcccccttttttttttta

SEQ ID NO: 669154 - DNA, 692 bp, Homo sapiens
  misc_feature (303)..(303): n is a, c, g, or t
  misc_feature (432)..(432): n is a, c, g, or t
acattggtgtgcaggataaagtttggacagtatactcgttccgtgtctcattggcgtatagtacataggaatgaaatcgctgaggttatgtggtaacactgatattcacgcatctaggcaggacctcgtcgataatgtgtcttccatacggtagctgatcccgattttagctatacatgatcttcctgtagtgatgagcggacgatcctccagctcgtgttgtgaccacagggcctgagatccagcagtgctgcgtcatcagcaatctaacagagtcttcacattgaagacgcatcatgtgtntcgctggtttcgaatcgaatgtctacctggcgctctaagtcttcgcgtgaagaataagtacggaagactgtgactagagtcattggttgtcacacgcagcagcgcgcagcatgacaacacttctacttntgtctatggttctacagtagtgcttacaggatccacatgccagctccaattgggcgtggaaggtgccatgggtcgtcgtaatctctcgggaactcgacgtgaagacgtggtacccggaaccgtcaccgttgagtagcaaggtcgcaatcattgccagtgcttctcaggctgcccccaatcgtagcgcctatttaagtcaggaaatctaattcggtggggggaagcccagtgtgttggaccgagtcgtttacgggtgacgg

SEQ ID NO: 669155 - DNA, 849 bp, Homo sapiens
tccccggtactttcgtttggcgcgccggtctttaacgacgtctaccattctcggggaactttaaaaatggggcgcgccccttcttcgccccccaaggaactttgggcccaccaccgtcttcccacggtgggaaaaggagcatgtcctccccgagtgcagcaattcttgtagttctctcgcttctcgaggtgtattaatagccgccactaaattgctctccgagtgaatattcctactgtattttacagtccctgcacaagaagtaaaaacatcgtgctctgtgaaacagcgtcaatcacacaggtctcaacaccgccgggggcacccctccagaggagcgcgccaagtcttccgccgggaagtaggagaacccgggtggtggtcacccccccgccacagaaccctgttattaaacgccatttcttggttgtgccccccctcacacgagtctaattctgggaggagagaactccgccgcttcttcttaaaaatattttatgtggagaaggcttttctggaattccttcatacctcattgttggagactcagcgctgttgttgacacccacacaagaggtcttaagtcgtttcacccacgttcgcgataagtctgttgccagattgacgacggcatggacaatttggggacatagtccacaggatagcatcttgtctttcccggcgctcttacttatatcaccacagagggccctccagcaccacgtttccttggaggctcatctgggtgcgccgccgttgaagaaaggagataaagaagcacgccctgtttcggggaagaaactgtccttctaccgcccttataaactaatcccttctggggacaaaaca

SEQ ID NO: 669156 - DNA, 420 bp, Homo sapiens
aatactcgggggatggagcaaggtaggtgagggaccctccatggtgggcaggggtatgagcgagagagtgccatgaagagtccggaggaagagtgcatcgtcgtagagtgaggcacaattactctttgatgtactggtagtgagggctggcattctggagtgtggagcagaacatctgagccaccgtgtggtacaggaacctgtactgctccatgtaggggtgagggaccatcaagaagggaaggcatgggcaaatgacagcagtgtgtgccactgtccctgaagattaggagacccagggttcacctctgtctgcacggccgcaggccgctgcttcctcatcttaaggaccacatcaaagagactgaagtcaggtgggctcatctggggcagacagacaaggcacttgagcaggacacg

SEQ ID NO: 669157 - DNA, 160 bp, Homo sapiens
atagcaagagacagagaagtcaaagaaataagcaaagagaaacactatgagattcttttttttggagacgggagtctcgcccgtgtcgcccaggcgggagtgcaagggtgtgatctcggctcacggcaagctccgcctccggggtcacgagattctccgg

SEQ ID NO: 669158 - DNA, 287 bp, Homo sapiens
caagagcatgtcatcggggtgctgtgggacctcaaagtatgcatatcgtcaccattcttcaacggtaaagatgccactgggggaaagaaggaccaaccttggaagacagagtcagtctggaggcaagatcttgtttcaccagcatggggccagttccatggtgacaccttccccaggcaatcacctttctgagcccactttatatcctaggcctggattcaaagacacttgagccctgctacatcacttcttttgaggtgctatcttgatgcctttcctatagtcac

SEQ ID NO: 669159 - DNA, 1383 bp, Homo sapiens
  misc_feature (293)..(293): n is a, c, g, or t
  misc_feature (295)..(295): n is a, c, g, or t
  misc_feature (304)..(304): n is a, c, g, or t
  misc_feature (313)..(313): n is a, c, g, or t
  misc_feature (366)..(366): n is a, c, g, or t
  misc_feature (694)..(694): n is a, c, g, or t
  misc_feature (811)..(811): n is a, c, g, or t
tgagctctctggagaatctccaatcggtcagggatgcgtgtgccttcattgtaccattcctcagccacctgctgacgtagtaataccattcttcaagactcacagtcacactgccagctccagaagtccccatgaccctgtgtacacgacctaggagtgaaggggagccatactatggctggaaggacatatctacctagctattgtagctgccttcttgccatttctggaactgtaggctcctagtgcgttactgatcaagtcggactaaggttgatttgagacctcatccnanagcctgcgncagattagntgtgaatttagaagtcacgacatcctacctcactcgctagggcctccccgtgntagagtgatgaaacattcaagcggacattctgcgttagtccagaacagcactcgcactcttgcggcaataaatcctaggaggtccaggatgttctcgccgtagacttaggcattgaccataggtatggagagggacgaaccgatgaatggcgatccatttgagttattgccagacgcaacattattaccggcaccaaaaaggaacacctatgcgctaaaatgtgtgttacgaatttacctttataataagagattcgcacctgtgaactagaacgtgctcaactagccacgagttctttggtacccctggggatagcttcgcatcccnttggcagaaaggtggcacgaaccacgagcttaggtgtccatacctggcctccccagattaaaagcgtttcttgacagacacgtttggcgaagggcgacactctgtgcgcaatagcantagtcccttaaattgcacctctatcattgcatagtgagttaccacttggcttgatagagctcgctcccgacgtcattcccgtgtggtagctaagatagttgaaacaataccgtcctgctcgattaggcttagagctggctatgagaatcaagtgttagtactaatcgcttgagctattaacacgaaggagactacttgtcccgagcccctgctagcgaaatttaccctaaagtttcccagaactttagaggaacaggactgggccattaaatttcttcccatattgtaccaaaacgcgttgtagcgacccttgtagggcgactttcgcaaccggggggtgtggtacccctttctttggccctggctaacgtcccaaatattgcgcgaaggacttgtctttctcgggcaacgcgcattggttggggttcacaggaaggcccgcgtgctataggcccccgcgttggaaaggccttcgggtttggttatcgccattgcttgggcggtttgcgttgggcttatttagcggtatggcgttggggccattcttgggcgcattcttgggttggttcccc

SEQ ID NO: 669160 - DNA, 128 bp, Homo sapiens
tgtgtgtatataggatactatatatcctattcgttctgtcctctgagagaaccctaatacagattttggtcccaggagtggttctagaatattaaggatggagttatttccttggttttgagtctaat

SEQ ID NO: 669161 - DNA, 230 bp, Homo sapiens
catctcctcctcctgccagatgttagctaccccttccttgtacatatccctatgatggcatacttataccaagctccatctgcctctgacaaacagagctacaatctgctccttgcctactcttcaatcagccacatagccctcgtagtaacagccattctcatccaaagcccctgaagcttcaccggtgcagtcaatactcataatcgcccaggaggaggcggacttcg

SEQ ID NO: 669162 - DNA, 320 bp, Homo sapiens
  misc_feature (1)..(1): n is a, c, g, or t
  misc_feature (10)..(10): n is a, c, g, or t
naaaaagaanaaaaagggaggggcaaaccacaaaaaaaaccgtcctggagggaccgagaaaccttaccgagaacaaagttgctaagagataaagaccgccttctttctgcggctgccacacgaaccccagtgactcggacaagcagtccaaaatgactctcttatttaattgtggagcgggaaagagactacaggtagccactgagcatgactggatcccactttactcctcttcccctcgcatgatctttttttaccatggccctcccctggcgcctagcgccctctaacacccacaatcaaatgctgtatccgcctgc

SEQ ID NO: 669163 - DNA, 771 bp, Homo sapiens
  misc_feature (650)..(650): n is a, c, g, or t
aagggtgttgggcctgtaagtgcacagaaatcaagaattgaggtttgggaatctctgcccagatttcagaggatgcatggaactgcctggatgtccaggcaaaaatttgctgcaggggtggagccctcatggagacctctgttagggcagtgtggaagggaaatgaggggtgggagcctccacacagagtctccactggagcactgcctaatggagctgtgagaagagggccaccatcttccagaccccggaatggtagatccactgacagcttgcaccgagcacctggaaaagccacagacactcaatgctagcccatgaaagcagccaggagggcagctgtaccctgcaaagccacggggtggagctgcccaaggccatgggagcccaccttttgcatcagcatgacctggatttggagcatggagttaaaaaaatactattttggaactttgagatttaatgactgtcctattggatttcggacttgcatggggcctgcagccccttcattttggccaatttctcccatttggaagaggtctatttacccaatgcctgtacccccattatatctagaagtaactaacttgcttttgattttacaggctaatagacaaaagggacttgccttgtctcagatgagactntggacttgaacttttgagttaatgctgaaatgagttagacgtgggggactgttggagagtgtggtggtgtttgaaactgtggggacctgcagattgcgagaaaccagcggtggaatgatcg

SEQ ID NO: 669164 - DNA, 363 bp, Homo sapiens
tctcgcaccatgggtatctatgatctactgtcttcatccctccttgacgctatggcagcccactttacattcacccctccgcgcaacccgggccacaacacggttggagcgctgcaggccatgctgaagggcgacgccaaagtgcttatctgcctcggcggtaacttagcgccggcggcaccggacaccatgcgcaccgagaaggcgctaagcaatctcgacctgtcagtgcaaatcagcaccaagctgaaccgcagccacttaacgccgggccgcgaagccttgatcctgcctacccttggtcgtaccgagctggatatgcaggccacgggttcgcagtttattaccgttgaaggtcgacgc

SEQ ID NO: 669165 - DNA, 131 bp, Homo sapiens
atttagagtatcccccggccgccacagctttctctctggtcagtaatatattttaaatatatatgctttatatgtattgtctcagagactgtcaaagagtagtggtaccgcaggctcgaacttcgtaaatc

SEQ ID NO: 669166 - DNA, 161 bp, Homo sapiens
ggtgtgtggtgaagcttctgtgaaacgtggaagggtcttctgtgcgtgtgtctgatgaaaacaagagtacagcccatgactgggcagtgcgctccggacctcacagatttagatgtagatgtagataacccaaagaagaaaagaaagaagctgctggagga

SEQ ID NO: 669167 - DNA, 251 bp, Homo sapiens
atgttgctgggagtgtccatacttgggacgacataatttgtataatcgcacggttactggacggaggagaatctatgtgatccagtccatgtgcacaatgaaaatcagcatatcacccgggggaacattttagtccccaagtcttggggtaatgacggatggtaaaaaacactagctgtcaatttttttccagtaatgggcttcaggtgtttttttttttccaactcggatgagagggtagttccactcaa

SEQ ID NO: 669168 - DNA, 199 bp, Homo sapiens
cgtatttctcctggctgactcttgaggatccccattatggcagcgtaggccatcgcaaagacctgtacgccaacacagtgctgtcttggcttgcaacaccatgtaccctgtgcattgccgacagcgatgcagaatggagatcacttgccctgtgcacccatgcacaagtgaatgatcaatgatcatttgctcctacctg

SEQ ID NO: 669169 - DNA, 429 bp, Homo sapiens
ggggattatccggaatttaactagttaattggatccttcttttaggggcctgggaactttaactgatgcttttcctgattttagagcaaaggtgtggaaaggggaaatggaggaatgccttcctgtctgggccgttttttgggccacagttccagatgcaaaaggtttttttggatagaacacttttgaatgtaaatcatgataaaagggttatttggaaactaactcttaagttgggattaagggggaatttttacttttggactgcctaaatatcaagggctgaaactttggaattttgaatattcgtggggtttaatgttaaaaagcctgtggtttaggagggctattcagggttccttttcctgataaacactttgaatatttttttggggttttggtttccttttttgaagttgttcctccttt

SEQ ID NO: 669170 - DNA, 161 bp, Homo sapiens
gccccggcaggttccctcggggctctttgggctttggctcaccgcagcctcttgcgcggggtctgctccagcgagccacagcccaggggcggcgcttggagagggacacggcgcggggacatcgtccgacgacttctcaggctctgatctcttgccttggc

SEQ ID NO: 669171 - DNA, 141 bp, Homo sapiens
ccctggcggattgggtggtgcgcggtgccgcatttggtccaagttgtccgtggccgtgcaagtcatgaacgcgctgctcttgcccatcgtgctgggcttcttgtttttgctggcacgtcgcgcacttcgtggtccgcaccg

SEQ ID NO: 669172 - DNA, 549 bp, Homo sapiens
ctgtttcggacttcttcattaaaacagctacttccaaagcccaagtcattaacagtttcctgaaacacaaaatatacagttgactgtacattaaaaacaataacaaaaacaaaaaaacgttaaaagcctagtcttcttacattggttttctcttggtttttcaaacatctcaaacaataaaaaataaaaataaagaatgaaactatagaaattactgtcaaaattgttgtgtgccttttaagaaaaccccccaacgcagcatgataatagcaaagaggccgggcgtggtggcttacctgaggtcaggagttcaagaccagcctggccaacaacatggtgaaacaccatctctactaaaaatacaaaaattagctgggcatgatggctgggtgcctgtagtcccaactactttgggaggctggggcacgggaatcacttgaacccggaagcctgggtgacagagcgagaccctgcctcagaaaaataaataaaaattaaaaagtggggaaaaaaagtatgccttccctattggagtagacactacaccat

SEQ ID NO: 669173 - DNA, 245 bp, Homo sapiens
  misc_feature (59)..(59): n is a, c, g, or t
  misc_feature (114)..(114): n is a, c, g, or t
  misc_feature (129)..(129): n is a, c, g, or t
  misc_feature (183)..(183): n is a, c, g, or t
  misc_feature (186)..(186): n is a, c, g, or t
  misc_feature (225)..(225): n is a, c, g, or t
gtggggatgataacgtttcagcagagttatcagcaccgggtgggggaagggcgtttgtnacgttgccatgcccgatgcgcaagttatcgggcctacaaaggcaataaatgtctnatgcgacgctaacgngtcttatcagacctatagccgctgccagatgtgtgctggataaggtgttcacgncgnatctggcaataagacgcgatgatattatttacactccgncagcgttttaaatcgcctta

SEQ ID NO: 669174 - DNA, 110 bp, Homo sapiens
gtaaaatgtgaatgactttttttgtgaatgaaaatttaaaatctttgtaactttttaaatctgcttttgtttccccaaaaaaacctaaaatcctttttttaaaaaaaaaa

SEQ ID NO: 669175 - DNA, 436 bp, Homo sapiens
atcacgaaatgttcaatgaatatgagaatgaatcaagtctgaatcctgcctcatcctatatcaaaatatagctgtacggacgataacacgtcttcataaatagccaactatgagtaacatgtcaccttaagtctctcattatgcttgtgcttctacgcttacgtaaaagtaagttggtgatcacaaccgtaagtgagcttcctgttttgcagaacgtggaatcttgtagaaggaagatcagcattcataaaaaactataaaacaaaatgctcacatagtagaatggtccccaagaggagagcagtcatgtagtaatcatacagaatgaaatagacatctatcagcttgacactgcatccattagtggcaccatcacaaatgaaacgagaatttcctctgtaaaattactttcagagtctgtccttgcagtggctgg

SEQ ID NO: 669176 - DNA, 181 bp, Homo sapiens
catcgagctcggcccgaatcctaattacggaaacaagagtagaaaggtggttgtgagggctgaggggttggagggaaaggagcgctgttgatcaaaggacacagactcccagttacaagatgaatatgttctggggatcagattatagaatagtgagtgtagttaacaatgctatgcaggg

SEQ ID NO: 669177 - DNA, 255 bp, Homo sapiens
agtcgattcctagaggatcccccatcaaccacccgacgctgccgattgcgctgtttgtcgcccgccggccgggcaccgagagctacctgatcgacttgcgcgacggggcgctgctgcagaccatcacctcgaagaccaatcgacacttttatgggcacgcggtggtgcacaaggatggcgagtggttgtatgccacggaaaacgacacgtctgatccggggcgcggcttgcttggggtatatcggttcgagggtg

SEQ ID NO: 669178 - DNA, 954 bp, Homo sapiens
ccaagataacaattctgagagatgccatatagttaaaagctcctagattatgagcataaggatgctcctataataagttgatcatggattttgtgctataatataaagcgatataaaacattgctcgttggcttgctgatttgcacgaacacctttttagcatagagagcttctggagtgtacctagacatgaattggctagtactatgtagggattcagagcctatcgttatcgtattacgcctgctgccttgccgagacagggtctcactcggtcacccaggctggagtgcagtggtgagattgtagcttactgctgcctcaaactcgtggcctcaagcgattctcctgcctcatgcctgtaatcccagcattttgggaggccgaggcaggaggattgcttgagcccgggaggtcaaggctgcagtgagctgtgatcacactgctgcattctagcctgggtggcagggtgagactttgtctgaaaaaacaaagcaaaaaaacccaaattaatgggcaatgatagtatttagctatttttgttccatgaggaagtgattcacttattttttgaaacagtcttgcttctgttgcctaggctggagtacagtggtgcagtcctcggctcactgagctggctccggattcaatgcgattctcctgtcctccggcaccttgaagttagtggataacaggcgtgtcccactatggcctggcacaatctaagaaagagcggagataggcatgttagacaggtgccctgcgctacagaccggaataaactctgctagctcccaagtggatttatcggtgaccagtaccccggacttgattataagacaaatccaggggacagcaaacaaattaaccttaaaaaagaaatatataggaggatctaacatcacaaggagtcaacacatcaatcagacagacacatcaacaccacacgactaa

SEQ ID NO: 669179 - DNA, 160 bp, Homo sapiens
  misc_feature (71)..(71): n is a, c, g, or t
acggacctcccaaagtgttgggattagaggcgcgagcaccgcgcttcgcagactccagattgtttccactncctgagtggccttaagctccgcttggagtttggtgctttcactatttcttttctagcctctccgtgattaaagcggatgaatatgtttt

SEQ ID NO: 669180 - DNA, 400 bp, Homo sapiens
ctaattagcatggatgttaagtcatcatgtacggattcaacttcctacaacttagataacagtggtactccattacctaccacactcatctctcatgtgcgccacacacccacgcttcctcctgtctatctagaaattctgccaatagcatcactactctttcacctgtttcagtgattctcacatctcactgtgacactatagtcatctaacaaagatttattaacaaaaatgcacaggacttacactacgtcttttttataactggtgtggggtgggacacaggtatggaacttgtttttataacgtcccccaggtaattttaatgcacgccagcttgagcacctctgcccttattggttttccggttcaggtgattctaatgtctaccttactcctt

SEQ ID NO: 669181 - DNA, 708 bp, Homo sapiens
ccaccccgtctgggaagtgaggagcgtctctgcctgggcgcccattgtctgggatgtgaggagcccctctgcctggccgcccagtctgggaagtgaggagcgcctcttcccggccgccatcccatctaggaagtgaggagcatctctgccgggccgcccatcgtctgagatgtggggagcgcctctgccccgtcgccacgtctgggatgtgaggagcgcctctgcccagccgcgaccccgtctgggaggtgaggagcgtctctgcccggccgccccgtctgagaagtgaagagcccctccgcccggcagccgccaccgtctgggaagtgaggagcatctccggccggcagacgcccgtcaggagggaggtgggggggcagccaccacgccggacagccgaccatgtccgggaggtgaggggcaacataccggacggaagacacagactgggaagtgaggagcccgtctgaccggcagaccagcccgactgggaggtgaacccaacagcgtcatcgagaaccgggcatgcatgacgatggcggcacgtcgacctagaaaggggggaaatgtggggaaacgatagacgaaaatcagattggtagctgtgtctgagatagaagggaagtagaccaggggagagtccattgtgcctgtactaagacaaattcttctgcctgggatgctgatatctataacttaccccaagcc

SEQ ID NO: 669182 - DNA, 180 bp, Homo sapiens
aacgggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccgcatcacccgttcgggt

SEQ ID NO: 669183 - DNA, 1337 bp, Homo sapiens
  misc_feature (370)..(370): n is a, c, g, or t
  misc_feature (670)..(670): n is a, c, g, or t
  misc_feature (750)..(750): n is a, c, g, or t
  misc_feature (814)..(815): n is a, c, g, or t
gtcgtaatatcagttgtgatactaccccggcgtgtgaatgtgtgtgtctgtcttccctcccctcccctccaccagaggttgtttgtctccgcgcctctctgaccctgtggtgtgttgggtggggccgcccaccacacagcacagctcgtgcgggcgagcacagcatacatcggtgctgtggttctttcctgttagttaataatattattggggggctgtgtgggcgtccgctcgtgtggaatgaaggaggggcgcctttctttctgtcgcctcatcggtggacccccccgtcgtgtgtatcgcccagcccgacccccccccccgtcgttgttgttggtgttaataagagctgttaaataagtggttgttnttataacagccaccagtgcggtggcccccccccccgcctggttttttttgtgaggaggaggagcttccttcgtgaagattttctttctccgcaagatggtccccaccagcggttgtgaggagattttcctccctctcctccttcgaaggaggaaattcctcctctcgagtatatagcgcgccccgtcgttaaccacacgcggagatatgtagcagaggtataaagaggggcctcacagcgtctgtctgtgtgtctgtgggtatcgtgtagagatatttctctcaccacaccggcgctctngtagagaggtgagaccaccacacggccccacatcatagagagacatatggttataggcgctcgagagagatatagagagnggggagatcaccgccgtcgagaagagagagatagggggccccccagcgcgccgcgcacacaggnncccacacaacgcctctctcgctctcacacagtgtgagagatatgtctccgcgctgtgtgtgtccttctcacacacacgtgagagaccaccagagagtgtgagacgacctttacacacagggcacacagtgtgggcgtcacacacacttctccccttctctttcacgccactctcccccggctgatacccgcacactctgttctcgctctcgtagaaagagacctcgcccacgccacgcgtataggagcccccacagagagggcccccaccacatatgtagaaagcgcttgtagaattttcccctcacactcggctctctgcgcttttgtctcgagagagatctcgtataggagaaaggagatgcttccacccaacctcgagaggtaagagataaatgctatatgctcgtcgcttggtgaaacacactccacatgaaatttttatagtaaattgctctcccaagccaattgatatgtttgataaatttaagtttttaggtaaattaaaacctttttaaaattt

SEQ ID NO: 669184 - DNA, 165 bp, Homo sapiens
ctcagaaagcaatacatgtaatactatgctagaaatccctacatgccttcccattgtatctgcacaaaccagaccagcgtaatacttaaaggcttgtctaaacgcgtacttctctacccagtctccatgttcccgtggacctggagacaaggtacgacgccgacg

SEQ ID NO: 669185 - DNA, 1198 bp, Homo sapiens
gccgggcgcggtggctcgtgactgtaattccagcactttaggaggctgaggtgggagcatcacttgagcctaagagttcaagaccagctcgggcaatatattgagattcccccatctctaccaaaaaaaaaaaaaaaaaaaaaattaaggggggaaaaggggggtggcgtggggggccccggctcacttaaaaaggctggaggggggggcatccattgtggacccgggggagggccgaaaatgtggcgagtggacgccatttttggtgccccatgtggcgcgccccaacgccgtggggcacaccacagcgggagagcggagcaccattctcaaaaacaccgagaaggacacagagcaagcgaagagagaaaaacagggttttaccaatactgtggattccacagagaaagcgccctgggagaagaacattcacaacgcacagcctttattctcttgacattctacattacccagggtcaggataccttacacatctatatatgggcgccgtgagaattccacggtggtgctactttgttagagagaccctttatactctctacaagatatctttttccacaaatcccttatacacacccctttttggcgctgttaatagttcgcccacataaataagtgtgccacaaaagggtttttttgttataaccctaagcgggggcgccagggacacctgtaaccctaagggggagaacaccgtctccacaaaagctcacccccgggggggcgcccaatttttctcgcccgaagttataccaccgggtgggctagacaactcgtctctgcagcgcggggaacacttacacccttctcaaccaggcgcttgtacacccgctacagaacacattttccttcgttcaacacagcgggcggcggcccggggggctacaacacgggagtacggtacctaaaccccgccggtgggcgaaaatatcatacacacggcccaccttttggtggcgaacagccgccccaggaggacgcacagcggggtgggcaagccaacacctggaggggggccggcaccacagacagagctgctcaacaagtatccgcagccgtgcctgggtggcccaacccgtggtgtggtggtgaaaaaccccccggtgggctgctctctaacacgtaaacaacaatgttcacagaagaaatataaatcggggcgcggggacatagttgg

SEQ ID NO: 669186 - DNA, 245 bp, Homo sapiens
tgaccgcatatatttccataataaggtttatattcatattcatttactgagagacagtcttactgtggcacccaagccagagcgcagtgacaccatctcagctcactgcagcctgcgcctcccaggctcaaaggattctcctgcctcagccttctgagtagctgagactacaggggtgtaccaccacacccaagcaattctctggatttgtagtagagacggtctcacgaagctgtccgcgttgc

SEQ ID NO: 669187 - DNA, 818 bp, Homo sapiens
  misc_feature (31)..(31): n is a, c, g, or t
  misc_feature (78)..(78): n is a, c, g, or t
  misc_feature (85)..(86): n is a, c, g, or t
  misc_feature (90)..(90): n is a, c, g, or t
  misc_feature (92)..(92): n is a, c, g, or t
  misc_feature (126)..(127): n is a, c, g, or t
  misc_feature (129)..(129): n is a, c, g, or t
  misc_feature (132)..(132): n is a, c, g, or t
  misc_feature (135)..(135): n is a, c, g, or t
  misc_feature (138)..(141): n is a, c, g, or t
  misc_feature (145)..(145): n is a, c, g, or t
  misc_feature (172)..(172): n is a, c, g, or t
  misc_feature (221)..(221): n is a, c, g, or t
  misc_feature (227)..(228): n is a, c, g, or t
  misc_feature (247)..(247): n is a, c, g, or t
  misc_feature (252)..(252): n is a, c, g, or t
  misc_feature (257)..(257): n is a, c, g, or t
  misc_feature (262)..(262): n is a, c, g, or t
  misc_feature (267)..(267): n is a, c, g, or t
  misc_feature (269)..(269): n is a, c, g, or t
  misc_feature (276)..(276): n is a, c, g, or t
  misc_feature (282)..(282): n is a, c, g, or t
  misc_feature (288)..(288): n is a, c, g, or t
  misc_feature (291)..(291): n is a, c, g, or t
  misc_feature (293)..(293): n is a, c, g, or t
  misc_feature (310)..(310): n is a, c, g, or t
  misc_feature (393)..(393): n is a, c, g, or t
  misc_feature (411)..(411): n is a, c, g, or t
  misc_feature (425)..(425): n is a, c, g, or t
  misc_feature (460)..(460): n is a, c, g, or t
  misc_feature (497)..(497): n is a, c, g, or t
  misc_feature (514)..(514): n is a, c, g, or t
  misc_feature (520)..(520): n is a, c, g, or t
  misc_feature (555)..(555): n is a, c, g, or t
  misc_feature (564)..(564): n is a, c, g, or t
  misc_feature (567)..(567): n is a, c, g, or t
  misc_feature (667)..(669): n is a, c, g, or t
  misc_feature (676)..(676): n is a, c, g, or t
  misc_feature (684)..(684): n is a, c, g, or t
  misc_feature (689)..(689): n is a, c, g, or t
  misc_feature (694)..(694): n is a, c, g, or t
  misc_feature (697)..(697): n is a, c, g, or t
  misc_feature (700)..(701): n is a, c, g, or t
  misc_feature (703)..(705): n is a, c, g, or t
  misc_feature (724)..(724): n is a, c, g, or t
  misc_feature (727)..(727): n is a, c, g, or t
  misc_feature (809)..(809): n is a, c, g, or t
aaaaagagtctggccatcagcagaccagggnggggaggtgcactggggtggttctgccttgctgctggtactgataanttcttgnntcantncatctacaatgatctttccctctaaatcccaaanntnaangcnggnnnntgtngcagcacacagccagtagcggttaggnctgaagcacagggcgttgatgatgtccccaccatctagcgtgtaaaaangtttannttcattgaaatcccataanatggnctggncatcnttgcntncagaagnacaganggatcnatntngagatatatttaccgtntttagatatttttttttgttaattttgtttttttttagcttgcagttagctaggttttatactttgatcagcttgttccagcnacaggagatgatgatagnttttttgttttttnttgatatttggacacaagatatccacttttatttntttttattttggatattttatttttacacacccaggntattttatagttttatntttttnttttgagatctagatataatttgccggttgttatntgagaaggncanactcagcacatccttggtatggcccacaaatcgcctcgtggtggtgcccgttgtgagatcccagaggcgcagggttccatcccaggagcctgagagggcnnnctggccntctgaggngatanccacntcnctnncnnngtgggagtgaccccgccgngcncgctgtggaattccatagttggtctcatccctggtcagtttccacatgatgatggtcttatctcgagaggcggagaggatcntgtccggga

SEQ ID NO: 669188 - DNA, 641 bp, Homo sapiens
tttttttttggagatggagtcttactctgttgcccaggctggagtgcggtgggtagcgtgatctctgctcactgcaacctccgcctcccaggttcaagtgattctcctgcctcagcctaccaagtagctgggattacaggcatgcaccaccacacccagctaattttttgtatttttagtagagacggggtttcaccatgttggtcaggctggtctcgaactcctgacctcaggtgatctgccggccttggctcccaaggtgttgtgaacttatcgtagcctagaaaagaaggccaccctggagtcttccaaatggtacgataagtaaacgtggaaaagactattgcatgtatgaaagatggcttttgtaaaagtgttgcgttgtcgttggtttttctggactagggcaaatcttctggcatctggcagcagagctcagcactgtgtctgggctgtgactcgggagacacagctgggaggtgcctcctgatggggcacctgggagtaggggatgctccaggcgctcgtgccttctgagaacgcctctcctgggggcatcttccgagtccagtgccccagtctgagaaggcccagaatgggaatgaccagactgatagaggcgacagtcctcctctaccgag

SEQ ID NO: 669189 - DNA, 189 bp, Homo sapiens
cttattatccttctttattgggcttctggccacctgtggcctgaaagctactaatcatttttacactttttaacatattcaagaaaaaaatcaaatggggtaatgttgatcaaggtgtacaagttttagttcttcaggatgattgagctccagagactatatgcaaagcctgctaacgggtaccgagct

SEQ ID NO: 669190 - DNA, 290 bp, Homo sapiens
cccagaggttacaggctataccaccacacctggctaatttttgtattttttgtagagatggggtttcgccatgttggccaggctggtctcccaataccggggcccaagccgtctgcccaccttgtgctctcaaaatgctgggattacaggcatgagccactgtgcccagcctaaaagggttttctgtttctactctgtacctaagtcactgtactcctaggaatttatcctaagacactattggccactagcaagttatgagtttttgggggtggtatagggtggtatag

SEQ ID NO: 669191 - DNA, 1724 bp, Homo sapiens
cctgcttcaacagtgcttggacggaacccggacgctcgttcaccaccccggacggacgaccatagccagccctccgtcacctcttcaccgcaccactcggactgcacccaaggccaccacaacgacgcatccagcgccgagcagacaaccgacggacgcacgacgtcctcatccttagatcgccgccatgacgaccgaggtccaccttcgaaaggtgcgccaagaaagttacacaccagagacctcaagagtgccggaccatacaacccgccacgattcaaaccttggagctcttaacgcactcctacggttatacctttgtcccatggtcatttacctacactttttggacccggcagaaatagatcgatggagcatacaggacgaggcaacacttttggcaccaaaagtcactttacatcatccaaacccacatacgatcaattgaaggagacagatggcgcgacacatttggactggcacgcaaaacacatggaattgaaacggacattgacaagaccaaccacaaaccagacgtgttgccaccagcaaataccgtatcccccttatgcccagcggcaataattacaaaaggtaaacaacacgccaggcacaactggattgacattcgaaacgtggggcgcaaacaatgaagggcagatttagaacaattgacaaaaatatggcgaacgattggttggacacattgtacacctatttttaggagaacacaacacacaaacattggtttggaactataccaggttcacacacgttacaacatgaggaacacatatggacaacaaaataatacacttgggaaaccaagaagtgcaaccaaacaacgagaatgtggaacaaccccagcaatttgtcgtcggtggcattgaacacatatccaatattataggaggaaaacataaatattttttcacgccgttggacatagttggaaagcacaatgtagatggtcaacaatcgccccatatacaacagacggacaaactctggcacgtggctggaacacaccactgtgttgatacccctaaacatgttttgtcaaacaaacagagagttggaggagaaccaacacgcccacctggaaaaatttcattggtgagcattatgtggacgggcgaaacaatcatgtcatcactttgatgagaacacaggacaaaccaaaccaccattggggaaaagacaacagggtaaatataatggacacaagagcttaaacagcccatcctggaggcatgatacatttataccacccagtataataccgactgaggtagaatgaaacttaacccagtgtgaatacaccaagagacaatgagacttcacatgtataggagcgttacacatttacccagtaccatatacagtttgtgtcccacacaacaacatccacgattaagaaattcgttgcagaaggtgcacaccaacacctgatcagagaaaaaacaaatttggggacccaatcaataacacaagaagaacaacgaaatgagacaaagtaaaacaacacacacagcgccgcggcgcatagatacatccttagacgaacagcacagataacgtacacatcaatactatacatcgacacacatgaggtatagatcattaacgaacagagcggcattaaacaagctacgacagacacgatagtagatactgacacactctgtggtgtaagacaacccaagaaggatatattgtcattg

SEQ ID NO: 669192 - DNA, 1032 bp, Homo sapiens
tttttttttggagatggagtcttactctgttgcccaggctggagtgcggtgggtagcgtgatctctgctcactgcaacctccgcctcccaggttcaagtgattctcctgcctcagcctaccaagtagctgggattacaggcatgcaccaccacacccagctaattttttgtatttttagtagagacggggtttcaccatgttggtcaggctggtctcgaactcctgacctcaggtgatctgccggccttggctcccaaggtgttgtgaaccactgcacctggcctaggatatttttccagtggaataaaataaaggaaggcggaaacagtgtcaaatttaggtcagaaacagccaagctagccccaaagagaaacatctagataagactgagttgtatgttgcatggctacattgtatgttgcatggctacaggtcacagcatgcttcaggaacccccgggtccaagtaaattaggaacaagtgggctgctcttcaggggctgggggtcacagagcatgcaagccagaaagatctggcttctagtgggcggggtgcagcccctaattcgcatgctgtcatagaaaagcagggtcagttggggtattgtcctgagaaaggaatatgctcatgaggagagagactgctttgagaaaaagtggcagaatggtaacctagaaaagaaggccaccctgagtcttccaaatggtacgataagtaaacgtggaaaagactattgcatgtatgaaagatggcttttgtaaaagtgttgcgttgtcgttggtttttctggactagggcaaatcttctggcatctggcagcagagctcagcactgtgtctgggctgtgactcgggagacacagctgggaggtgcctcctgatggggcacctgggagtaggggatgctccaggcgctcgtgccttctgagaacgcctctcctgggggcatcttccgagtccagtgccccagtctgagaaggcccagaatgggaatgaccagactgatagaggcgacagtcctcctctaccgag

SEQ ID NO: 669193 - DNA, 429 bp, Homo sapiens
agatcggtggtcccgatcacttcgactagtgcgctcgcctcccgcggattctccacaacctggtcgaattctgttgcggtgcggcagatccatccgtaaactagcacatatgttcggacatgtggggatcggggctggcggtgcgaaggtccacgatgcctctgtgcccgacgccatcatccatttcgcgcgagtggaggcggaatcggccttgggtcgattcgcggcgatcgcggatttggtggcgttgcgggatgatgatcagggtgatcggcagtggtgggcgtgtgatgggtgggatgccgcggtcgctgaagtcggggccgcgctgggcatcgggcgcagggaagcctccgggcaacagtctgtcgcggtcgcattgcgagaccggtagccgagggtgtccgcggtgttcggcgacggcaaaga

SEQ ID NO: 669194 - DNA, 711 bp, Homo sapiens
tggggctctaaagggggtaaagggggtgctatagggtaaatacgggccctatttaccaaaaattttaaggggaattaattctagtgacgatgggcatgaaacgggggttgtgctccacatgatttcaagatgcatttgtgaccctgtagtatacccccgggtcgttgtacgcggtgtagaaacgtgtggtttgggttaaaaacgtcctgggaatggcatctggttttataagcgcctaatggtggtgggacagctcactgagttgcaagacgtctgtggtgattgtacttatttatcaccgaatgggggggctatcaactccgggagtcacataccctcagaatgtgtcaaacgagctcacagggaggctccgcatgggtcagcattgggggatcataagagaactaaacggggggcggacaggtacttgtaagcgacgttgagacaagactcacgcctcggccaggaaccaccgggtgtaacccccgggaacggctcacaaagcacacccattggggggggccacaacattggcaatcttgcgagagggtaaaaagagggaaggcgactcagtgcgaacccatacgacctgcggcagattgatcaacagcgaaatcacatacgaggcatgtgcacgggcgagaatgaacgggcaccaacgaaatcgaacgcgccggcgcaagcgaatagacacaaaacgcgcccctaata

SEQ ID NO: 669195 - DNA, 620 bp, Homo sapiens
  misc_feature (262)..(262): n is a, c, g, or t
  misc_feature (545)..(545): n is a, c, g, or t
aaacttagggagtgggggggccagggaaaataagtggaagtggttctgaaataagccccaggtgattttcagtaatgaaagggaacagagatcattttcttataaggctcagcctcagagagaacaatttgggaggcaagaaattaataatttagtaacaaagtgaagctccatgggtgaatactttatgatgtaaaatcaagggtggatcggagggtgagcaaggggtgctcagatggggcaggtatagacagagagaagngagggcactaagcatccatacccagctctacctcggagagcagggaagactagaggccaggagacgacaggcaaccggagaagacggctctgcagccagagaagggcctgaggacggtgggaccgagagccggaggcagcactttagggctggtagctcttccggcgggaggaggaggggggggtgtactggaggggggaatggcgcctccaacagagctgagggcacccccaatggctctgccatgttggaatggaagcacctccaagtgcaagaccattgncataggagtagctgttcctccaccaaggctaagccatggcgaacgcatggcaccgcatagcactggcgatgtggc

SEQ ID NO: 669196 - DNA, 169 bp, Homo sapiens
taatccaaaaggtatttataaaaaacccattaaaaccctactacttcatgaccctgccccccgggctctttaaccccaaaacttgccctacaaaccgggggaaaggggcataaaccccaattgagtcctaaacctctaccatttaaaaaataaaacaatgaacgcaatt

SEQ ID NO: 669197 - DNA, 497 bp, Homo sapiens
cgaggatcccgccagtagagatgatgacgctaaaatcaacaatacattctcacagaaatattcgagagcagcaaatacttacataatttcgtgagaactttgagacatcatttacagtaatggagcttgtaaacattatctacaagaatactcctgagaaattacatgaaatggctaaacataatctcttacttcatttgaaaaaactagaaaaaagaaggaaaaatatttagcaacacagatcctgacaagaaatggaaagctcatctttagtttcagattacagaaagctttgttttatatttgctttcagagaaatggtatgttttcttaactataggttattttatagagaatataacagtataaaacattaaaaataaccctagatatactttaaaataaatgttatatttatgctaaaatatgtaaattacactatacaaccatatgataggttatatctctaaccttgtcttctaacgttttaccacaaa

SEQ ID NO: 669198 - DNA, 144 bp, Homo sapiens
ctcgatcgcggagaaagatctgccgctgtcgtctttgcttcagccgcagtctgtcgactggctgactgctgtggtcttacagcctgttccaagtgtggcttaatccgtctccaccaccagatctttctccgcgatcgaagtgtg

SEQ ID NO: 669199 - DNA, 447 bp, Homo sapiens
  misc_feature (89)..(89): n is a, c, g, or t
  misc_feature (372)..(372): n is a, c, g, or t
cacttaccatatacggatcactgcccgtcatttcgccgtcttgacttgaaaaaccttgcgagatggggcaggtatagacagagagaagngagggcactaagcatccatacccagctctacctcggagagcagggaagactagaggccaggagacgacaggcaaccggagaagacggctctgcagccagagaagggcctgaggacggtgggaccgagagccggaggcagcactttagggctggtagctcttccggcgggaggaggaggggggggtgtactggaggggggaatggcgcctccaacagagctgagggcacccccaatggctctgccatgttggaatggaagcacctccaagtgcaagaccattgncataggagtagctgttcctccaccaaggctaagccatggcgaacgcatggcaccgcatagcactggcgatgtggc

SEQ ID NO: 669200 - DNA, 315 bp, Homo sapiens
ggggcccctaaagggttttttccaaaataaaaaaaaaaattttggggagggttccctcataaaaaaatttgggggattttttccccaaaaaaattttggggcccacccccggtgttgtttaatggccccggtaaaacccccccccttttggcccctcccgttttagggccaaaacaaaatttttttggggaaaccccctccccttttgggaagaaacgccgggtttatttgctggaaccaaaaaaccaaaaaaaagggggctcccgggccccccaagggaaaaggggtttagggataattttccccccggggttc

SEQ ID NO: 669201 - DNA, 595 bp, Homo sapiens
  misc_feature (135)..(135): n is a, c, g, or t
  misc_feature (156)..(156): n is a, c, g, or t
  misc_feature (177)..(178): n is a, c, g, or t
  misc_feature (202)..(204): n is a, c, g, or t
  misc_feature (228)..(228): n is a, c, g, or t
  misc_feature (250)..(250): n is a, c, g, or t
  misc_feature (439)..(439): n is a, c, g, or t
  misc_feature (446)..(446): n is a, c, g, or t
  misc_feature (568)..(568): n is a, c, g, or t
  misc_feature (586)..(586): n is a, c, g, or t
  misc_feature (593)..(593): n is a, c, g, or t
cggtgaggtcagcttcacattctcaggaactctccttctttgggccacggaattaacccgagcaggcatggaggcctctgctctcacctcatcagcagtgaccagtgtggccaaagtggtcagggtggcctctgntctgcgtagttttgcccctgncaggattgctacagttgtgannggaggagttgtggccatggcgggnnntgccatggtgctcagtgccatggnttcactgcggcgggaatcgctncgtcctccatagcagccaagatgatgtccgcggcgccattgcaatgggggtggagttgcctcgggagccttgtggctaactctgcagtcactggggagcaactggactctccggattgaccaagttcatcctgggctccattgggtctgccattgcggctgtcattgcgaggttctactagctccctgnccctcgncctgcagagaagagaaccatgccaggggagaaggcaccagcatcctgacccagcgaggagccaactatccaaaaatactggggtgaaatataccaaattctgatctccagaggaaattaggnattaagatgaattgttgnaactctnaa

SEQ ID NO: 669202 - DNA, 622 bp, Homo sapiens
gagtggtggagtggcgtagacgagtaagtcctggtctgcgtgaaggtcgacgactccgtccgcagatacggacctgtctgggtctcagccgccaaagaccccgtccgaagtactagccggacatcatgagtgctgtcgggtatccatcgggagactaatccagcgccaggagagggaggtgaaagattcttcaggggatatggagggataagagatatggatctgaaaagaggctgggtttggtggaatgtgaggatccaggggttgcagatgatgctgtgtatgagcttgatggaaaagaactctgtagtgaaagggttcactatggaacatgctagggtcggtcacgagggggaaagaggtagaggaggatactcttgaccggtttaagtagtcggcagacctcgaaattgattagaggaaaattgttccacctgtaggaacagaaaaatcgtctaatagtggagaattaatcctcaagaagtcagtgcaggatctcaaagatttcatgagacacgctggggagagtaacgtgggggatgaaaccggcctaaataaatgaggggggtgagtttgccctaatggggttaaagatggtttgaaaactttctggacggatagg

SEQ ID NO: 669203 - DNA, 569 bp, Homo sapiens
  misc_feature (22)..(22): n is a, c, g, or t
  misc_feature (92)..(92): n is a, c, g, or t
  misc_feature (116)..(116): n is a, c, g, or t
accagcgggccgtagatcgcanagtaaggccggcaagcaaggcgccccgcatcccccgcgctccgggttgggtccatctggcccatcgtggnatgccccacggttcggtacccacnaaggtgcgcgccggcccagggttcaacctggaggagctcagggtggccggcattcacaaaaaagtggcccggaccattggcatttctgtggatccgaggaggcggaacaagtccccggagtccctgcaggccaacgtgcagcgggtaaaggagtaccgctccaaaatcatcctcttccccaggaagccctcggccccccaagaagggagacagttttgttgaaaaactgaaactggccccccagctggccgggccggtcatgcccgtccggaacgtttataaaaaggagaaagctcgagtcttccctgaggaaaagaagaatttcaaagccttcgctagtctccgtatgggccgggccaacgcccggctttttggcatacgggcaaaaaaagccaaggaacccccaaaacagggtgttgaaaaaaaaaaataaagccctcctggggccttgga

SEQ ID NO: 669204 - DNA, 110 bp, Homo sapiens
tcgactaaaatcctgtgtccggttgtacactgaagtgattacaagatttgttttgaggtttatgacctgtttattttcactgatactcttgagtatgtcattttataaat

SEQ ID NO: 669205 - DNA, 558 bp, Homo sapiens
  misc_feature (515)..(515): n is a, c, g, or t
  misc_feature (522)..(522): n is a, c, g, or t
  misc_feature (526)..(526): n is a, c, g, or t
gggtgcttccggtctttctgcctgccagtgcggccttcttgactcagacggtctgctccattgcggtcacttcctaggactcagacggtcctgctccccctgtgtcacttgctaggactcagacggtcctgctcccactgcggtcacttcctaggactcagacggtcctgctcccactgcggtcacttcctaggactcagacggtcctgctcccactgcggtcacttcctaggactcagacggtcctgctcccactgcggtcacttcctaggactcagacggtcctgctcccactgcggtcacttcctaggactcagacggtcctgctcccagtgcggtcacttcctaggactcagacggtcctgctcccactgcggtcacttcctaggactcagacggtcctgctcccactgcggtcacttcctaggactcagacggtcctgctcccactgcggtcacttcctaggactcagacggtcctgctcccactgcggtcacttcctagactcagacgntcctgcncccnctgtgtcaacttgctagactcgtcaagtccgt

SEQ ID NO: 669206 - DNA, 218 bp, Homo sapiens
ctgagatggtgccactgcactccagcctgggcaacaaagcgagactctgtctcaaaaaaaaaaaatttgtgaaggcttctctgatttttttttcccaacagttgtcctgaatcttaagcttgcccagtatttttaaataccttctaataatggtcgtaaaaccataaattcactgatcttacccatatttaggtgtacaatagtgtcaatatcaaact

SEQ ID NO: 669207 - DNA, 116 bp, Homo sapiens
tgacgggccatttgttgatggtattcttactaaagatgtgagggggaaatactgttttctcaataacctcaagtttgcagtctgtcatctcccgcgtagaggaagaggggggccga

SEQ ID NO: 669208 - DNA, 108 bp, Homo sapiens
aaaaaaaaaaaggaattaactaattggtagataaaataacacaattactggagtactaaaaaaattggcaattgggggatcagaaggaattggccattttacaaccat

SEQ ID NO: 669209 - DNA, 107 bp, Homo sapiens
gaggtgactctacagacttccggagccttacctttgcccagtacttacactaataaatacaacataaacgtcctagtgtgatgcatgagagcactaatggtgtggta

SEQ ID NO: 669210 - DNA, 812 bp, Homo sapiens
  misc_feature (777)..(777): n is a, c, g, or t
aggaaatttccaagaaagcaaaggtttccctttgcacaattttggcgttttttaagggcaatttttcaattcctaatgtcccgtttctccaaccctagatgctttaaaacaaaaaataatactataaaataaacctcccctttttatcatggcttaccttccctcctatggtgcctctgacccaaaattgcttctcttctgttctagtatattcgtcacaatacccattccttcagtttcagtgatctcatccatattttgaaagaaagcaaagtgacttaattatgttcaagtatgaatggttggttggttgagtcaacctgaaatactggcatatggaaagttgtaacccctttacctaaatgagtattttaatttaactattttagacaagcatgactaagtaaaaagaacttcaggctaagcaagaaaaaaaatgtgtggacaggaagagaagtgataccacctagggtatattgtaacttactgcaaaattcagacctggggctatggtgctgctgcctctcaccctctcttcatgccgacgggagattctgtgagtaaacatagcatgctttccatttagacaggactttgaaagtgctctaggaaatcccgctcagtgctctagggaagacactaccatttgtttcaagttgatccatcttcatggaaacttatttcccatttctggttttaaaaccttagggctttttacccacttttattaacacttgttcttatttggatgggatgttgttggcttttaaaaaaaantttaacttgttccctgccactttaggatggggaaa

SEQ ID NO: 669211 - DNA, 396 bp, Homo sapiens
ggcccccccttttggtgggtttttttcaacccctttcccaaagggttttttgggttttccaagttccccaattttcccccgaaatttcgggggggaaatgggattttttcccaaaacccccccccccccttttttttttttttggggggaccgttttccaaattttttttttcatttgcccctttaatttttttttaaaaaggttttttttttttccccattctttttaaccccccccgggggaaggggggtttttttttggccccctttggtttttttttttgggggggcccgttttaatttttttttttttaaaacccccctttttttttgggacccctttgccccaaattttttcccggatttttgggcccctttaaaaaatttttttgggga

SEQ ID NO: 669212 - DNA, 103 bp, Homo sapiens
cacaaaggtgcaggcattgtggggtcagggactgcttatttgtcacctggatcacaacagatgggactgtctgctcagagctggtggtgacaggatccttacc

SEQ ID NO: 669213 - DNA, 123 bp, Homo sapiens
gctaggctgacctagaggaccccacactgggtcgagtcttgactgtcagctcttccctcccatgaaagaatcttctcttctgatatgataatactgtgctttcccattctctttccctactag

SEQ ID NO: 669214 - DNA, 1372 bp, Homo sapiens
  misc_feature (9)..(9): n is a, c, g, or t
  misc_feature (78)..(79): n is a, c, g, or t
  misc_feature (81)..(82): n is a, c, g, or t
  misc_feature (1256)..(1256): n is a, c, g, or t
  misc_feature (1280)..(1280): n is a, c, g, or t
cagagcaangatattcggcacgaggcatggcccatatgagtcaactcacagcttgcgaggagtgggccttctcctggnntnntcttgctcataaacaggtcacttcctccatgaagagaccagtttccacgctcccatctctcactgctgactcagcgatgcctctgcctcggtctgcttttgaagactgtgaccttcaccaggaggttttacttacaccagtcgggaagattagtccctcattctgcctggagtgccccgtgtttgacttggcagcgggtgtggagccatccccgcgtcctcctggcacattgccactgtggctgtccaggaacaggatgtggctgccttggccgaatgttgtcctactctccccaaccccggcgcctcagctcctcagctcctcgggcccctgcgtctggctggtgtttgcagggctttcgctctgctctggtattgctctgcctttatagaaagtcttattgaagaagtgtaagaaagacctaaggtggggaagactcctacacacaccattagtatcagtgacaccagcaatgtaggttcccagccccttcccagtggcagcttgtgtgtccaggagataggacatcatttaacgcatcagcaaagtagcagcagatgccacatacagagtagagcgaaggcatttggtggatcggtcactagagatctatcttgcagaaagtatgtttttcctcataaaagtgcctcttaattggccattgtaccagccacttgtcctagccaaatgtccaaaacacgcccttgggccccgccacgttacaatccacagattgtctgtctgagtcgtttaaggcatttcctggtgcttgtgttccatgaataaaaggacaaagtcagaagatcactgatgtcttactgtcaacagagatattttaaaagagagaagcaggaaaagatcttccttttttgatctacaacttatatagttttctgattatgcacataatagatatgccttccagatgcataaggcaaacatctggaaagaaatatacccaaatcttagcaggggttatctttgggagtggagtacatgggattttgctttcttcatttttataattttatattactgtcttggaagatgtgtttatgtgtgtgtgttacttttacaatcaggaaaacatatttaataacatatagtcaagaaaacagacttaaaaataaatactatgtgtccattgagaaaattcacaatataaacagaaatncaaataaatacatacacaattttnaagtcacctgtagccctacccttagaggtaccccagggtaacattttggtgggatggtcttatcaatttttcccgtggaacatttagcaaat

SEQ ID NO: 669215 - DNA, 453 bp, Homo sapiens
gaccgaaactcgcgcggcgtggcgcactgcggctggtttcccggcatacctggacttgctttgcgggcaccctgccagcgtcgaggccttttccaagcgcttgttcctggcgggactgccgcgtaatcaatagctggcggatgtgtttctatcccgccctttcactttatgaaaagcctgctcaagtcggtatcggagtttatcgccgggtgctgatgacgccatcgcaggcaagccagctcccagagtagaccgagttgtctgactattgtgggagctggcttgcctgcgatgaggcgctgaaactcaacagagtggcctgcactgaaatgcaaaaagccccgccattcacagggcggggcttttgtttttcagcctgtcactcagacctgcgggtcgcccacatgcaggatcttcatgccataggtgccaccggtggtgtggtagctgtcg

SEQ ID NO: 669216 - DNA, 249 bp, Homo sapiens
tgcatgcccctgtgccaatgacatccatccagattgcatggccatctgcagattgggccaccatgtagtacagccggtcatgggtctttacgcagaaagtgagggctgggttcgggctcttggctgcactgcgcaggtagtcgtagtacacttcctcaatggcctggaaatagataactcccttcaacttcgtctcatgcttgtccacataataggaaagggtgcgctcgactgcttggattacaagga

SEQ ID NO: 669217 - DNA, 201 bp, Homo sapiens
gtctggccccttttctgtttctgtgtatcctattgctggtgactctgtgtgaactgggcctctgggaaagatcagagagggcagagtcgcacaggacataaaggaggtgctgttctggccttcagctggacaaggcttttgctgacttccaggcgggggctttgcatacgcaagatgacggctttcactgcccaagcctct

SEQ ID NO: 669218 - DNA, 749 bp, Homo sapiens
gagtctcgccctgtcaccagactggagtgcagtggtgcgatctcggctcactataagctctgcctcccggattcaagcgattctcctgcctcagcctactgagtagctgggactacaggcacgtgccaccacgcccagctaattttgtatttttagtagagacagggtttcaccatgtggccaggatggtctcgatctcttgaccttgtgatctgcccgcctcggctcccaaactgctgggattacaggcatgagccactgtgcctggctgagtacagtatatctgaatccaccaaagcgatttgctttagtggttgcatgacaatatttaaagatcaatatcccattctttttagtaaggtgtttattgttctgacaaaatatttaaaggagaaaaaacgttaagacaggtaaagagtagtgtaacatcttttttttctgaatacgaatatttaaagactaaatatgagttacatgtgagcttgtacttttggtaattttcagggatgggctgagcatataagctcccttcagttaatgaattccccattactgggatatagagtgtgattaaagtagtattttatggaatataagtctctgaaatgggtttggttggtttgtaatcctacacaaagattctttagcctctttatgcctcaggtggcctattggtaaaatttttattaccccctttggatgtggaaggttaagggggagactgggtaaaggctgaaaaagccgggtta

SEQ ID NO: 669219 - DNA, 935 bp, Homo sapiens
tcctttggtgtgattccgtcctgcgcgggtgttctctgtagcactctacttttatctctcgtacgcctcctctcctacctaactgcgtgccgcttaccctgatggaagattcgatggcactatggacatgagccccctgaggccccgagaactatcgtttgtcggtgtgtgagactaaaggccgagaaagattatcactttgcggtgggtactgatgaaaatgagcaccaggttatcttccaagaacggtcagatttaggggctgtgcaccgcgatgcagtggcacatcgttgaagcagaggcaatgagtcacgatggccgtccaattaactgtaacactgtggaacttttgacaaatgtctcgttacaatgccaactgccttaacccttggggggcttttgaggataaacaccaccaagtgcctcttcacaggtgtgaagtgtggtttcatgggccaggtgccatattactgcgacagcacttcacgttagcctgctggaggatagcatgccagacgtcggaagagggaagcaggcaggaggaatgtgaaacctctttcccgttattctggaaagccggacagcccctggaggtggtcatgcatcggttcccatcagaagagagtcaccagtgtgctgctttgaatcatggtgacggtgtctggtgtcgcgggctcacgcacgaacgaggctggttgctcgagcaccttgctgatgaggcacgtgcaaaaaagggtcgaggaagcaaacggtccgcgatatttctgcgggtgcccacccgttcttggatggggaccttcccacactccagcggggggaatctcaagagaaagagtcttacacctgccggtttccactttaggatcgctaagaagaggggccgagaaactaaatgccccgaccactccatccgggggaatacctctccgaacaag

SEQ ID NO: 669220 - DNA, 422 bp, Homo sapiens
  misc_feature (78)..(78): n is a, c, g, or t
  misc_feature (112)..(112): n is a, c, g, or t
ttaaatctgtttcaggcaccaaaagaggactgagcaggtgaactctgagttcaacaattgtaaattttggaaattatnacaagggaatcttccctctgttctttgataaccnacttgcttactcaatgcctttaagccaagtccccctgttgcctatgggaggaggtggaaggatttggcaagctcacccccatgttatttagttagcatcagttgtccccaccagtctttttgcaaagggcaggagagctttgggggaaaggaaaaggcttcccaggctgttatggtcaccttttcagaaattttcagaccaatttaaaagcgccaaaattcgctatgtttccagtgatccttttaaaaaaatgaatgtgattttgctctgtctttttaagtatgatcaaataaaaaatttgtccctccca

SEQ ID NO: 669221 - DNA, 319 bp, Homo sapiens
atcatattattcaaaaaagcaagaggagaattacaagatttaatcaccaaaacattcatgattttattcctattaagacttgtcaaaatataataaaccaaaaccttggccagattacaaggtcaggagttcgagaccagtctggccaaaatggtgaacacccatctccaccaaaaaatacaaaaattagccaggcatggtggtgtgcgcctgtaatcccagctactcaggaggctgaggcaggagaattgcttgaaccctggagatggagattgcagtgagccgagattgtatgccactgcacaccagcccggaccgg

SEQ ID NO: 669222 - DNA, 668 bp, Homo sapiens
gtgaaacttgtgtggacgacgctgaccagtcgtgttggaatcaaaacagtggggaaccctgcgccatgtcgctgactgatcgtgaagaatctcccgaatgggatgaaggaggagcgtttcagtgcagctgtttgccgcttcggcacgctgacagactgcagcctgatgttcaccaaagatggcaagttccgcaagtaatggttttattggcttcaagtccgaggaagagtgcccagaaggcacagaagcatttcagcaagagcttcatcagacacatccctgtgatcacagtggagttctagcaagtcattcggggacccggccaaacccagagcctggagcaaatgtgcccagaaaccaatgccatggccaatgcaggctccaaaagactctactactccatgaaattaggaaagatgagacgaagaaaaaggtgggcagtgtcaactgggagaagcttgaaggaggatacagagttccaggagtttcttgtcagttcatcaagattgctgtgtgctgcatggcatgccacttttgtgtccgaagttgattggcctggaatgctgagccctcgaaagggaatgaggcaaagcctggccatgtgactaccctgaacgttcgactcccgattctgggcaggagagtgaggaggagggacgcctggggag

SEQ ID NO: 669223 - DNA, 847 bp, Homo sapiens
ataacacctagtttgagtcaacctggttaagtacaaatatgagaaggcttctcattcaggtccatgcttgcctactcctctgtccactgctttcgtgaagacaagatgaagttcacaattgtctttgctggacttcttggagtctttctagctcctgccctagctaactataatatcaacgtcaatgatgacaacaacaatgctggaagtgggcagcagtcagtgagtgtcaacaatgaacacaatgtggccaatgttgacaataacaacggatgggactcctggaattccatctgggattatggaaatggctttgctgcaaccagactctttcaaaagaagacatgcattgtgcacaaaatgaacaaggaagtcatgccctccattcaatcccttgatgcactggtcaaggaaaagaagcttcagggtaagggaccaggaggaccacctcccaagggcctgatgtactcagtcaacccaaacaaagtcgatgacctgagcaagttcggaaaaaacattgcaaacatgtgtcgtgggattccaacatacatggctgaggagatgcaagaggcaagcctgtttttttactcaggaacgtgctacacgaccagtgtactatggattgtggacatttccttctgtggagacacggtggagaactaaacaattttttaaagccactatggatttagtcatctgaatatgctgtgcagaaaaaatatgggctccagtggtttttaccatgtcattctgaaatttttctctactagttatgtttgatttctttaagtttcaataaaatcatttagcattgaaacaagacaccaacaaacgcaacacgagcggg

SEQ ID NO: 669224 - DNA, 515 bp, Homo sapiens
cattccctttttacagtagctttcaggaagtcgctgagaaatggggtggagtagggaactgtaatggtcactgaagcacgtgagagaccctcgtcaagatgatgtgaaaggaccagtttcttgaagtccagtgcttccacggctggataccttgtgtgaaattgttataccgccaatcaccaagggggttaagggcatggtatcccagcgacttctagagagctaagagtatacagatgagggtgtccgctgctgctttccttcggaatccagtgctatccacagagattaggctgtagcttatatttgacattcttcactgtctgttgtatacctaccgtagcttattacctttcacttccccttccaactatgtccagatgtgcaggctcctcctctctggactttctccaaaggcactgaccctcggactctactttgtcccctcaactccaccccctcctgtgaccgggcttgtgacattcactcagagaagaccacacaagaggcggcgc

SEQ ID NO: 669225 - DNA, 764 bp, Homo sapiens
gcgtggcgtcatgaccaaggacgctggaccccgcgtcttccgcccccgcgtggaaggtgatcctgacggttctttgtggtgtgctgccatcctctggctgctctgctcccaccgcctggccccaaaaagcccacaccaaacaatagaaaaacaaaaagacatcacaccaagacactccaaccaaacaagaatacacataacatcctaccccacatatatcccaccacaaaacgacaaccagcacatgcaaatactcctactcaacctcaaccaccatatcaacaacaccatgaaaaacaaccacatacaacgacacacaaaaacacacacacacatggcaaaacaacgaataaacatgcacaaaaagagagcctcaaaccttagaaccacacatgatacagcaaaaaaagagaatgagaccaaaagcatgcgcccagctgaccaacaccagggcaacacacacacgacaccaacccagagcacccaaggcacaaatcccacgcaagacatcagaagcccgacaaccacccacgagctagcacgcaatcagcactagcaacacactcacatccaccgtcaacacataagaaatcaggccaccaaccacgccccggcgacccaccaactccctacaccaccggccagagcaaatacaacaagaaaaccgcaccgaacgaactagcccaataaccccacgcaaatacgcacaacgaccacccacacaccacacagaagccccacacgggcaagcacaccacgcaacc

SEQ ID NO: 669226 - DNA, 649 bp, Homo sapiens
agcgggggcggagcttgcagtcgagccgagatcgcaccattgtccactccagactgggcgacagagtgagactccgtctcaaaaaaaaaaaaaaacgaatttatgatctcatcagcgcacataaatgcctgtttccctcacaccctcgcaaacattgggttactgtaaaactgcaaaattggccaatctgatagctgaaaagtggtgctctctgggcgggcagatgtgatagtcatttggtggctgatttgggaggaatacatacacattggtaagaaattcaaacagtacacaatgtgtggggtatttaggatgttcccagggttatgatgagcattcacgcaacaaacttctttacattagttgcacaagttattagctgaaaaattcttagtggttattagactttcttacattaaacatttttggttgtgaaaaataacaaacacagatggcttttttttaatgtagtaagaaggctgctttcttcccactttcttgtcccacatttttaccccagaggggcccaacttttgtttttgtttttgtggacaaggtggagtcttgtgcctcgtgtcccccggtgtttggatggtgcaatgtgccagaaagtcgtgggcctccctgtgcaaagccttccgccttccgg

SEQ ID NO: 669227 - DNA, 386 bp, Homo sapiens
  misc_feature (4)..(4): n is a, c, g, or t
  misc_feature (8)..(8): n is a, c, g, or t
  misc_feature (68)..(68): n is a, c, g, or t
  misc_feature (82)..(83): n is a, c, g, or t
  misc_feature (246)..(246): n is a, c, g, or t
  misc_feature (367)..(367): n is a, c, g, or t
  misc_feature (373)..(373): n is a, c, g, or t
ctgntatngggaatctccaggatcccccgcaaatttccttccactcgttccgggtgggcgagtcgtcngtcacgctgagccnnttcgatgacggctaccgggctatcctcaccggtcctgccgtgatcctggccgctggcaaggtgaatctgccgaatggatgagagggccgaacacgctcttgtcaacctgtcaggaaccgtcctcctacacttagcgcgatggcattggggccgtgaggatggntaccgggtgagcgagatcgaacaaatcgataacgagcgcgaagacgcgctgaagaacaacaacggttttagcgaggatcagagtgactacgacggtgaccaatttgatctggatgcacgcntatcgntgacacgcgtggg

SEQ ID NO: 669228 - DNA, 211 bp, Homo sapiens
agtgcatgttttgatacatggtgatgtctcagtgatcaaatcaggatcatgagcatatcatcatctgcaagcgtctgttatgtgtgtcgggaatgttcactatcctccttcttgctgcttgacactatatgatatgtggtcaggagttcgtgtttccgtcgtcatttgtaaccgttaacattagggatcttgtgttggtggggtgtgggtg

SEQ ID NO: 669229 - DNA, 322 bp, Homo sapiens
ctctagaggatccgtgggtctgagaatcagtactgtcacaggaaatactggcttccggagactagtacatcaatgtgcgaaactggtccgtgtcctagcagcacttggctattcctaatcagttgtcaagactatcttgatccaaggacatttgactcccctacctctttatgtctgcccagtggtatcgggcagtatgactatgatgagtatgctgtgagagggtatcctgtggccgatctacttgtcattgcagacaaatatgatcctttcactacgacaaataccgactgcctctgtaaggaacccaggcggctgccgc

SEQ ID NO: 669230 - DNA, 1229 bp, Homo sapiens
tggactcgcacgacgccgccgccatattcccggtaacgggggcgcgcggtcggggagcaggttgggccgagaagaggggtcctgggccggcactgaggcgggaaggggtggcatcttccttagcttgtccatcctccggactcgcgatcttcctatccggagccatgtcagaaggagtggagcttgatcgatatatagtgctgacctgaggagtatcacacaggagcccagagttcaacaatacagatcagattgacctgtatgatgatgtgctgacagccacctcacagccctcagatgacagaagcagcaggactgaacgcacctcctcctgttcgccaggagccatctacccaatgcccaacaacaatgagccctgcaaatgcagtatacctacagtggactgcgtaatagacagagctgccgtttatgtgggcagctacttcctggtggaaccagagaccaggagctgatccacgttatacgctctataggagtctatgacgtggtggacgttgaaatagcaagagaatcgagcaaatgggcagtccaacgggtatgcctgaggtggtggtagcctctgaaaactctgtccacccacttgttggactcctaccgggacagccctactggagacaaaggtgaccgtgaagccggccaccgcgaagacctgaaacagaatgaggcccagtacggaacgaatacatcaagggccctcccgcaaaccaacggccggcgacgacagcacacccctaggactggtccacatgacgggggatacccaggtcgcacaaagacacatgacaccgagtgtccccaaacaaggacgacaaaagagaaaaccccagagcccaccgacccacaatatattcttcattttccttctctatgaaacaaaaacacaaaacaaaaacaacacaaacaaaacaaacaaaacgaaagacatgcaacaataaacacacagtacagaagtacaataaaaacaacaacaataacatacaaacacacaacgaaaagaagagacgagaagaacagaaaacaagaggacagacagaaagaagagcgcagacgagacaacagacacgaggcagacaaacaaaagcaacaaaacagaacaaaaagagcagaagggacacgaacgagaggaacaaccgaaaaaacgaaagaaagagcgaaaagcgcaaagagcaagacgcaaaaagagacagaacgaacaacgagaaaaaatc

SEQ ID NO: 669231 - DNA, 284 bp, Homo sapiens
ggccggggcggaaggattccttgagcccaggagttcaagaccagcctgggcaacacaggaagaccccatctctacaagaaattaacaaattagcctccagtgagatacccccaatgaaataaacagaaatatagtcaggtgtggtggcatgtacctgttgtcccggctactcagaaggtcgagatcagaggatcgcgagcccgagaagtcgaggctgctgcagtgagccgtgatcatgcctctgtactccagcttaggtgccagcccgagaccctatctcatgc

SEQ ID NO: 669232 - DNA, 163 bp, Homo sapiens
gagcggtcttcatatgtggctatttaaatgtaaattaattgaaactgaatacagggtgttcccgttgtagctcagtggttaaggaatatgactagcatccatgaggacacaagttcaatccctggccttgctcagtgggttaaggatctggtattgtcgtaag

SEQ ID NO: 669233 - DNA, 307 bp, Homo sapiens
gggctaacagagcgtcagtggtatgcacaagggcagaagcacgcatctatgcccgaggcatataaccctttgccgttaaaagatacatcgcagggacttattacaacatcaaaggccagtcatgcacatcgaagaactagggagatcgtacattctattaggaaactggataggggtcagataacaactgacatgctagtgactaaaaagtccatatttccacatgcatgagagataccaagaggtcttagtaaaaaaagcatagtcattaaagacaaagcaaaaagaaatattagtattaatgtaa

SEQ ID NO: 669234 - DNA, 828 bp, Homo sapiens
  misc_feature (271)..(271): n is a, c, g, or t
ctgtgtgaccctcaagtatgaaatctaaaagctgatctacgtacatctggtcatatggctgctgctggttgctaaaatgagcggggggggggggaggctcttgtcacatgatcaggtggccatgccctatcagtgggaatacccgtatttgctgagcgttttgccctctctcttgggccttctctcctttccccgcaacaacattagctacctggtgctctccatgatcagcatgggactcggggggggtcgctccactcatttatggcancatggagatgttccctgctgcacagcagctctaccggcatggcaaggcctaccgtttcctctttggttgttctggcgtgtccatcatgtacctggggttggtgttggcagtgcaagtgcatgcctggcagttgtactacgggaagaagctcctagactcttgggtcaccagcacacaggaggaagaagcataaatgaagcctcttttgggtgaagcctggacatcccatgaatgaaaggacactagttcaggcggttccaaaatcccttctgggggatttagcaactgggatgttgggacctggggcagaccagccaaaggtctggaagctcctttgccctgtgcggagggggcaaaacttaatttattcctgggggcttaaactgggtgaccgacgctatagaacaaatttacggtggtggaagggagacttgggaggtttcttaagaatggcttcgcgctggctctagtcgggatttcccattgcctccatacccttatcctgtgaattaggggatagggataatcaattcttgttttaggaacggcgaagaaat

SEQ ID NO: 669235 - DNA, 1144 bp, Homo sapiens
gcctgggaaatgtgcttggtaggcctgatcagcgtgggccgtggggcggcggcaggcgtgcggcggcggcgtgctggctggtggaggagtgcggctggtggctggtggaactggccatgcgcatcctagtgcggagtcatcagctgccatcagcgaggctggctgcgcagtacaagaccggagcccccgcaccccatgcacacattactccaacattgagcgccaacgagagtgcaggaggtccggcagttcctggagactctttgcccagctggctggagatgacatggaggtcagcgccacagaactcatgaacattctcaataaagggttgtgacaccgacagccttgatctgacgactgactggttcggcattgacacatgtcgcagccactggtggcccgtgctggatagcgacaccacaggacacagctggcgctttgcaggacttcaagctccttgtggaacaacagtcaaaaggtggcaggccatatacaaacagttcgacactgaccgatcagggaccatttgcagtagtgaactccagtgtgcctttgaggcagccagggttccacctgaatgagccatctcctataacctgatcatccgactgctactccgactcaccgtgggaaccatggatcttgacaaccttcatcagctggttggaccggctgcacgccatgctccgctgcctcccgatctcttgacaaaactggcctggaccaactcccggttcccatcccggaatcgctgcaggctggctcatgttccttgaccggagtccagaaccagcccatcaccgcttgcaataggagtacccggcgcttagcactatccccggcgcaccatcgcagcaacacctccttcgtggccgtgtgaacagcagactggatcccgacctgatacccgctctagacatcaccggcaaatctacctctgcggctcccggcgtgagccttaacactgttcagggtccccaacacgagctgaagacccattcactaccttatgcccaactacgccccccggccaatcgagcgaacaccgcaccctagccgggccgggccgcagtttcccggatgcgacaaccgtcttttttcccactgaccagcgacgaatacactacaccgtcggccacag

SEQ ID NO: 669236 - DNA, 1039 bp, Homo sapiens
atcaccacaacacgtcaagaagataatatataacgacaccagctaggctaggtacgatgccttgtcggttaatcggaagaggcacgcacgcacgtttacgcgcgcctgcgctcttttccactgtgctgaaagccccggactcgtggagttgtgaactgccgtggactccgtgagccgcacaaaccagggctcgccatgaatgccatgtgattcatgtcccctgtggttggtgtgctttgtgctggcctgagtggtgtgcttctggtgacctgtggatgtgtcgttggatgtgccgatgtgtgtgtgcttttggctggtggtgcctgactggtcgatgtgcggagtgcttttacgcagtgtctgttggactgacgtgatgtgagtgttggcatgtgcttcgtctgtgactgatgcgtcgttgggacgggcatgtgcactgctgcaactgatgtcgttgtgtcgcggatgtgcctttcccactttctttgtgttgtgcaaatcctgtgtgtgttctgtttggttcgggtgggcatgtggacaccaacagcagtgcaacacactatgtacggtgggcacacgacattgtttgcattgggttgtgaatgcccagacaaactctgtggccaacttgaacggagttaggtctttacaatttaggtactgaatgtcggacacatggtgcaaggcattgccaccttggtgttcaaccccaaagggacacccattgtggttcccccttgggtggcgaaactccaagagttttatttgtgcacgaggcaaactggagcaagtccttccgtaacattatccagtgcaaaggtgcagccacttgaacgacaaaagatatggaaaggtaagccgtagtcccatgagaaaagaccccccttttacacgaacatccccaaaaggacattagaaccaagccaggcaaattccttgcgggaagcgctgttggaacccaatgaatcgccacattcgaaaacccgtgtggggcctaatcggctttctctaaccttcgggtggactgccctcgtggtca

SEQ ID NO: 669237 - DNA, 331 bp, Homo sapiens
  misc_feature (79)..(79): n is a, c, g, or t
  misc_feature (203)..(203): n is a, c, g, or t
  misc_feature (206)..(206): n is a, c, g, or t
  misc_feature (302)..(302): n is a, c, g, or t
cggggttttataagggaagaaaatgagacaaactttgggaagttcacggttttaaaaagtacttttggctgggtgcagnggctcatgcctgtaatcccagcgctttgggaacccaaagcgggaggatcgcttgagctcaggaattctagaccagtctgacctcctttttactaaaaatttttaaaaaattagctgggtgtggnggngggtgcctgtagccctggctactgaagagcctgaggtgggaggattgcttgagccctgtagatcgaggctgcagtgagctctgactccaccactgnactgcagcctggttgaaagacctgtctct

SEQ ID NO: 669238 - DNA, 104 bp, Homo sapiens
ctcagactatgaccttatattaacttgtccaggcactctattcccagagataaatccctgttctgggaaaatagccacctccttgattagcagcagcagcagga

SEQ ID NO: 669239 - DNA, 121 bp, Homo sapiens
cgaagttgagtctgctgcggggtatgtgcagtgtgctgtgggatgtctcgacagcacagcacatctctttctgtctggagtgcgctcaagtgataagactctgctctctgcaggacccacg

SEQ ID NO: 669240 - DNA, 415 bp, Homo sapiens
gtcgaccactcgatatcggcatcggcgagcatgaagaatcgatcgtaggacgatccttcgaaggtcatgtcaaggcgttttctgatgttgctgcgggcaccgtcgcacgcgacacccagcgacaggtaaaggcttcatcgctgccctgtgcatgatgaagtgtcatccgcacggatcctggctggttttctatatcgaccagttcggtattccactcgacctctacccccaacgcgttcagtcgttcaagcaggatcttctctgtctgcggttgtggcaggctgaggagcaggggataggtcgcatccaggtaggagaagttgtagttcagcacccgtttgctgttcgattgcaccgaaaactggttgatcgtgaacccgtcaccgatgacttgatcggcaacacccaggtcccg

SEQ ID NO: 669241 - DNA, 200 bp, Homo sapiens
ttttttttttttgggggggcgggttttaatttgtttttttttaaaaacgcgccttttttggggccagcctcccgccctgggtttttccggaattttttgccccccttagatggtttttttggagaaatggaaaatgtaataagtatcataaacatcatacaaaaaacaaaataacataacaaaaaagaaaaagggaaaga

SEQ ID NO: 669242 - DNA, 140 bp, Homo sapiens
ggaggttaaaggtgcaaggagctatgatcatgccaccacactccagactgggcaacagagccagaccctgtctcaaaaagaaaagtcttgctgtaacttttttttgagacagagtctcactctgttgcagtgtgcttccg

SEQ ID NO: 669243 - DNA, 144 bp, Homo sapiens
aagtatggtaaacaatattattcatacatatattgaatatctgttctcatgtataggaaacacaacaaacgtaaattcgacagagtatcctgcctcacaagattacacagtgcaatccgcactacccctgaggcatgacaaaga

SEQ ID NO: 669244 - DNA, 861 bp, Homo sapiens
actgtgaattaccagtgtatgaataaatttctgtaccaccttatgttgggccagaaggccaccaagtgtacttatatgtaatccttaaatttcaaagtacgcttgtaatttaaaatatttctaaatctttttcttaaacccataaaataaaggctcttactacttagtcaatatcctcagtgtatcgtactcaatgtgtcagtatggcacagattactgtataaaatattctcctttcgtctcacatattaccttctgaggtaatttttcaccttagtgtgtactacaaagattgtgcaggatcttaaatcaagcactatgtaaatactgtaatatcagaatactatgtggcattcattcacaccatcttgtccaacttggcactagatacaacaacgttttaaatgctatggcttcatataatgggctatcatccactatggcattgcttatcaatcagttattaccacttaatgttgcatgagtgatatggggtctgggttcccctctaaaagataagtggtctgaataacggaaaaccgtttttactataccattcttattgtgtcccacccctccagaaattaggttgaaaatcttaactttagtgggggtctatgggggtttaatgggcccagactgtggttacatttcatgtatgtattccttttgggagtctaactacaacactggtttggactacaaaactctcaggtgggtttcccaggtctacacctcttgctcacgcacggatttgctaagattggttaggcacatgagtatgggatttgtaaccccaatctggcttaggggacactgtcacgcaatagcgctttcgcgagagacacgcccctctttgga

SEQ ID NO: 669245 - DNA, 598 bp, Homo sapiens
caaatccaatccaaggttcccaaatcagcccgcacatccacttccttttgggttctcgactacggggtggttatgggcggggtggtaacgtttggctgggagtaagacgtagtctggatgcgtgacgcgtataggtggggaggggactagcgatgtgttctaatttcggtggggtagcctgtcgagggatgaggtttcgtccccggagatgtttcgatttgtccggtgttagatggattctagggcgattttgaggggggttttctttttattgggtatagtacgctagtcggtttttatcgcgacgttttcgtgccttcgtaataagctgctgatcgctacttccgtgggtgttatttgcgaaatagagtttaatttgttcgtcttggatactatgacgggctataattcagacggcctataaagggtctatagagaaaggtaaaataaagagtataaaaaggtaataatcgagctagtagcgagtcctgagccggtatgggaggtatatgtctatgtgtgggtggtttgtcgggtgattttctctttatatctatattgatatttttgggactactcgtttcgttttatccggccg

SEQ ID NO: 669246 - DNA, 259 bp, Homo sapiens
  misc_feature (153)..(154): n is a, c, g, or t
ctgtgggaggctgaggcaggagaattgcctggacctgggaggcagaggttgcagtgagccgagatcacgccattgcactccagccagggcaacaagaacaagactccatctcaaaaaaaaaaagctgaatctctgagtgggtttttcattttnnatttttttttttaaacagatgcctcagaacctgggtaactcagtttatcagaaattcagttttcaagtttggaaggataacgcttggagctggtagtcactcata

SEQ ID NO: 669247 - DNA, 622 bp, Homo sapiens
  misc_feature (444)..(444): n is a, c, g, or t
gtacccccccgcgtgtgttgtgtgcgtgtgtggagaacttagaaacgtgatgtggcctttatttatgcaaaacacctcagaatccagtttaccctgtgctggtccagcttctccctgtgggaaaaagtctctccgtgttctctctcctccttccagctcccctccctccatcacctcaggcctttctgttcctgtgtcctcacacttactcccctcaggacctacccagcctcttgtgaaaagacaaagctctgcttacatagaagactttttaattttaaccaaaagttactgttgtacacacgggagttggggggaaaaccattacagttaccaacagtgggttttcccccaaggtcccctttggagacttcaacggggggaattggcgcaaccgatttttctcacgttaaaaccggtggttgtcttacacaacgtggtgtnaaacacacagacgaacagacccatagcgcacaccaacatcttctctccactagacacagaaaacacttttctctcgtgcggaggccggggggaccacaacaacacaacactcggtcggctgtcgcctcgtggcttgtcgagacacacactgagggcgaagcgcgagcagcggcgacaa

SEQ ID NO: 669248 - DNA, 420 bp, Homo sapiens
  misc_feature (412)..(412): n is a, c, g, or t
tgcttaattctctcctttgttttaattttgggttttgtgtgtgtgtcatcgtaggcgtgttttgtggatttgggatgtcagttctttgttttattcctttttctacctcccactcctgtttttccatttatctttggtcctgagggatacatgaggaagaaacaaagcaagaaagttggggaagaaagcaatgtctcttacgggaactgaagtaaacacttattttcttagttctggaagtggaattaatggtggaacagtatagtagaaagagcataaatgttggagtcaggcctttgttcttatccctgctccactgcttactacccacataactcatcctgctacttcagctccctggcccttggtttcatgtgtaaagcctgtctttgtgtggtgttgtatgactcangtggtgtg

SEQ ID NO: 669249 - DNA, 134 bp, Homo sapiens
ataccttttactggtagcagttatttatttagctttaaaaagtgacttcttgcaggctgagttagagactagcctggtcaacatagtgagagccctgtctctaccagaaaaaaaaaaggtgacttccgtccttt

SEQ ID NO: 669250 - DNA, 197 bp, Homo sapiens
tgtcatagtggtctccatggggatctatgttgcttccacctaccacgtggcttgtgcactctttactcagtggccatgtacggtggattagtgcttcagcatgttcctatctgtatgatacccagaaagtaatccggcgtgcagaagtatccacaatgtatggagttcaaaacatatgcatcccaatcactcgcatg

SEQ ID NO: 669251 - DNA, 84 bp, Homo sapiens
acttgaacctgcagaccccagcaacttcatgataagttcacggtcttcttcatcctggtctttgtatttttctgtcgtcttctc

SEQ ID NO: 669252 - DNA, 1566 bp, Homo sapiens
  misc_feature (144)..(144): n is a, c, g, or t
  misc_feature (152)..(152): n is a, c, g, or t
  misc_feature (494)..(494): n is a, c, g, or t
cacgattctcgtgtgttcttgttttttgtcgtttgtgtttttgtttgttgttggagttctattgtggaaagaaaaagaaagagaagagtaaatagagatactagagtggcgcggggcagtagggaagagggagggaggagggangttgcaancatgctcaattgatgtttgtgatgtataggctgtgctagctctcgcgtgtgttgcctcctgctccctctgttgtgggtgtgttagctgcacactgaacaacagtcggtgtgtggtgggtgaccaaacaaaacactgcgtggttgtgttgtggtgataagcactctcttggagtatgtatgtcaccgcccccccccctttcgttcggggtggtggtgagttcctgtcctgcaagcacgacgcactttcttgttgggttgaggtgtgttcttcctccccctggagacacgcagacactggtgggggggctctgtatatatgttagtatgttgtctgctccctanagagaagcgtggtggctgtctacaaaaagacgctcgccttttgtttccatagatgttagacaggttgttggttcacaactgaggttcttcagcagcgcgtgtgggctgtgctccgcggttcgtttggttaccggcgtaaaaaaccgcctggctgttttgttgggtctgctgttgtgcccgcgcaagcgatgcagttgtttaacctcgcgctgggtgggtcccgcccccctgtttagccaacatgcgtggtccctcgtggtgtttgctgctatataggacgagcatgtgcccagcagccgtgtgtgtgtggtgtttgctatggtgcatgttgtcctcccgcgcaagtatgtgcagccaccacgggcggggtcggtgtcgtgtaggcaggacgccgaaaattttgtgtgtgtccccccccgcagtgatatggtgtcccccgccctcgcttttacattatcgggcggatacctatctctgagataaagttgcggccccccccccccattgtgggtgcgtcgcacgccctcgagtataaggagaacacgcggcgcagcagtcgtgtgttgtgcgtaggaagcacacgacgattatgggctccgtccctgcgacgtcaaatgtgtgtgatttgggaaataatatattttgtttgtcgcctgcccccggcgggcgaaatttttttctcttttgttaagggcaagcacccacagcgtggcgtgcgtgcgagtatagagtcacacgtgtgcggagtatagaatatcatgtcagtgggcgtcgcacgtgttagtgtggtggcacctatcatgtacgatatacacacctatggatatatatcatagtgaatgtgatagatttacagacgcactcacgcgcgcgtgtggcatagtgtgggacaatgaaaacatagtattgttagatggtggtgattcgggtccacagcgggtattgttgtgggcttataaattcacgcgcggtgaatatatatgctcgtcgcgtctttaaacgagtggttcttatctctcaaattaaaagaaattgaggagcattcaactatcgaacaaacaatgaacaagaa

SEQ ID NO: 669253 - DNA, 190 bp, Homo sapiens
ggctgtctagaggatccctgttcatgtatactgaaagtgatggggactcagccaataaaaaaaaaaaaaaaagcccaaaaaaaaacaccaaaaaaacttcaatgatccccccacttgggctcccaaaggggtcggggaatcacgggggtaaccatgggcacttgcccaagatttttttttactgggactt

SEQ ID NO: 669254 - DNA, 678 bp, Homo sapiens
ggtatacgttcacgtaaaaactaaagagaagcgttcacagaaacttctgagtgatgattgcattcaagtcacacagttgaaccctccttttgattgagcagttttgaaactgtctttttgtagaatctgtaagtggatgcatggacctctttgaagatttctttggaaacgggaatatttccacagaaaaactaaactgaagcattctcagaaactgctttgtgatgtttgtgttcgagccgcagagtttaacattgcttttcatagagcagttttgaaatattcttttggcagaatctgcaagtggacatttggagcgctttcaggcctgtggtggggcctgaaagccttttcctttatcttcgcagaaagacgagagagaagcattgtcagaaacttctttgtgatgattgctttcaactcacagagttgaagattccttttgaaacagcagtttcgaaacactctttctgtgggatccgcaaggggatatttggacctctctgaaggtttcgttggaaccggataatcttacctacagctaaacggaagcattctcagcttctttgggatgttgcaattacctcacagagttgaacttttccctttgatagcgcaactttgacacactttttctacaatgtgcaagtggatatttccggcttggaggctgcgtcg

SEQ ID NO: 669255 - DNA, 238 bp, Homo sapiens
ccactgtactccagcatgaacagcagagtgagaccccatctttctttattgttgttgagatgaagtctcactccatcacccaggctggagtgcagtggccaatcttggctcaccgtaacctctgcctctgagcttcaagcgattctcctgcctctgcctcccaagtagctgggattacaggcacccgcaccatgcccggctaatttttgtatttttagtagagatggggtttcacatg

SEQ ID NO: 669256 - DNA, 111 bp, Homo sapiens
gttagcatgatacaatcgagctctgtaccccaggtagaccgtaatctagaagtgtgaaacgttagcttgattaaggcgaccgcgaatttccaagatagtccgtagaattag

SEQ ID NO: 669257 - DNA, 1008 bp, Homo sapiens
ttctactagacgatgaccaaatacttagttgtacaaaagcccacaacgtcagctctgcttatggctacttgcatgataatccttgaccgactgtgcagtaccgagagtaccatcttagactctattacgattccgtgcaactaacgtgccgtagctagccgctacgccagtattgtgcaagccatcgcagtactacttcgaacgttgcagacgtgcaggttgtgcaagtacggggcattacacataggaaagcataggctagttcagggtcttccagtggtcctagctggtttctcatagggttctgatcggtgataactgcttgacacttggatcgatgagtgttgtgtacatcagggacaatagccataagagttcattaagtgtaattccattatgatagaagtggaatctcttcgttgaataagctcgagcaatgaatgcttagcatataatcgatcttctgttccaggaaccctatcagggaatatccctgtaatttccctagattgataatttagttcgtactatcacattacttaaggactcgactcattggcaccatcgagtgcatacattgcagaagccttaacaccaaccctaaacactaacgttggatccctgaatacccctaaggaacccgtttcttcttgctatacctgtcagttgcatactagcgtatggaccgaagctaagttgcttggtccgtaaccatttcgtgacaaaacttatttcacctaaaaaacgacaaccacacatgctcgcaagtgtgtgcgctttaaaagacgccattttgctcactacttttagttaaaagcacagcctgttttagtgtccacggtgccaaaatgcttaccggcattaggtacaggggccaatcggtgaaacgacccgctaggtcttaggataccgcggaaacgggaattatggaacatgtagccgtatacaggtacgggaaaaactggggtttagagtgtcacacgctctgaagggatagcgtacacccca

SEQ ID NO: 669258 - DNA, 102 bp, Homo sapiens
gtaaccctgccccgcacaacctggccccataacgctcctagcgaaagggaatttccgcgtcctggtacgacccgttacgccgtgctcacccgcgcaaacatc

SEQ ID NO: 669259 - DNA, 141 bp, Homo sapiens
tgggcatcattacatcacaacaattaacaatataaaaccccctggccatacccaattaccaaactgcccctacttctgtctaaatcctgtcctaaatcacatgcatgtcctcacttactacctatactactacccatgtcc

SEQ ID NO: 669260 - DNA, 270 bp, Homo sapiens
ctcactggaactccatctcccaggttgaagtatactcctgcctcagtcctcccgagtagctaggattacaggtgcctgccactacgcccagctaatttttgtatttttagtagagacggggtttcaccatgttggccaggctggtcttgaactcctgatcttgtgatccacccatctcagcctcccaaagtgctgggattacaggcgtgagccaccgcacctagccaggaggtggtttttaaagaggaagacaaataagatttgccaata

SEQ ID NO: 669261 - DNA, 702 bp, Homo sapiens
gtcgtatcacgctcaggtaaagataacctcctctttctatgactccagatttccattcaggttatagatattattcaatagttgattttctttttaagctgggcaataaattgatgtttccagagtggtaacatggagagagggcagtataggataaaagatgagcgagaattctaccctaaaaatgttgctagctagttcacaggaatgaagatgagcggtttatataacttctcaaggtaattctagattgacatttctgaggggaaaatgggctcttgttctaagttgaacgtgagcagagaaggctataacaactatccactatgtagactgtacaggcgttccagagagtaaaacaaactaactgactgcagatgtacttgcttcagtgtgattcattcagtacttcaaacttgtatacttttggcataggtccaatgttcatgaaacacatgtgctgtcatagtgtgtgtgtatgagggttggtcttcgtctcgtatcgcttcagatttagctctaaattctggcaactccttgtaatgccaatgtatttgatacatgaacaatcatgtctgaatgcattctgtgatctgggagacttgcctcgtcttccagggaaggaaggatgtgcgagccctgaaggcactgaaatatcccagtgtgtacggagccagtggaactatgggatacccatactga

SEQ ID NO: 669262 - DNA, 214 bp, Homo sapiens
  misc_feature (176)..(176): n is a, c, g, or t
taattgtgtatcattcccatacagaaggtaagtactcaaattattttcctcataaaacctgacattcagcatcttaaaggtaggtatacatttggtactttcttatgttcactcctatacccactagatcaaaaatataaggtactgagtgattttaaaacttaaatgaaaaattntaataaggaaaaagtaatagacaatatcagtatgataa

SEQ ID NO: 669263 - DNA, 391 bp, Homo sapiens
taacctccgcctggtagccggcgttctgcaaacgttcgacgatgttcactgcataacggctgaattgagcgcgctgcagcgaatgctggctgctattgagcacttcagtgcgtgctgcgttttgtgttgcgttcgacgcaagggagaacggaatgactgggacaacttctttcgcatgggatgccctggttggagggattgttcgggcaaacgaagaatgaccgcatgatgggcggggattcctagcatttagtcaggggatggtgtaggaacaagctaaagggatagtgcgcacatagcgcttggagggttcaaatcccggaaactacaaggggagccgaagctccccccagaagtagttgcgtgctctatttttattattgatgtcggg

SEQ ID NO: 669264 - DNA, 356 bp, Homo sapiens
ctctgtgtaccgtttgtgaggagcgcacatttgcacatctgtattatactatgcactcacgccactcatgtctgtgtgtgaatgcacatcctgccaggttctgctccatctatgcgttctgtctccccagagctgacagctcccacctgactatgagctcagggaaagaaccgacaagcctagttccatccctcaggctctggacgcctgtactgggactgctgggatctcagcagtgctgccaggggaagtgagccaaacgtgggcaataccatcctctgggcacactgtccccatctgccagtgacctccaggccagggctcactcctccactccccacatgcatgcacccagg

SEQ ID NO: 669265 - DNA, 350 bp, Homo sapiens
tcagaccatgtctgaagcacacgctgactttgttcttaggtatttccctctgggtactctctgagtttctaagaacttgacggcagccactccaagagagttcccgacacaaataaatgataaatgttagagatgatgggtatttgaatcactgtgatctgatcgccatacattacatgtgtcagaatatcagtatgttcccaataaatatgtataattatgtgtacgccaatttttaaaaaagccagttaaagtcatgaagacgcaaacatggaaagccctccttttcaagaacaggagtctcttctgtatgtggagaagcccaaggaccaaaaaatataccactctct

SEQ ID NO: 669266 - DNA, 407 bp, Homo sapiens
ggtcgatcagcttccgatgagaagtctgccgttactgccctgatgtgggcaaggtgaactgttgagtaagttggtggtgaggccctgttgcacgctggtggtggtctacccttgtcacccataggttctttgagtcctttggggatctgtccactcctgatgctgttatgggcaaccctatggtgaaggctcatggcaagaaagtgctcggtgcctttagtgataggcctggctcacctggtacgacctcaagggcacctttgccacactgagtgagctggactgtgacaagctgtacgtggatcctgagaacttcaggctcctgggcaaggtgctggtctgtgtgctggcccatcacttttgcccagaattcaccccaccagtgcatgctgcctatcaggaagctg

SEQ ID NO: 669267 - DNA, 313 bp, Homo sapiens
aaggaattctttggccagaaattcaagaacatgtctgaacaacatagctcgaccccatctcttcaaaaaatgaaaaaaaattagctgatgaggtggctgaagtgagctgtgatcgtgtcactgcactccagcctgggtgacagagcaagacttagtctcaaaaaaaaaaaaaaaaggaggaggaagaggaaggaaaaaaaaggcccggccttggggggctaaccctggaaaccccagcttttggggggcccaggggggccaaatcattgggggccaggggttaaagaccggcctgcccaacaggggaaaccct

SEQ ID NO: 669268 - DNA, 272 bp, Homo sapiens
cccaggtgtagtgcgtggcgcgatctctgcccactgcaaggctcacaccattctcctgcctcagtctcccaagtagcagggactgcaggcgccaccaccatgcccggctaattttttgtatttttacgtagagacggggtgttagccaggatgatctcgatctcctgaccttgtgatccgcccacctcgggctcccaaagtgctgggattacaggcgtgagccaccgtgcccggccagtagcttatcttttaccttcctttaaaatatcttt

SEQ ID NO: 669269 - DNA, 335 bp, Homo sapiens
  misc_feature (28)..(28): n is a, c, g, or t
  misc_feature (109)..(109): n is a, c, g, or t
  misc_feature (113)..(113): n is a, c, g, or t
  misc_feature (134)..(134): n is a, c, g, or t
  misc_feature (160)..(160): n is a, c, g, or t
  misc_feature (174)..(175): n is a, c, g, or t
  misc_feature (190)..(190): n is a, c, g, or t
  misc_feature (238)..(238): n is a, c, g, or t
  misc_feature (266)..(266): n is a, c, g, or t
  misc_feature (271)..(271): n is a, c, g, or t
cacccccacccccaccgaaagaatcaanctacgcaaataactggaatgaaattctcaggcaatttcagcaggggaaatggggttatctcatctgggtctcacatccganctcntcaagacaagaccttccctanacttcacctgaacacctggacacacngtcatgtcttgccnnttcttgttactgganatccaatgatgatgtctttatacaatttataggtctttctataagtgncaagataaatgtcatctctgtacctgcntatcnttcagaggtaggcaagcttctatgtaaagtgctagatagtaaatattataaacttttaaaaaaa

SEQ ID NO: 669270 - DNA, 340 bp, Homo sapiens
tttgattcaatcttgtcctttggaccgacaaggcgtccgcaaccacatccgtattgacgttgtacatcagtgtgccgtggcagaaggttttaccatcacgggtgtacatggcgttaccagagaacttcttaccatcaatgacgatgtcgttacgccccgtcgccatcgctccggtggcccccatgtcgtggagggcgaccacaacgggttgcacgagttgcttgaagtaaccgaagcgaacttcatcggccgggacgataaaggagaagcacatattccccatgtcttgatacatcgctccaccaccggagaggcggcggttatggtaactccgttttct

SEQ ID NO: 669271 - DNA, 1126 bp, Homo sapiens
  misc_feature (746)..(746): n is a, c, g, or t
ttttctccccacagataagtaaagatggggccctacgcacaacaggagggggagcgactctccagcgcagcaaaagttggggggggagaagaaatataccattgtgggggggggagaaaccaaaaagagagggggcacctcgtcaaccacgcggaggactatagagcgagcagcgccttgtgtctcccagagaagagaggaggcgcagccatattagaagagagaacaaacgagggctctttatttggaggggaggaagcagctaagcaaccacacaaaacgagcgggtgggtgtcgccaccccgcccgcgcggacaacactatgtaggatagcttgtaggagacaacaccacgaggtcgttcctactggtgacgagtctattacaacacacgacagggtggtgagtatgatgtttctccgcccattgggacacatcatagtgacgctcggggggagatattctcctctgacgccacatagtgtagagagcgcgctacacccctctcctcttgccagcagtattcttcgggcggccacaccacggagaccgcccttgttttgggcaaaacaagaaggggggcgccgtgacacacgttgagaaaacaacatcgggtggggagaacacaggcagcacaggcacccagcggcacgtgtgaaaccattcgcgcgggacacacgagatatgcctacgcgcgagacacatctgttataataagagaaaagaatatcgaagaaagagttgggnagacacacacagagtggagatttgggaacgaaagaggttgcaggagaaaaatatggcgccacccgtgaggagagcgtctcacgcacgccactcggagaggccaaggccgtgaggaacggtgcccggtcaacaaggaggaacaaatcagcgttcaagggcaccactggcccccgaacatctaccccccaaggagccacgggcacacaaaagtaagagagagagagaaacgatcccgatcctccacaccgtcacaaaaatagttgtggaggttgcaccaaaatagtatgacaaaagatgggggatggttgaaaaaaaatttattgcacaccaaccttgggagaatttggcgctgaatacccagagattttcccttttaaata

SEQ ID NO: 669272 - DNA, 615 bp, Homo sapiens
  misc_feature (399)..(399): n is a, c, g, or t
tactactaacagaccgcaacctcaacaccaccttcttcgaccccgccggaggaggagaccccatgctataccaacacctatcctgatttttcggtcaccctgaagtgtatattcttatcctagccaggcttcggaataagtctcccatagtgtaacttactactccggtaaacagaagaaccattgggatacataggtatggtctgagctatgagtatcaattggcttccgtagggtgtatcgtgtgagcacaccatatatgttacagtaggaatagacgtagacacacagagcatatttcacctccggctaccataatcatcgctatccccaccgggcgtcaaatgtattgtagctggactcggccacactccacggaagcaatatggaaaggatctngctgcgagtgctcggagccctagtgattcatctcttctgtttcaccgtaggtggcctgactgggatgagtattagcaaactcatcactagacatcgtagctacacgacgagcgtactacgtgtgtagcccagcttccacgtatgtcctatgcaactagggagctgtatgtgccatcataggaggcttcaattcagtgatttcgcctattctcaggc

SEQ ID NO: 669273 - DNA, 118 bp, Homo sapiens
actccgtttgacagtgacgcggttgcatccgttgacagtgagcggttgcatccgttgcagtgagcggttgcatccgttgacatgtgagcggttgaatccgcttgaagtgagcggttag

SEQ ID NO: 669274 - DNA, 211 bp, Homo sapiens
  misc_feature (45)..(45): n is a, c, g, or t
tactgctatgcaagttagaagaatttgacaaggtcaggtacacanagtggttgatggtttttcaccaaagccagtgactcttttggcctcattattcaaagtacaagatgatgtcacaaaattggatttgaggttgaagatcgcgaaagaggagaaaaacctggggtttgttttttctggggggggtttgttttttggggccggattgttt

SEQ ID NO: 669275 - DNA, 128 bp, Homo sapiens
ctcctgaggtatctaaggtgctacaaggcatctctctctgcaaacgagtaaacatcaccctccaactccttacagagtggagcaacaggaaaactccttcacctcattggcttgtgctgcttgggagg

SEQ ID NO: 669276 - DNA, 103 bp, Homo sapiens
ccacgttccacagagtcaagagcccctttatatctaggcccctgtgtaaagcgatgtgctactgccatgcctagaatcctatatcactgatagctgaaaaaga

SEQ ID NO: 669277 - DNA, 151 bp, Homo sapiens
aagctatacggttcatcacttgaggtcaggagtcgaaacagctgtcacacatggaacaatccgttcttattaaaattaaaaattagccggcgtgtggcatgactttatccagttactcaggaggttgaagcaggagaatcactttgaaccg

SEQ ID NO: 669278 - DNA, 134 bp, Homo sapiens
  misc_feature (49)..(49): n is a, c, g, or t
  misc_feature (55)..(55): n is a, c, g, or t
  misc_feature (74)..(74): n is a, c, g, or t
  misc_feature (87)..(87): n is a, c, g, or t
gatcagctttgtttttcccagagttcatgcaaatagaatctggcttctntaagtnagcatcatggacttggttnaaattcgcccgtnttgctgagtgtatctttagcttgtcccttttaactgacgagtagtat

SEQ ID NO: 669279 - DNA, 100 bp, Homo sapiens
tcggtacccccttgtgtagcaggagaggcggtgatggggcatcgagcggtcagggactgaggtggggggctgggttggacgcagctgggccctggcttag

SEQ ID NO: 669280 - DNA, 199 bp, Homo sapiens
tcatcctttatgcatacaacctaccaagcctaaatcagaaataaaaagtgtcccatcaaagaaaagcctaggacctgatggcttcactgctgaatgctaccaaatatttaatgaaggactaataccaaatcttctcaaactgattcaagaaattgaagaggagggaatactttcaaactcatttataatgccacaatca

SEQ ID NO: 669281 - DNA, 194 bp, Homo sapiens
catgctgactagtcattatcaaaaccatacctgcagattcactattcatcaggacggaagttgtcatgcatagcatgagctgggatgtgtcgatggcctcaaaaatgattctgcccttaagatgaacaggactgactctgaaatacaatactcctgattctgaaactgtcacttgcctgactcactgtaaactc

SEQ ID NO: 669282 - DNA, 1058 bp, Homo sapiens
  misc_feature (540)..(540): n is a, c, g, or t
ggtccagactccatcactgtgctcctctcgcggcccggagccctgtcgatgtgacaccaaggagagggtccaactgctccagaagttcacgcgtagtgatgagatcgccatacgtgcggccataggttctagccagaggaatgtccttgatagcgtcttgggattacagtgaatatctgtgcgcaacggtcggatggaacctcgttgcattgagcatctaacttacattggattgacgctgttcccatcttactcgatgtcgacccaataggcggtattctcaattgtgcccatcgccgttgccaagggacgtggtaggaaaacagagtggagatggcgtcttgctcctatgcgagattggggcaaaagtacacgcgagttcgatcgcaatccttttcccatggggagtgccgtaggattgccgcgtaccctatagacactccgaatgtgggtcgcgagtacatggacgtcctcgagggtacccgttcgagattgagtatgggtccagctctgagtccagatcgtatctaggctcagacnctagttggaatcgatatgggcttgtgaggtctcatctctgtgcacgggggaggggaagacctagatacaccggggatcagtccactccgatctgctccctcgtccatgcaatgaagtgccacaccgaagtggttcgggtcgaattgtgagtttggtggaaaaccccatctggaacggaaacgtctaattgaacagagccagggcccttccaaagggagttcaagttcagaggcaaaatttggcctcggtaaccgttgccaaacgctaagcccaaaaggccgtagtccgatattagggcctagcagcccccttgtggcgcctagatgggcttccaattcacaagtttggaacgaaatcgtaatttgaggcaaagttccggattagcgcagaaggggaacctttccaagttggaaccccaacaaggatttgcaatttggccccaaggtccaccgttgccgcaagcccccaagggaaaacggaacctggattggcgacttggggctcccccctacccacgg

SEQ ID NO: 669283 - DNA, 181 bp, Homo sapiens
ttatcatatagctaatctggattgaccactaattgaatagcatctagggtttgtttattattaaaatctgaaaaaatactatatttaaatatgacattgatgtgttgagtttacttatttatttgcctttttagggcatatggaggggtaggtatgatgaaggtaggtatgatgaaggacg

SEQ ID NO: 669284 - DNA, 433 bp, Homo sapiens
gactatcgggctgacgttgccagatatattcgttcaccggggatcaggcgcctgaccgagatagtgccaccgattgacggggatattgtgctggtttcgcctgctccatcgcaattgcacctgatgatcgcggggatgggcggctttgtgcatgcccatgcagggttacgccgcgtcgtgcctggccctgcatttcccgactggccgatgctcgatcgctggcgtgtagtgggaggttggagtggcgacactggttttgaccgcgttgggcacggcgattggctgggcccgtcgggcgggtgctgttggggccatgcttggccagcagctcgatcgcgctatagtttggactggcccccgccgcgacggcccgcgcctgcaggaactggaactgcaaacgtcgagttatggcactgcatttccagcgatattt

SEQ ID NO: 669285 - DNA, 324 bp, Homo sapiens
  misc_feature (44)..(44): n is a, c, g, or t
caacattggaactcccagggtatataaacattaatagatccaanggggctgggcgcagtggctcacgcctgtaatcccaacacttcaggaggccgaggttggtggatccaacgtcaggagattgagaccagcctggccaacatggtgaaaccccatctccacaaaaataccaaaattagctgggcatgatggcgggtgcctgtaatctagctactcaggaggctgaggtgggagaatcacttgaagctgggaggtgaaggttgcagtgagccaagatcgtgctattgcactgcagcctgggtgacagagtgagactccatctca

SEQ ID NO: 669286 - DNA, 102 bp, Homo sapiens
aattagatcccctatttcatgttcagtatctagtgtgagagacttccatcttatgtaagatctggattcctgtagtcccagctacttcggaggctgagattg

SEQ ID NO: 669287 - DNA, 96 bp, Homo sapiens
gggtaaatcttttcaagacagaaaagcaggtgactcagccctgtgagctctgtgactgacatgacccaaaccaccagcgattttctccttctccag

SEQ ID NO: 669288 - DNA, 591 bp, Homo sapiens
ggggtgacattgcaccgcgcccctcgtggggtcgcgtgccaccgctacgcggactccccagatggcgcgccccatcctattggcctgtctggtaaggtccagaaccccgcttgccacctgaacagccatgggggctgagggtgatattcggcgtgtactttcatcagcgcttcggtaccggaccttcgcgctttactagaacactgtggctggggacccgcttcgctgtaatcatcctggatcgcagggaggtgttccgcatttgcctactacaagctgcttaagaaggcagatgaggggttagcatcgctgagtgaggacggaagatcacccatctccatccgacagatggcctatgcctttctgacagcagccattatcctgctccataccttttggggagttgtgtactttgatgcctgtgagcaggagacggtactgggcttagggcctggatggattgggagtcacctactgacatcgggcactgacattccgtgaacccctggtatgaggccaagcctgctgcccatcgtatgcacgtcacatgatatccatggggctctgggcacttcatcacagctggagggt

SEQ ID NO: 669289 - DNA, 130 bp, Homo sapiens
cttcttctggcctcagaagtaggactgaagtgtactattgctaggtgtgagaaaggggcacttctcaaaacacagaccaggtagcaaatctccactgctctaaggttctcaccaccactttctgtcgacg

SEQ ID NO: 669290 - DNA, 848 bp, Homo sapiens
agcaccatcttccctcgcctgctgctggcagcctttccttgccttgcttgttagcagagcatgctgcttacccatgtggctcccagaggttagcagccccggctcttggatttcttgattcttctcccctgtgatctcagaggtgctgcagaggacattcccctttagagcaagtcatgtttctattcaggccacaaaactgggatgtacatgcagtgactttggtgttccttgtcttgttcaggggaacgggtgggactgtgtgtgctgtcaccctcttcattccatgagcaccttgttcacttagggtctgctgccttttttttttcttttcttttttttttttttaagttgggggctcgggtttccctcctgtggcgcaggcgtgagtgcgagcctccaaagtagcggggatggtaggcgtgcgccaccagccgggttaatttaatatttggggcagcgacgggggtttggccatgtgggccagcatgggtctcaaacctctgacctcgtgtttgacccccctgggctcccaattgcggggattaccccccagctcgggtgctttacattattccccatctgtttaggggtccactctcataacggtcacactttctcattttactttaacttacccttagagttgaccccaatgtaagaagtcactctccgtcaaaagaatcatggcttaaactctcagaatctgtagtgcgaaaacttattgaatttttcacacttgtgcgttgttcacagaaagatctggcatgccactgtgggctcccccttattaaccgccttgggacggggggggacactggggggttaaaacctggcggttgaacgta

SEQ ID NO: 669291 - DNA, 312 bp, Homo sapiens
  misc_feature (243)..(243): n is a, c, g, or t
  misc_feature (274)..(274): n is a, c, g, or t
tgacacatgtattaggagatgggtcacctgtgaccaggcttgactacagtagtgctatcacagctcactgcagcccaggactgcctggagacaagcacgcgccatcacacccaggctaattttttatttttatagagacagggtctcactctattgcccaggctggtcttgaactcctcggattccagcgatccttccaccttggcttcccaatactgcaatgattacaggcatgagccactngcacctcggccgaatctttgtattgtctcangacagtcctgggcggatccttctagcagtcgtacctgc

SEQ ID NO: 669292 - DNA, 91 bp, Homo sapiens
cgcccgcatgaggtgctgctgcgctcggacctggtcaaggcacaccagccccgcgtgagcgccgcccacaagggctgaggagcacgcatca

SEQ ID NO: 669293 - DNA, 296 bp, Homo sapiens
gtacaggaatggggtgtgtagtactagactaaatacaccaaatagtcttcaaagagattgtaccatttaatacacctaacttaccaaacatcatagcttagtctagctcaccttaaacatgttcaggacacttacgttagcccacagttgggcacatcatctaatgcaatgcctgtattataacaaagtcttgaatatctcataaaatttattgaatactgtatcgaaagtgaaaaacagactggtttatgggtactatacaggaggatgtgtgtaggttatatgcaaatgctatg

SEQ ID NO: 669294 - DNA, 150 bp, Homo sapiens
gggtaggtcggcacgccgtggcaggtatggtcagggcctggagagatgttcctgtccttcccaccacagacctacttccgccttcgacctggccacggcctgccaggttaagggcacgcagaaggtgacgacgcgatgaccaccactggc

SEQ ID NO: 669295 - DNA, 263 bp, Homo sapiens
cctcaaagtgaacatgggttgtatgttacatgcatgtttgttcaataagcatgagtcaggatgaccttcataattattcatagctcctcctgtaacctgttgaatatgtatgtttagccaacctattcagcatcaagttcctacccctgctcctcctttgaagggcctgtttttggtttttgccaaagattgtacttcctggcctgtgggatggcccccttgcaggcctttaaccctttataagaaataaagtttcctctcca

SEQ ID NO: 669296 - DNA, 405 bp, Homo sapiens
  misc_feature (243)..(243): n is a, c, g, or t
  misc_feature (378)..(378): n is a, c, g, or t
  misc_feature (399)..(399): n is a, c, g, or t
acgaggttgatgaaaaaaatggttttattgtacttcatttcattttatagatggcaactgaggcaaaaagaaggcagtaactgccaaaggtcagacaggcagtaagtggcagagttgggatctggctcccaagtccctgttcttcagtaacattatgctgcctctcataatgttctttttttcaataaactgtgtgtgggcttctaaaatagtaacagttctttatataaaaggggaaaaaangttttaaaattagagcagggttgaataaacgttcaacttaaacttaacatttgactgaattttatctgactttttccatgtaatattgacatcatcgaaacatactgtagttatttaaaccgtgtccgtgggtcnaaatggcctgcatccaatggntaaaat

SEQ ID NO: 669297 - DNA, 378 bp, Homo sapiens
gtccccctgagaaaaatttttgggcttatgcccggagcttccggtttaagtaaagggcatgtgcccaaaaaccggcatgtttgccctgagtagcgagtccatgtccctcaaaagggcttttaggtagtccaaagtcctttttcatgccaaaggccagttaggaaaaacatgtccctcaaaaaactatggaattgagggcccctcctttgtgggtttccctccaataaaactcagtggggcaagcaaaaaaaaaaaaaaaaaaaaagttttggggagggatgttttgttagtgtataatcaataacttttaacctttagcttgtatttagtaccctttccttgtgttttgaaaaaaagtaaaaattttttttaagccca

SEQ ID NO: 669298 - DNA, 201 bp, Homo sapiens
ccgtggtagctgtggtaccaaaaatgttgagccgtagatgccgtcggcaatggtgaagggcgactcgaagtactctgaggcttgtaggagggtacaatagagaccccgtaaaattgtaataagcagtgcttgaattatttgggtttcgggtgttatctattagactatggagagctcaggtgattgatactccctgatgct

SEQ ID NO: 669299 - DNA, 181 bp, Homo sapiens
cgaggtgaaatatgctcgtgtgtctacgtctattcctatgtaaatatatggtgtgctcacacgaatagtttatgctgtaatagtttatgctgtaatagtttatgctgtaatagtttatgctgtaatagtttatgctgtaatagtttatgctgtaatagtttatgctgtaatagtttatgcg

SEQ ID NO: 669300 - DNA, 104 bp, Homo sapiens
gctctcgcactgtacttcgcatctcttcctcacagactgacacctctctatcatcagaagacagatctataagaactgttccacataccagaggtgtacaccgt

SEQ ID NO: 669301 - DNA, 282 bp, Homo sapiens
ctcggctcccaaagtgttaggataaggcgtgcaccacggcgccgggcctcaaaataatttttttaaaaaaattcagggtctcattcggtcatccaggcgggggtgcaggggcatgatcacagctcacggcagcctcgacctccagggactcgagtgatcctctcacctcagcctcccaagtagctgggactataggcatatactaccacacccagctaatttttaattttttggtagagatggggtatctcactatgttgctcaggctgatgtcgaactccg

SEQ ID NO: 669302 - DNA, 207 bp, Homo sapiens
tgtttcactattatctttactcttttgtagtaatttgtcgtaaggcagtgtacatcagtagccttggccgcagggtatagataatgggtttttctttgatcaagtgtaccataccaattccatagttctagcccacaacgatattagtataaggtttaattgcctataagatggggtatatttgattatacactctatcaatagaga

SEQ ID NO: 669303 - DNA, 199 bp, Homo sapiens
taaaccctttttaaaggggtttttttttttgggcccccccctttttaaaaatggggtttttgccccccctttttttttgggggggggggggtttttttaaattttccggggggccccctttttttaacctaattggaggaaatttgtttccccccccccggtttccttttgggccaccccaaaaatcttttgtttttta

SEQ ID NO: 669304 - DNA, 294 bp, Homo sapiens
ccccgggaggcccccccccccgttttttttccccctttaaaaacccggggggggcccccccccccggtttttttcttggggggggggggggggaaattttttcccccgggaccccctttcccccctggcccctttttggggccccttttaaccagttttttcccaaaaaccggggggggccgggccgggtttcccccggggtccaaaaattttttttttttttggttttgggggggttttgggggggggggggcccccggtttaaaaaaatttttgggttttttccctgtggga

SEQ ID NO: 669305 - DNA, 90 bp, Homo sapiens
  misc_feature (17)..(17): n is a, c, g, or t
  misc_feature (52)..(52): n is a, c, g, or t
  misc_feature (87)..(87): n is a, c, g, or t
tggttttgccccccagnaattaaggcttttaatgcccctttgccatcctagnggggggctttgtccaaaaaatggttttgccctccngga

SEQ ID NO: 669306 - DNA, 552 bp, Homo sapiens
ggtccggctactttgcctggtctctctttgtgggttggcccagaggttccccccgcacccgtgttggggagaccttggggcccgcgcctttctggtctggtatatatgctatgatgttgttgttgccttttttaacccaggagggcgcccgtggagttcccccacgcacccaccggtcccctctccactgcccttgggatgcctcaccacaccccaggtcgtcttccattgctctgaggtcccttcaaggcctcccccatcccaggcccaagcccccatgtgccttgtcccgggactgcctgggcccagcgaggggcccaacagagggcgcccacccaccaacctgacggctgggggccccaccccagcccctctcccctctctgctccccagactcacttgcccttgcccggagatggcccccaccagcaccccgcttttcacacagaggactgagttggcaaaccgggcccccctgaaccgcaccccatcccaccaaccccggccttgctttgtctggcctcacgtgtttcagattttttaagaacccca

SEQ ID NO: 669307 - DNA, 861 bp, Homo sapiens
  misc_feature (861)..(861): n is a, c, g, or t
ttctgttttcatgttaatgcatttatgggaattaaagtagttatatgtgtaaagatttttcataatttacaggctgaccataaattatcttttgtatgatcatcgtaattcgctctcttatcttcatagtatgcctattaactttctagcatttatttgaggactttttttttttttaaactttttttccaatggaccaaataagatatgcttattgttttggcggggggtgaaattaaattatctttggagttggctaaagggtgatcactttttttttagaaaccaagttaggtaaaattaacatagtggataaatattcggtggatgggggtcgaattatatctacctctaggtaaaagagcttatctggaaatggtttattggaagatgggctggtagactatcgggttccaatatgtattttcaaaacatttatctgtgataatagcacattctatttgatattaatattatgtataattaataattaaacgggatatgattgatgaccaagtgtggcatattaccacaattattaggcacccctaagtggcgttgtgaggagtttgggagtaagcggaataccaccaggggtgcggacatcactcacacagtgcgcgcaatcatcccggcaaatcgcgaacaccgttactctacagggcagcactaagtaacacacaggggtgctgaaacccaattgtgaaaagccggcagaatggacacacactcaggtagagacactggtccgcacaccctgcgtctttcagacagaccacgcgcgagagggaacgaacaccgccgaggccgagcccatacggcaccacgatcggggccaaaaagcgcaccgatagtcgaccn

SEQ ID NO: 669308 - DNA, 498 bp, Homo sapiens
  misc_feature (340)..(340): n is a, c, g, or t
  misc_feature (491)..(491): n is a, c, g, or t
tgatgcataatcaaagataattatagcaagttgcatcttcaaggagaatgccaacatcaatctcattgaacctctttgaattagtttactatcctataactaaaagaagagatttatagtttactgaagtcaaaaagtgggcttgaattaaggctgcttatattgtataagtgaaatgccagagtattttacttttatgtttctgtggcccaagggaattaaaatagatattatgccctgaatcccagtgtcactgtgactgcctgtgaaccatgtcagaaccaatatcaacaaaggcctcttcagctaagacttcccagtgttagaaagacaagaacangtaggatctctaaagcccttatcataatatgcctacacaatcaatatcactgccacaaaatcatgcagccaggtcactaaggcatctgcagtcatcactaacactgatctcacctggagaagctgtatggagactacaccactgcacccanctaagta

SEQ ID NO: 669309 - DNA, 982 bp, Homo sapiens
  misc_feature (25)..(25): n is a, c, g, or t
  misc_feature (39)..(39): n is a, c, g, or t
  misc_feature (43)..(43): n is a, c, g, or t
  misc_feature (45)..(45): n is a, c, g, or t
  misc_feature (53)..(53): n is a, c, g, or t
  misc_feature (73)..(73): n is a, c, g, or t
  misc_feature (109)..(109): n is a, c, g, or t
  misc_feature (126)..(126): n is a, c, g, or t
  misc_feature (131)..(131): n is a, c, g, or t
  misc_feature (138)..(138): n is a, c, g, or t
  misc_feature (142)..(142): n is a, c, g, or t
  misc_feature (145)..(145): n is a, c, g, or t
  misc_feature (148)..(148): n is a, c, g, or t
  misc_feature (164)..(164): n is a, c, g, or t
  misc_feature (202)..(202): n is a, c, g, or t
  misc_feature (207)..(207): n is a, c, g, or t
  misc_feature (209)..(209): n is a, c, g, or t
  misc_feature (222)..(223): n is a, c, g, or t
  misc_feature (233)..(233): n is a, c, g, or t
  misc_feature (240)..(240): n is a, c, g, or t
  misc_feature (264)..(264): n is a, c, g, or t
  misc_feature (281)..(281): n is a, c, g, or t
  misc_feature (286)..(286): n is a, c, g, or t
  misc_feature (299)..(299): n is a, c, g, or t
  misc_feature (315)..(315): n is a, c, g, or t
  misc_feature (322)..(322): n is a, c, g, or t
  misc_feature (332)..(332): n is a, c, g, or t
  misc_feature (362)..(362): n is a, c, g, or t
  misc_feature (365)..(365): n is a, c, g, or t
  misc_feature (376)..(376): n is a, c, g, or t
  misc_feature (401)..(401): n is a, c, g, or t
  misc_feature (405)..(405): n is a, c, g, or t
  misc_feature (433)..(434): n is a, c, g, or t
  misc_feature (443)..(444): n is a, c, g, or t
  misc_feature (455)..(455): n is a, c, g, or t
  misc_feature (466)..(466): n is a, c, g, or t
  misc_feature (475)..(477): n is a, c, g, or t
  misc_feature (480)..(481): n is a, c, g, or t
  misc_feature (497)..(497): n is a, c, g, or t
  misc_feature (502)..(503): n is a, c, g, or t
  misc_feature (515)..(515): n is a, c, g, or t
  misc_feature (524)..(524): n is a, c, g, or t
  misc_feature (534)..(534): n is a, c, g, or t
  misc_feature (539)..(539): n is a, c, g, or t
  misc_feature (541)..(541): n is a, c, g, or t
  misc_feature (553)..(553): n is a, c, g, or t
  misc_feature (556)..(556): n is a, c, g, or t
  misc_feature (585)..(585): n is a, c, g, or t
  misc_feature (602)..(602): n is a, c, g, or t
  misc_feature (606)..(606): n is a, c, g, or t
  misc_feature (608)..(608): n is a, c, g, or t
  misc_feature (623)..(623): n is a, c, g, or t
  misc_feature (677)..(677): n is a, c, g, or t
  misc_feature (753)..(753): n is a, c, g, or t
  misc_feature (899)..(899): n is a, c, g, or t
  misc_feature (902)..(902): n is a, c, g, or t
  misc_feature (920)..(920): n is a, c, g, or t
  misc_feature (980)..(980): n is a, c, g, or t
tggcgtgaactgcttcctgcagggnggcgatgggggttnacgntnccaagggnccgggctttgccgagatggncaaggagggagcgaaacacttttcaggattagaagngggtgtgtatagaaacntacanggttggnaggngcntgnccgaaaccacgtcggncagcgaggatggaccaagatggaatgagacaaaatggntatcnancacttgggggggnngtttgtgacnaacggangcgagcaactattttaagagagantagaagtacagcatccnggtgnaaaaatgattgtnatggcttcgcatatgngagagcnagaagtgggngatgggacaaactttgttctggtatttgcnggngctctcctggnattagctgaaggggttctgaggatnggcntgggagtttcagaggtcggagaaggttnngagatagcnngcagaaaagcncatgagattcntcgcgtaannnggnntgtggttcggcaaaangcgcnncgagagggtggngagagtctnagcgtctacntcgtncntccataatgagnagncgaagtagtggtaatgaagtatttctggncaagcttattgctcagncatncntatctatttttcctnattccggccatttcaatgttgataacatcagagtttgtaaaattctgggctctngtatcagttcctcttcagtattgcatggcatggtttttaagaaggaaaccgaagtgaatgtaacatctgtcaaaanatgcaaaaatagcagtgtactcttgtccttttgatggcatgataacagaaactaaggggacagtgttgataaagactgctgaagaattgatgaattttagtaagggagaagaaaacctcatggatgcacaagtcaaagctattgcnganactgggtgcaaatgtcgnagtaacaggtggcaaagtggcagacatggctcttcattatgcaataaatataatatcatntt

SEQ ID NO: 669310 - DNA, 491 bp, Homo sapiens
tcccagggggagggaggaaaggaaggagggggatcaaagctgtcccaaaaagggaaagcggtgaggttggaggaggggcaaaaccgggccggcaagaggtggtaccttcataaggtggtatggggggtgggggtcaggccctgaattcgcctactggagaatctgtcgggggaacaacgctcagggggacgcaggaggaagagccagaggggccagaggcagagaagagatggagtcttaggggccagggttgagcgaggggtccaggcctagaggtgctctccggggggcgggggaatgcagccagttgtccccctcccttcttccacccaaagttccagcccgtggtctgtgttttacatccctcttccccacgacagaagaagtggtgggcccgcggccaggtcatcgtgtcccggtgtccctggtatgtaccccaccctcaaccccttcctttggcgcggaccccataacaataaatttagattaac

SEQ ID NO: 669311 - DNA, 156 bp, Homo sapiens
aagggctttggatagatcaacaacgtttcatgttaaactctcaacaagctaggtattgaaggaacatacctcaaaataataagacccatctatgacaaacccacagccaacatgtgggttggctgaatgggaaaatgctggatcagcggatcgagt

SEQ ID NO: 669312 - DNA, 419 bp, Homo sapiens
tcacatgcgggtgcagtaagtgtgaagcatgcgcgatgagagatggcagcgtgttgtaggaatgcgatataggatcacgaagcagcctgttgtctaccatccacgggtgcgctgtgctcagcccgtgtgtctcggggaataatccgggagcaggtgcacgcctgtgcctactcgctaccacgcgtcttctgggaggaagtgaatgagccggttatcttctcagggagggttagtgctggccactgtgcactgccgctgccagcacgcccggtcacagccagtgtctatgggcgactggcgcggctgcgaggctgtctagaggactcctacccttctgctctgagtgcgcaagtcttcctggactctccggctgtgggctgtggtttggaaacgaggttgttcatagaggccgctctggg

SEQ ID NO: 669313 - DNA, 109 bp, Homo sapiens
gaaaggaagactgagcttaggagctggaacagaagcactcgcagctgaccgaggagaagaacctgcttcttggccgccagccgcacccgcatctcctcagcctctgcat

SEQ ID NO: 669314 - DNA, 911 bp, Homo sapiens
gacctaaaatcgctcatgcatactcttcaatcagccacatagccctcgtagtaacagccattctcatccaaaccccctgaagcttcacctggcgcagtcattctcataatctgcccagcaggactttacatcctcatgacatattgcttgcctagcaagactcgagaacttacgaacgcacgtctacgagtcagctatgcatgaatcctctctcaaggaagttcagatagctctactccctactaatagctttttgatgaactgcctgagcaagcctgcgctaacctctgccttagccccgcattattaacctactgggagaacttgcatctgtgctagtaaccacgttctcctgatcaagatatcacgtctcctacttagaggagcgtcaacatactagtcacagccctgatactccctctacatgatttaccatgaacacaatggggctcagtcacccgacaattaacaagataaaatccctcattcacaggagaaaacaccctcatgttcagtacacctatcccccattctcctcctatccctcgaaccccgacatcattaccgggtttccgtcttacgagaaaccaaacgcttccagctactccgaatctgtctcgagaggaccaccagcaaagtacaaattagaggtacggaaccctgtggcgctctccgtctcaccgagagaacttcggcaggaaatcggggagcggcggccccacgggggcagagagacgtagtttccggaacacagcgaatcagcgggtggtctccccatgaaccgcggggcccggtttccaccccaggttggggcttggctccaagagcaggcgcaccccccacaccaaagacaagaccgtctaaccgacgaggaacacactcacggagaaccatagcagaactagaaaacg

SEQ ID NO: 669315 - DNA, 944 bp, Homo sapiens
cgaataatagtgaatatttcaggctttagaagcaggcatttatcaatgtttcataaaccctgggtggcaggtaagtcagtatataataaaattagaaggatccatgaagcccctgaaaagatataattttttatgtatgtgtaatttctttctgggaaacagtccaaacgtacaaaaagcaaaccccttttccccccacctgtataatattgtctacttcctagtgtgtaaacaaagaggcatcttgactgccgttacccgatctttggtgagaccagagaacagatcttccttgaaatgccagtggcttgccaccagtagggatttaaaaggatgtcacaggcagagttccaaaaaggttttaactgaagtcttagcattagaataaatgagaacctgcctcctcccatcacagcacacaagcaaaactagttaaagtattaaaaacaaagtttagatttattacttgcagaattagggttataataaaactgtaacccctttcaatgtgtgagtacaaatttaggtcttctccaggaatattaagtactgaggtgagttccagagaagcttgatctcctcaatgggatatgtgtaacatgtaggtaagcctacctttgcaaatgtgcagggatgacaaagcaatggtttactagcgggacatacctatctcgaccatctacttaccgtgatatgctcatgtgaagagctaccttttgcaacatgcagatgggcaagttaacccaggaaagctggccctaacaggtgccaacactggtatgacctgcaggatccacagggaccccagtgaagacaatacagacgcagaacacagatgatgcccagcaagccaaaccactaaagaaggaaaaacgataacaaaaacgtaaaagccacaacctcgacaagaaagaaccaaaaacaacacaccaaggagaaagacg

SEQ ID NO: 669316 - DNA, 1004 bp, Homo sapiens
ggcatcttggcagtctctatgcctgtctgtgatgtgtgtgtgcacgtgtaactacacacacacacacacacacacacacacacacacacacacacacacagctatcacacatctcagagcctaagaaataggactaagcccagaaactcctagaaatcacctataagtgctaggcatagatggaaattagtgtgttccaccagaagcacagctccaaatctatacctaaaatatatttcgtgcacttcccaagagacctggacttcaaactttcccagtggagccgtgattatagaacttgaggggtcctatctcaggatgaagggggagacggccctggcttcacggggaagggtatcccagcattgttcgtgcttcacccttgagtgcgttgtcgtggcagtcgtcgtgtgtgcgtgccagggatattatagtggaacgtggagaagtgggacgtcgggtctctgaagctagagtctcactaattagatgtctctgtacgtgagaactattgacgtgtcgtgcaggtccatatagctaagcgtgcaggaaaaacactattatcttccaaaacttacgagagcgtgtgggagaaccctttcgtgagcgttctcttctcagcattctctcgtgcctcccagaggctggcagccagagacactgagagcatcagcagtgttctaacccatgcacgcagggcaggggctgacgggccctccacaggctttcggggagagagcaggcagggggtaggagccccttcggggtgcaagccctggtggggtgctctgcgggaactcattggtgtgagtgacgactccacagggcggtggcatggataccaacagaggcgacaaccaattagttctgaacggggacagagaatcaggccgcgggcactcaggaggaggtggcaaaagcccgggaagaaagcagcataaccatgtggccacggggggcccccaagagaggggtgacccacggcgggggagaaaacggacata

SEQ ID NO: 669317 - DNA, 858 bp, Homo sapiens
tacataagttctactatcagtatacttggcagcatgactttcttttttcttaacagtaaattaagtgaaattcagcaccattggtaaatgatagtatttggtaacaacatagttactggggtgaaggagtaggggagacactcagtaaccatctatttacctagacacttatgcaggggtacatgctaggtggcttaatccaaattcgggctcacttgggaatcacattcagtgacttggagtctgaatggcgtgtgttagcatcaagagcatttaagccaagtgcctgggtgattgagcgggaaacgtattaaaacctcattggggttgaaagctttcccgaaagtgagtgcataattaattagcacttcgtgcctttattccgtggagtaactttaagaattgagtcacgatatgactagtcataaaagtccaaaatttccggggttaaccttgggtttaatttgccatatatatattcacgtgtcggccgtggaaatagcctgggttaacctaatttatggtatatgtaaaactatcatattggatttaattccaatatatatatgagggaaaagccagaatgtctggcagaattcaatctccctgggatctctagtctcggtaaacatatcaggttccattcatcaaatttaactactgtagctctgggatctcacttccatttctggtcaaataaatggtcacttatagacacagtactgtggccacaattaagctcaaagaaatccccatttattaaaggtgcccacgtacaataacccttaatttgggcaaatgggaggtttaccaagtaaagattcactcagtacgcttactagaaagaacatctcagaa

SEQ ID NO: 669318 - DNA, 107 bp, Homo sapiens
ttgaggttgcgcaacacgggttgcgctcgtttgggcaggagaccccctgtacatcgactgggagtaccgccaccctcacccctcggcgcgcgccgtgcagcgcttgt

SEQ ID NO: 669319 - DNA, 87 bp, Homo sapiens
  misc_feature (29)..(29): n is a, c, g, or t
gccggcagtccccctggcccgggcatttntgggacaggtcctagtccggcgacttcctaatggcacagaactccgaggccgcatcgt

SEQ ID NO: 669320 - DNA, 119 bp, Homo sapiens
atcttcggtggacgacccccatcatctgtggttttctataaagcaaccctgtatcaggagatctgtgtcgtatcttctctttagcaagcatttgtgcctgcggggtatcctctagtagt

SEQ ID NO: 669321 - DNA, 198 bp, Homo sapiens
actgaatatcgagcagtaacatagacgatttccagtatcctgctgcgcgccgggtcggcgccggcaacacgcggcgactgaggaaaatggcgatccagccagtcaataatcgccagcgactggctgagagactcaccgtcgtccgtgagcagcgtcggcaccagtccgaccgggttcattcgccgatatgccagctca

SEQ ID NO: 669322 - DNA, 251 bp, Homo sapiens
ttcgattgggggcacttagcaaacgctgtctctacaaaaaaaaaatacaaaaaaattaaccatgctgtggtgggcatgcttaagatccagctacttctgtggctgaggcaggaggatcgcttgacccaggaaggtcgaggctgcagtgagccatgttcacgccactcgactccagcctgggggacaaagtgagatcctgtctcaaaaaaaaagtacgggattatcagactgaatttaaaaacaggctctaa

SEQ ID NO: 669323 - DNA, 167 bp, Homo sapiens
  misc_feature (161)..(161): n is a, c, g, or t
ctcacaggccggacagtgaaaatacttcagataaatcccaatagagaaagaaaaagggaggcaataatggaaaaaatagaagaaacagaaagaagaaaaatccatgtaagtggcagaatttcaaaatttctgcattcacgggagaagtgcaaatatatagnagcacc

SEQ ID NO: 669324 - DNA, 362 bp, Homo sapiens
gggcatatgacagggaaagtcgacatagatgttgcccccagtaagactctagggttgcaccaggaagtgctcgaacgagcgatctccatctagtcttccatgtttcaccacggtaagcttcatgtaacgggatgtctgtgcccgttaaggctatcaatgaggcctcgaaccttctcggacagtggattatccagaactggcacgaggagtcaaaccactggtgatctgactgaaggaggagacgctgaacaggctctggacaatcaccctgttggacgcttgctcccacccagaggaagaggttgagcccattctccagtaaatatatatccccattgcttagacgctcttcagaggctcga

SEQ ID NO: 669325 - DNA, 616 bp, Homo sapiens
  misc_feature (611)..(611): n is a, c, g, or t
gtccatagatgctttagggcaggcgatctatgtatactacgttgctgtgatcagtgttatgaatgaagctatactgatatcagatgcgagctgacatctaggtctggattgggatcagatgggctaataggaagggcggagtctgtacactccatcctggtggtcaatgccatggccaaagtctgaataccttgtgtggcatagagaacttgacgatcaagaacagtgtctagagacttcctggtgtactgtaccagacactatcgggaatgcttccatatgagactgcttataatctgtatttgatactgacggatgacaggcacatgaaagtggcaagagaccccgacatgacagtaatccgacgatcagtgtattcatgactctgtagaaattgaatgaactgactctctcaagattactgagctgaactgagcacagctatgcctgtatacgtgcgtatataatcgactgatgacaggtaagaaggctgcactgagtcttactcgacagtatttcagtatagcacgtacgtgaaacatatgagtgatgcagtaactagtacgatgtgaatgctatcatttcggatactcccaggattttagactaantctgg

SEQ ID NO: 669326 - DNA, 128 bp, Homo sapiens
ggtcgatggaccttgcctcagtgaggagacaggccacgcttcaagtgctgcagctcactgatttcctcctctagtttccgcacagtgcccaccagaagtctgtccgcccagcctggcagaaggccgac

SEQ ID NO: 669327 - DNA, 939 bp, Homo sapiens
gtccctgccctctcccgtgctctccatcttccctttcctttccctctgtcttttactctgtccatacccgcttcctgcctgactctctgcccccgtgtttcttgacatccatgtcactccccttcggccaacttcccattccccacctctccccgtccgtgtccctccggcactgctctctgtcctttctcggccacccgctggcccccctccgcccaccctgcctgcccccagggcaagcgctgctatcctcgatgtctcggccaatgccgtgcggctggctgcaggcggccatctgcacctccatcgccatcttcatccgcccccgctccctggagaatgtgctgtgagtatggtccggggggcctcccctttgctccccccaacactgtgagcctgggcctcacaaggcgtctgcgttcaaactactcccttcagaaacctggacagcgttttcagcaagaccctgagggggatccctggaacaccaagaggatgtggcgcggaatcgggtctatacacccatcctctcctgacttggcgtagacaaggactacatttcccagccagacccctggaggcataccaactggggcgagtcaagaactctaggcgcctgttgggaaatttggagtccgaaaatcccatctctggaggctgaacaagctagcaaaggatagaaagccccccgataagaatagtccccctggaagtaaaaccacacccagggctgaggacgggattgccgggatggcaacgagaggtagacggagtgatcacaatcagcggcccccaggaggaaaaaagaggaaatagaaataaaaacgcaaatgtgacacaactcgaaagaaaaattacaaatcccggacacacagacaaataaaaaccacgaccacagaggagatccacacccgacggacctccacccataaacaagaa

SEQ ID NO: 669328 - DNA, 114 bp, Homo sapiens
aactcttccaacctgagaaaagacttcctggctttgaaatggaaacttacagcagagagtcacaggccacggcaacaacaccgacagcaccaaacatttggattattattctca

SEQ ID NO: 669329 - DNA, 183 bp, Homo sapiens
cttcaagtaattctagtctatagtaaataattaacgttaaccccatattcaaattctagaccgcatacgggggcaccaaatcatctctgccaattctaatgatactctctactctcttagaatcaactatattaactcaatccacgcagcatctacattatccgtagagatgaaatggtagaa

SEQ ID NO: 669330 - DNA, 805 bp, Homo sapiens
tcttttgtacgcccggggttatggatatcgcgacccaggcctcggcagcgggtgcggcgcgccgacaattcgagagccagcgagcgagcgatgcgagccgagccgagcctcccgccgtcgacatgggccagaacgacctgatgggcacggccgaggacttcgccgaccagttcctccgtgatcacaaagcagtacctgccccacgtggcgctgcctctgtctgatcagcaccgttcctggagtgacggcatccgtatgatggttccagatggagacgagcagacgcgactacatcgacaccacctggaactgcggctacctgctggacctcgatccttcgtacttcctcaacattgcatgggacagctgactggatgacgtcactgggtgtagagacaggaactatacgtgcagataacgcctgcttcagggctctattggaactcatagacatactgacagaacgacttgccatacagacattaatatagggacttgaagttaaaagatagagagaacctggaccctgtggcaggaggacatgatatgctgctcctagcagtaatccccgtactgaagggaacgagcaatgtttcgcgggacgtccccgacacatgacgatgaagaggctcccaccgaagacaaggtaccatgcaacgcatcggcagtgccagggatcctctgcctaggtctccgtgaatagtaacgcatgaaacccatccctcttcacctgtatgaagcgcacagctatcataactcatatttgatacccgaacccatcgtagggacaccagaatcctaattc

SEQ ID NO: 669331 - DNA, 264 bp, Homo sapiens
atcttctccgataatttcatactctgcctcattatgcttcctcagcttaggatatataaggtccttttcaattagctaatgcataggaagtttattacaaccatttactgccttacaagatattctttataggagcactacttttcgttaggatatgctgctaccagccttattctgtcctctaacttaagtaccctgaccagtgacactatgaagcaaccactcgaacaggttggtcttttaaccagcactgggtttcgatgg

SEQ ID NO: 669332 - DNA, 171 bp, Homo sapiens
agtacgatcgagcgaggaggaataaaaccacaaaaaataagttagcttaacattatactacaaatagaacagaaatatagtacctaactacaggtgagataacagtaatcacaatacattgatagataagcctgtatagcagataatacacatactagttctagtaccaac

SEQ ID NO: 669333 - DNA, 526 bp, Homo sapiens
  misc_feature (90)..(90): n is a, c, g, or t
  misc_feature (108)..(108): n is a, c, g, or t
cgggctctggaccagttttcccctgtggtggaggccaaactgataaaacacaaaaaggggattgtcaatgaacagttttgttgcaacggntggcagacggggccatcnacctttataccatggtggtggttctctcaagggcctcaaaatcccttagtgagggccaccccccggcccagcattaaaaaattctttgttacacctggtgtattgaggctacagctcggatccaaaagggcatggccccccttcagttttacccctggcaacaaaagtttttccccaacttcaaaagcatttccaaggccttggtggaacggggtggtgtggtcaccaacaacccccttggttttttaatactcccggccagggcctgtcccagttatgtgccttccctcaaaccaaaaccgaagcccctttccttaaggccctggtttgtcccaaaagggcctagtgttcccaacactgtgcctgctttcaaaagccctttttgcctcgcaaataataaaaatttttagcccgtcca

SEQ ID NO: 669334 - DNA, 349 bp, Homo sapiens
gcccctgcttggtctctgtaccttgtgtgctcacaacggcgtgcagctctgagatgcgcactccagtgatggtgatcataggttcaaggatcccggcgaccacaatttgatgacctgcctgtcgatagctttcgctcacaatcgacagaatcgctcatcagatgatgatgttcaactaatgcatgcggtcactgcctgtgcgagaacacgtgccggtgctgtgtcaattacatctctactggccacctactgtgagagctgatggctgatgagcaacacacgcctgacattgagacgctggtagcagccactacatgactgatccacctgctcagactgatcataccct

SEQ ID NO: 669335 - DNA, 106 bp, Homo sapiens
cgtcacttttcttgggacgtgtgtctgactacggtctcttacacgggactgtggttcaccggaactttaccactttggggactcctctacgacgtcgacctgcacg

SEQ ID NO: 669336 - DNA, 1296 bp, Homo sapiens
tctcacaatgcaggcgccccagctctgacacgtgcactttcttttattgtggaaaaaaatataaagcagctcacgtgatgtgtgtggcaggggcaggacacaagcagctgtgccgctcctctcctctcccaggcgtgtgccgtggcatgtggctcgcaggggaagcgggtgtgccgtggagagtctccgcgggtgaacccacccagcgggggccaacaacgtgagagggaagctgtgaaggaagccgcggggccccgcgccgagcctctcctgtggaatgcctcaggcggaactcggtgttacttgtgttccccactttctttttctcgagggggctcgtatgaggggtctcccccaaggggggtgtggcggggggaaaaaaagtggtgccggtgggttaccttatctctcgttacacccagatctctctctacgaggcaaaccacactccttttgaccctgtggcattgtgggagaaaccttcctatcctctttttctttcccaaaagcaggggggggcgtatcccaactgtgaaaaaccaaaaccgcgggcccacaactattctgtctcctgtgttgtaaacaccctattcaaaaagagttttgttcgacacagaaccagtgtggggctccccacaacatctttatcaccccccgcgggtggccctatgtggtgtggtgacacgggaagtgaacaaaagtctcaggatagaaaaaaccctgttggtgacaactgggtgtggaggagcggggcaattgacaatcacaaagtgctccctctccctttgtgcaactgtttccccatttgtgaagctctgtgtgtctccccaaaacccctcttgtgcggggaaaactctaacaaggtcttccctcgtgtgaagaagctccttttacccgccaaaaagaggatattactgccggaaaaagcgcaccactttatacgtggcgcgaggctgaaacaactgctgctgtttcacctgttgtggtgtgtgttttgggcccctcttattttcatacctaattatcgttgggaaatcgtgtggatccccgcacacgggttgtggccccccagagagagcggacaatattccccccaaaagataaaggccgtcacacaaacggtggaaggaactccctcccagaaaatacactcccttataccaaattcttctttgtagaaacttccttctgcgcctccctagtggagagtctgagggggatatattcccccacaaacctctcccctgttagcgcccctacaaaagtctaacaaattatttttatacgagcccccga

SEQ ID NO: 669337 - DNA, 332 bp, Homo sapiens
  misc_feature (36)..(36): n is a, c, g, or t
  misc_feature (123)..(123): n is a, c, g, or t
ggaaaatagggcctagaaacagggaacttaaggccnctctgtgctaacttcctaaaagagaaaacaccagggtctggaggcaggaaatctaaggccaattcactctgacttcccaaagctggntcaaaaggaaaataccggggtctgggggcaggaaacctaaggctgattaacacaaacttcctaaagctaaaccaaaagacaaaaaccccatctttccatgctgagtaacaaaggttcagaggctactctccctacaaccatccctcttccaccacatctcagatggaaagggaggggagggtgccttgttgaccatgggccaagcaggg

SEQ ID NO: 669338 - DNA, 1712 bp, Homo sapiens
ggacgcgtgggtcgacccacgcgtccgagcaagcttagtcctaaagctgtacttcactgcaacgcagaccatcgggaattcctgctggcacaatcggactctacttcacgcaggtggccaactaatcaagacaacactggcgacttcgacgcgactggactcacgttcatgacacacagatttcgtcttcctgcaacagcagcacgaaacacctgctccccctgacagaacagcacgccaccaactgcctttgacacacacgaactgacggccactacaggacagcccacatgactgcccgtggccaccaggcaacgcggccaactgctcaccgcgctagcactgaacaacggctgcacacttctcacacctctccaataccctgctcctacacacaccgctgcgcactgcgccaacccctcaatactgcccaccctctgcacctgccgaccgacacgtgcccctcaacacacgcgctgcaaaaccgagtgggcccgcccaacgctctccacgaagcgaccacccccatgccactgaaagcgcacgccctggccccacggcgctcccgccacgccacgaaactccacccccgcagaccgctgaacgccacacgggcaagcaacagcgtcccgccgtcctcccttcatgacccggatgcgccaccccctccgtgcccacaggcgccacgccccctaaactggccctccctgccatggcacgaccggcgcaccctccaccgccccgcacgctccccccccccctgcaacacccccctctccacacaccactgccacccccgacactacacagccttacgcaccaccccacgcgcacaagatgcccaagactccccacacgcaacctggcctccaccacgctacccatactgcgcagacaccacacaccaacggcccgtcgccagccacatcccaggagcaccctggcacacacaacgcacacggccacagacaccacaccagtccacagcgcccaaccagaccaccgacgagcaggcgccaacccgcaccacccgccacccgcaacagcccacggaacgcgagagcccaccacgagccgctggccacacacaccaggcgcgacccaacatagcaagcggcagccgcaagaacgacatcaacacgccaaactggccgcgcaaaccgcacaattcccatacgccccacacggctaagacaaaagagtccgatagcgacatgcaacccacgcacacaaaacctctagcacaagcgcgcatctaccaccacttcggcgacaccacccaccgcacacgccccagcaccctgacgccaccacctacccacccacactgccgcacgcccgccgacaaacagacgcagacgacggccacccccaacccgcgcaccacccccactcccgccaccccgccgcgccccccacacccaccaccccacccaccccacccaccacggcgcgccgcacccatcgccgaccgcccccgccgccaccactccccaccacgccacacactccgcccccaccccgacacacgccgccacaacccacacacacccgctcagccaacccaccagcgagcaccacaccccacgcaccaccccacgacgcgacacaaccacccccctccacgcacccaaaccgcaccaagcacacagcaacgcgcccacaccccacccgccctgcaccaccgcccgcgccacgcctcccccgccacc

SEQ ID NO: 669339 - DNA, 343 bp, Homo sapiens
gtgggtatggggggtctctcagtctgctgctaacatcttggttgactcccaagtctctatgcaaccctatgttaccctaccaggcgagcacgaagacacttctctatagagtcccactgcctctttgtactgtgtgcccattaattaaattttgggaaacagagtccttctcctcccctgatatgagtgcagtggctatggacaggactcactgtggcgtcaccctcctggctcaagcgatcccgcctgcctctggagtagctaaaaccagaggcgtgcaccaccaaaacctaactaatatatggtatatagtaaggacactggtctcactgacaacgggctt

SEQ ID NO: 669340 - DNA, 394 bp, Homo sapiens
  misc_feature (17)..(17): n is a, c, g, or t
  misc_feature (73)..(73): n is a, c, g, or t
  misc_feature (169)..(169): n is a, c, g, or t
aaggtttttgggaaggnaggaataataagacctaggaaaaggaaaatgcagagcagtaaagggtttagatganaataagaaaagagtccgggcacggtgtcttacgccctataatccctagccaatttgggaggccgaggcaggtggatcgcttgagtcccaggagttncgagaaccagccctgggcaacatggcaaaatcctgtctctacaaaaatactacaaaaattagcccaggtatggtggcatgtggctgtagtcccagttacttggaaggctgaggtgggaggatcacctgagcctggaatgcagaggttgcagtgagctgagattgcaccaccgcactccagcctaagcctaagtcaacagagtgagactctgtattaaaaaaaaaa

SEQ ID NO: 669341 - DNA, 389 bp, Homo sapiens
gaatgcatagacatcttaagctggtagcacttcccatcttcaacttccaccaaattatttcccactgggtagagtgctattgcttcaagagtcagtatgtcaaaatgaaactatcttctccagactacatcctctttgaaaaccccccatttctgtctgtggtcccatcgttccttcaatttcctacgctagaaatctcatatttcactttagtaagaactgttatttctatcaccactacatactactatagctagaagctgccactctgctgtgtgccacccatggtgctggctggttcagttattttgcctgaaggtgacaacaaactggtaaatggaagagctggcacaagttcatttaaatgtgtgtttgtctaaatgcaatca

SEQ ID NO: 669342 - DNA, 229 bp, Homo sapiens
gacgaataacattgttctaactgcagtacattctcaatacaaagtattgatactcaggcatgaaagctgcatgtgcatgtaggggagagaaggaggtttcaccagactgacaaatggagtcatggttctgggaaggagcagggtgttgggtgcacatttgtcacctgggaatactaccagcaggggtaccgaagctctgaatatcggtaatacattggggcactaaacc

SEQ ID NO: 669343 - DNA, 827 bp, Homo sapiens
tgtactttttgtagacatgaggtctcgctatgttgcccaggccggtcttgaactcctagctcaactcatcttcctgtcttggcttcttgaagtgttgggattacaggcgtgagccacctgtgcctggcctattttttatttgtaaatataaggggtacaagtgcagttacatggaaacactgtgtagtggtgaagtcggggctgtcagtgtagccatcaccagagagcgtacatcaaacgcaccgggaactttctcatccctcgccccaccctcctgagcatccacgggtgagtgttccccactctgtgtccacgtgcacacatcatttagctcccacctgtaagtgaggacacgtgctctttgtccttctgtttctgaactgtttgactcagcactatgttctcccgttccatccacgttcctgcaaagggcacaattgtacactttttcatggctgaatagtactccatcgtgtatatgcaccacattctctttctccagccgtctgttggtggagccctaggctgattccgtgtctttgctgttgtgaacggtgctgtgatggacgtgcacgtgcaggtgtctttttgatgtaatcatttccttcgagtagctgcccggcagtgggattgctggatgagttctgttttcagttctttgataaatctctttactggggcagtgggattgctggatgagttctgttttcagttctttgataaatctctttactgtgctccacaggggctgacaatattcccggtgagggttgggagacgcaggtgtgtgcacgtctccagaactcatctcacggaactgttagatc

SEQ ID NO: 669344 - DNA, 873 bp, Homo sapiens
  misc_feature (837)..(837): n is a, c, g, or t
tgcgcttggcggatggccgtccatccgggacgctccgttctttcctgtgcctcccaggcctcctggcgtcccggtccgtgcaaggaaatggttgaactgtgcagaatctctgtttctgcccctttggcatatcctcaacccacccgggttctggagaaaggctgtacggaagtcctccttctccgctccgggcgagtccagtccgctgtctcgggatgggagtttgtgtgtggtcaggccccgtgctccggccagccgctccctgtccgggaggtgacggggcgcctctgcccggccgcccctagctgggaagtgaggagcccctctgcccggccaccaccccgtctgggaggtgtgcccaacagctcattgagaacgggccatgatgacagtggcagttttgtggaatagaaacggcgggaaaggtggggtaaagattgaaaagattgagaaatcggatggttgccgtgtctgtgtagaaagaagtagacatgggagactttgtcattttgttctgcactaagagaaattcttctgccttgggatcctgttgatcggtgaccttacccccaatcctgtgctctcatgaaacatgtgctgtgtccactgcagggttaaatggattaagggcggtgcaagatgtgctttgttaaacagacgcttgaaggcagcatgctcgttaagtgtcatcaccactccctaatctcaagtacccagggacacaaacactgcggaaggccgcagggtcgctctgcctaggaaaaccagagacctttgttcacttgtttatctgctgaccttccctccatatacgtcccaggacctgccaaatccccntttatcggacggccagatatcagcttacttttgcta

SEQ ID NO: 669345 - DNA, 407 bp, Homo sapiens
  misc_feature (286)..(286): n is a, c, g, or t
  misc_feature (322)..(322): n is a, c, g, or t
  misc_feature (343)..(343): n is a, c, g, or t
  misc_feature (359)..(359): n is a, c, g, or t
  misc_feature (363)..(363): n is a, c, g, or t
  misc_feature (381)..(381): n is a, c, g, or t
  misc_feature (390)..(390): n is a, c, g, or t
  misc_feature (399)..(399): n is a, c, g, or t
ggcggcccaaaggcaactgtgggggctccaaatttcctggggggggtcagggtagaaaaagcccctccatcccgcccttcccccagcattcctccattttagatagatgggactctccaaaggcccttccaaagggaacccggcctactgagcggacagaatgatgcccaaatattgcttatgtctttacatgggattggaatgaaaatttgctttaatatagctatccttttttttccaaaattacttctctctatttggaatttaattaatcgaaatgaatttntttgaatataggaagcatatgcccacttgtaatttntaactccttatgtttgaaaanaaacctccggtgtganatanacaaatatatttaattgngtcatattnaacttttgntttcccca

SEQ ID NO: 669346 - DNA, 130 bp, Homo sapiens
gagtcgtgtaggagtttcctgaagttgacggtgattgagccacgtggatactgaatgcgcggtcttcacacatcccagccgttgactgcagtgagcactggaagacgcaacgcagatgaggagtatgaac

SEQ ID NO: 669347 - DNA, 831 bp, Homo sapiens
  misc_feature (112)..(112): n is a, c, g, or t
  misc_feature (116)..(116): n is a, c, g, or t
  misc_feature (149)..(149): n is a, c, g, or t
  misc_feature (189)..(189): n is a, c, g, or t
  misc_feature (208)..(208): n is a, c, g, or t
  misc_feature (228)..(228): n is a, c, g, or t
  misc_feature (237)..(237): n is a, c, g, or t
  misc_feature (270)..(270): n is a, c, g, or t
  misc_feature (277)..(277): n is a, c, g, or t
  misc_feature (281)..(281): n is a, c, g, or t
  misc_feature (312)..(312): n is a, c, g, or t
  misc_feature (329)..(330): n is a, c, g, or t
  misc_feature (332)..(332): n is a, c, g, or t
  misc_feature (385)..(385): n is a, c, g, or t
  misc_feature (396)..(396): n is a, c, g, or t
  misc_feature (401)..(401): n is a, c, g, or t
  misc_feature (427)..(427): n is a, c, g, or t
  misc_feature (646)..(646): n is a, c, g, or t
  misc_feature (657)..(657): n is a, c, g, or t
  misc_feature (661)..(661): n is a, c, g, or t
  misc_feature (667)..(667): n is a, c, g, or t
  misc_feature (670)..(671): n is a, c, g, or t
  misc_feature (675)..(675): n is a, c, g, or t
  misc_feature (683)..(683): n is a, c, g, or t
ggggcatgaatatcagacgctagggggacagccactgtgttgtctgctaccctcatcctggtcactgcttctgctataacagccctaggccaggaatatgaacaagtctgcntgcntttggatctcgtgtcctcaccagcctcctgtgnaagccttgtgctcacacagacctcgagtgggaaggtgttngtatttccgtagagaatcntgtatactgatcatgtaaanttgatcacnaccgctggagaagcctctacagaacttttaccnttgtgtngtcngagccgtatagtgatctctctcgtgcctacngcctcttctcctacaannanccaaggcagggataatgagctactagtttataaagaaagagttggagagtatngtctatacatnggaangacacaaagttacatccaaagttatngaaaaagttcccgggtccagtgcacatctgtgtgagctgggagtcctcatcaggtattgctgaatgtggatcaatgggacacctgtggtgaaaaaagggtctgcgacagggttacttgtggaagctcagccaagattgtcctggggcaggaacaggatcctatgggggcaagttgataggagcagccttgtgggagagattggggattgtacatgtggnctctgtgctgncccnagaaantannctgntgctatanggtaccatctcctgcactatctggactggagggtccgacatgaactcaaggcatggaccacaaaccttgggggggaagaggtcgaccagagacgctgacataatgcgcaacaactgtcacacctgcaaaaactcaaccgctatagaca

SEQ ID NO: 669348 - DNA, 245 bp, Homo sapiens
  misc_feature (38)..(39): n is a, c, g, or t
  misc_feature (104)..(105): n is a, c, g, or t
  misc_feature (132)..(132): n is a, c, g, or t
aacttatgtagcgcatgtgactttgacatgtacacctnnaatggcactatttttatttggactatttttctataacacggtaggtagccctagaaaaagaggtnntattttgtaaacaatcatttgtgaccncagccattctctggttaatattttggctcacagcagatacttgccagatcatgtatgaggggtggtgcatgttgaattgaaactggcataaaactgcctcctttgtcttgctc

SEQ ID NO: 669349 - DNA, 901 bp, Homo sapiens
  misc_feature (112)..(112): n is a, c, g, or t
  misc_feature (116)..(116): n is a, c, g, or t
  misc_feature (149)..(149): n is a, c, g, or t
  misc_feature (189)..(189): n is a, c, g, or t
  misc_feature (208)..(208): n is a, c, g, or t
  misc_feature (228)..(228): n is a, c, g, or t
  misc_feature (237)..(237): n is a, c, g, or t
  misc_feature (270)..(270): n is a, c, g, or t
  misc_feature (277)..(277): n is a, c, g, or t
  misc_feature (281)..(281): n is a, c, g, or t
  misc_feature (716)..(716): n is a, c, g, or t
  misc_feature (727)..(727): n is a, c, g, or t
  misc_feature (731)..(731): n is a, c, g, or t
  misc_feature (737)..(737): n is a, c, g, or t
  misc_feature (740)..(741): n is a, c, g, or t
  misc_feature (745)..(745): n is a, c, g, or t
  misc_feature (753)..(753): n is a, c, g, or t
ggggcatgaatatcagacgctagggggacagccactgtgttgtctgctaccctcatcctggtcactgcttctgctataacagccctaggccaggaatatgaacaagtctgcntgcntttggatctcgtgtcctcaccagcctcctgtgnaagccttgtgctcacacagacctcgagtgggaaggtgttngtatttccgtagagaatcntgtatactgatcatgtaaanttgatcacnaccgctggagaagcctctacagaacttttaccnttgtgtngtcngagccgtatacgatgatgctcgtacctcgatgccctactagtccttcgtgtcttaccctaacgaattatccacagaggtcgaagcggtatacactggatgctagcatagttggataataacaagaaaacgagtgtaggtagcacgtcattaggtctactatcaattggggaaaggacagcaataagtttaagccattccacatagatttattcgcataggagtatcccgggtccagtgcacatctgtgtgagctgggagtcctcatcaggtattgctgaatgtggatcaatgggacacctgtggtgaaaaaagggtctgcgacagggttacttgtggaagctcagccaagattgtcctggggcaggaacaggatcctatgggggcaagttgataggagcagccttgtgggagagattggggattgtacatgtggnctctgtgctgncccnagaaantannctgntgctatanggtaccatctcctgcactatctggactggagggtccgacatgaactcaaggcatggaccacaaaccttgggggggaagaggtcgaccagagacgctgacataatgcgcaacaactgtcacacctgcaaaaactcaaccgctatagaca

SEQ ID NO: 669350 - DNA, 517 bp, Homo sapiens
  misc_feature (150)..(150): n is a, c, g, or t
  misc_feature (469)..(469): n is a, c, g, or t
ccctaaccaggttgtactaggcgtataccttgactgctcaggctggataagctctacattacagtataggtgaacttggaaagctagacagtcatcctcagagttgtgagacctatgtccaggtgagatgatgagaggtgttcctatcgngataaagctttgtccagctcatacttggagatgtgtctgtcaacaccattggccagctgcttcaggtcatcttgtgtctaggagcagaagccagttcagtcatgggatatgtccacatctagaccatagtggctatcctgtgtctccccaggtacccggtacacgatctcgaaggatcatgagtgttcttggtcatcctgaggcctcttttcggtttccggtgctggtttgatggtgaccttgaggtcgactttattacaggtgagttgatctttggccttagcatggtacattgtcaccaccgacaaggtgccttggncttttccttcagctgtgactgtgaaaccctcattttccttggtctctc

SEQ ID NO: 669351 - DNA, 336 bp, Homo sapiens
tcactttgattgtggatcagagtctgacttgagtaagttttgggccggagatgacgtctgggacaggagttgggcctggagaggccacgtgaggcataagctgcatgtagaagaggccagtgtgaggcaagacctgggcctgtctaggctgctgggagacaggcaggaatctggccagggaaggtttgcatgagacaaaagttgggcctggaaaggcccttgtgaagcattgagcttgggctaaaagaggccactgggtgggcaggagctggggtggtgtaagaaagctggtgaaagggtttgggaggcttggcttttggggggggtcccacagtt

SEQ ID NO: 669352 - DNA, 537 bp, Homo sapiens
  misc_feature (4)..(4): n is a, c, g, or t
  misc_feature (8)..(8): n is a, c, g, or t
  misc_feature (14)..(14): n is a, c, g, or t
  misc_feature (17)..(18): n is a, c, g, or t
  misc_feature (20)..(20): n is a, c, g, or t
  misc_feature (24)..(25): n is a, c, g, or t
  misc_feature (29)..(29): n is a, c, g, or t
  misc_feature (32)..(32): n is a, c, g, or t
  misc_feature (36)..(37): n is a, c, g, or t
  misc_feature (39)..(39): n is a, c, g, or t
  misc_feature (45)..(45): n is a, c, g, or t
  misc_feature (52)..(52): n is a, c, g, or t
  misc_feature (72)..(72): n is a, c, g, or t
  misc_feature (77)..(77): n is a, c, g, or t
  misc_feature (81)..(81): n is a, c, g, or t
  misc_feature (107)..(107): n is a, c, g, or t
  misc_feature (145)..(145): n is a, c, g, or t
  misc_feature (162)..(162): n is a, c, g, or t
  misc_feature (168)..(168): n is a, c, g, or t
  misc_feature (173)..(173): n is a, c, g, or t
  misc_feature (183)..(183): n is a, c, g, or t
  misc_feature (206)..(206): n is a, c, g, or t
  misc_feature (211)..(211): n is a, c, g, or t
  misc_feature (240)..(240): n is a, c, g, or t
  misc_feature (309)..(309): n is a, c, g, or t
  misc_feature (317)..(317): n is a, c, g, or t
  misc_feature (415)..(415): n is a, c, g, or t
  misc_feature (453)..(453): n is a, c, g, or t
  misc_feature (477)..(477): n is a, c, g, or t
  misc_feature (481)..(481): n is a, c, g, or t
  misc_feature (508)..(508): n is a, c, g, or t
tcgnaaanctaaancannanaatnntatnaanccannangtggancttacantgaaccgaaaccgtcccacnacacnccancctgaacaacacagcagacaccatcncgaggaaaaaaaaataaaacagacggcctgcggtgagnaaactgggcgcattttncgagtncaggngaattagccncaatcccccgtgttcacttggcncccanagccctcttgatggatcacgtaaaactgnaaggcagcggggagcagacaaagatgaggtctacactgtccttcatggggattaaagctatggttatantagcaccnaacttctacaaaccaagctcagggccccaaccctagaagggcccaaatgagagaatggtacttagggatggaaaacgggcctggctagagcttcgggngtgtgtgtctgtctgtgtgtatgcatacatatgtgtgnatatatggttttgtcaggtgtgtnaatntgcaaattgtttcctttatatatgtantgtatatatatatatgaaaatatatatat

SEQ ID NO: 669353 - DNA, 338 bp, Homo sapiens
ccaggcgagatgacataaacttatacctagtaagaggcacagcatctgcagattttccactgacactcggaaagccggtggccaggaacagaatggtacacagcaaagtcatagttgatggcatatgcgtgaacttcgaagctgagcttccatctctgatccatcgtcgtggcatcgagaatgatcccgtggactttagaggttggagattacatcctcactccagaaatgtgcgtggagcgcaagagtatcagtgatttaatcggctctttaaataacggccgcctctacagccagtgcatctccatgtcccgctactacaagcgtcccgtgcttct

SEQ ID NO: 669354 - DNA, 589 bp, Homo sapiens
gctgctgcagtgctctcgtcttctgcgggtctcgcgtgccctctccttatcgtattccggaaacatggcctcacgtatgtggctgtctctgatggtgtcatcaacgtgttcaccgacatgaaggtgcgtaagtcttcaacgccagatgaggtgaagaatcgcaggcaggcgggggtctctgctctgagtgaggactcagaagaacatcatcctggagtgagggcaatgagatcctggtggagcgatgagggcccaactgtcgaagagtccctaccgccaactttgtcacgatgctggcagttagggacgtggcgcatatgccctctatgatgccaactatgagatgcaatggatgagcatgaatggatggctctggagtatatcgtagcgagacggccccgagtctgcgcccgcttaatatccaagtgatatatgccagattccaatggaacgccactcaacgaatgaagctgactacggggtcaagcatgaattgcaagcacacgtgctacgcaggaggtcacggaccggctgcacccatggccgaggaagcctggggggcaagggcggcctctccctggaggggcaa

SEQ ID NO: 669355 - DNA, 322 bp, Homo sapiens
  misc_feature (266)..(266): n is a, c, g, or t
ttcaggtgagcagcaatgagacggagaaaggagtacagctcccgaatgtactctgaggccagttagcggctcacacctgtaatcccagcactttaggaggccaaggcagaaggacagtatgagtccgggagtctgagaccagcctgggcaatacagtgagaccccatgtctacaaaaaatacaaataaaaattagctagactgctgcttgagcacaggagttgaggttacagtgagctatgattgtgccactgcaccccaacctgngcaacagagcaagaccctgtctctttcttaaaaaaagaatctgtcggccggcacgg

SEQ ID NO: 669356 - DNA, 879 bp, Homo sapiens
cggcgcggggacgcgggtttctgcctcgggcctgccctgctctactctgcgctctctgccctgtgccgccgcgctcagcctcggcctgcgctgcgcgcccggcgcgtgctgccatggcctgccgccggaagcccgccgaggatcagagccgctgcgacggtgacgccagccctgccgtcccccgcgcgatggatgcctgggacggaagcgcagagccgacggaaggcgctggaggcccgaagacgccgaggaggcaagagcaaccgaggcgccagaagagacaagacccgagagctttaccactccttgaagggccctaaaaccccgtaccagaatgctctgactagggcaaggtgcagttgaaggaaagatgacatgaggaccaaggagtataaaaacaagagattggcaggatatagagaatggaaactccttcatcaatgactttggaaaagagagaggaaaatcgatcatcaaggaagtttctgattcaaagggagtctaatgtctacatgtgccagggtagactttgagacacgatgaaagtgtcctaatagagggagacagaagccagaatcaagtatgtgaagggaaacaccaaattagccttagcgaatcggtaaataatataccagagaaagggtcccagaggacagcctttcagaaaagccttggagattacagtcccaaagagaccccattagataaaactattaacaaggtagtaggacagaagggtacatgggcgacccaacgacacattcaaaagcgtcctacgcaaatcgtaggcgatctgacagactagtgcggatacatccagttggaaaagaagcgagtgtgctttagacacgacaatacagcaccttgaaaaccttggca

SEQ ID NO: 669357 - DNA, 178 bp, Homo sapiens
cggcctgtgcagcagagcgggttagttatcgtacgtattacgtacgagatggaggtgtgatcactctcagtcaggctagtcgcaagcgcctgacctaaagtgatgtgccagcctcagtctcccaaagtgctgggattacaggcatgaaccagcgcacctggccgaacgtttcatctta

SEQ ID NO: 669358 - DNA, 383 bp, Homo sapiens
ttgcaaagcttctaggctgtcacaaatattaagagaagccatgtttatctttgcactttgttttggttgctaagtaaacctagactgagcattcagtcaaccaaagaaatcacatgtaggtgagcatctgcaggttttcctactggtaagacatgatttttttttataactttagaaagatgtgtttacacaaatttagtctacttagtgactatggcagtgttattgttttttgggttttttttgagacggagtctcgctctgtggcccaggctggtgtgcagtggcacgatgtcagctcactgcaacctccgcctcccgggttcaagcgattctcctgttgcagcttcccgagtagctggggttacaggcgcgaaccacca

SEQ ID NO: 669359 - DNA, 165 bp, Homo sapiens
ttacctccgtctgcagtccaggccgagccagaaactcggtgtcacatagagctgacgtgataaatatctttcagcccaggagagaggggtcctgatcattaaccctttcctggtgtctcagacaactcagaatggttgggagggatacgcaagagacggtggtga

SEQ ID NO: 669360 - DNA, 122 bp, Homo sapiens
tgatcgagaatgctaccaatcaatttttacctcttattttagtgagtgcttctggaggagcacgcatgcaagaaggaagtttgagcttgatgcaaatggcaaaaatatcttccgctttatat

SEQ ID NO: 669361 - DNA, 245 bp, Homo sapiens
ctggtcagagaggcggttgatgcacgatctgatctggttctccaccgctgtactgatggcctctacgtctgagcctcccagcaatgggcctatccaacctcgtctactttgggccctcctccagaccttccccttcatcatgctgactcgctaacttcatcctgtcgtgtggactagtggtggtgaatcattacctagcatttcaggtttttgcagaagatattatccgcttcttttttcctttt

SEQ ID NO: 669362 - DNA, 649 bp, Homo sapiens
cgctgggcttgcgtgggtaattacgtgggcgctcggctccgaagtgacacagctcgccacctgaagggtcccttcccaagcccttagggaccgcagaggacttggggaccagcaagcaacccccagggcacgacgaagagctcttgcatgtctgccctgcctcaccactgccccacaccagagcccggatggcccccagcatgcatcaagctggaggcggagcgaggcacgcggagagagggtggcaccaatgggcccagggcggtgcccttccatgcccggggcatgaagacactgctgccatggacagacccgtgccagccgcagcccctaagtcaggctctccctcagttaccagggtctatcgtccagagcccttggaagcctgagccctggccgggcaggatgggagtggagagttaccctgccctgtccccttgcatcccatactaccacttgtccaggagtgcctagtgagggcctcggcagggagttgagacccccagagccacagccactctaccactgccagcactcttcgggacggttacggcggccaggatgactgatagctgcggccgatgagagtgaaggcgctgagcgatgtcaccaagggtgccacgatgccagccaggcgcacggctgagcc

SEQ ID NO: 669363 - DNA, 138 bp, Homo sapiens
gcggtgacgtcgctctgtggcgcccgtgttcgtacgcatcgcccgtggtggcctgtcgacgcgcgcaacccgccactcgtggatgtcctgcgccgggtcgatccgcgcgtcgctccggccttggtggcggttcgcttg

SEQ ID NO: 669364 - DNA, 407 bp, Homo sapiens
acactgcattgtcatccacacacacaccaggactcaacgaaaaatgggactgatgtcatcttgagctcttcattcatctcgactgctgattatatttgcgagtggaggcactgttctctacacgaaacacatgtcactgctaggttgtctacgggataaaatgcatctacactcactttgagagaatgccttttagcttcactgcactatttaaactacattgatcctgctagtgttcctggagaagctagagcctgattgtaggctactactcatcaattaacttctacagtggagactacttctgggactggaatataaaaaagaatcaaaggttctgattttgagctgcaataaagggacaagaccatgctcatagcagtgccaacatctgaagtgtggagcct

SEQ ID NO: 669365 - DNA, 1013 bp, Homo sapiens
ggtgaatttaatggaaaagtgggtaacactacattcatggggagtttttattaaattttataaattttaatagccaattatgtcctaattgtattttggggaatgaacagcagcaaatactgtaaatgtacagttttcttttttttttttttgggttatgtatacaaaagttttaactactgggggggtgttatgaaaatcattatagttgacaaggtgcctatgccattgtttaaattttctttcaagtaatttaacaacagatttgctaatttaaaaaaaaactgaaacaaacaaaatcttaccagcagttgtgtaaaggtctggcaatccacagtgtggcatcctttatccaggtctctctctctccaggtacacttaaaatgcggtgccgagccagggatataaccgtgcagcttaagctgaacaagaaaactccagcctcgcccctctaaaaaaaaaaacaaaactttcatatttttcacacacttagggggctagtggcaagtaaaacatcttcagaggcatatttaacccttcgtgaattaacccattttctagtttaaaacgaacagagacttcccatttgggaaaggtgtcacctgggtgtggacattctgcgtggccggaagttaaggttagaaccattacagaacaggcgttttcagaaaggtcaacacttttgacaacaccttctgtcgtggtgctccggggacaataagtctggaattttttactattgcccagtgttttaacgcgaggctctggacaaagtatgaagtcttccatttcacatcttggggggccccgaattgggcaccattgattaaggctcgtggcctaatgcgggataaggttacgtccaaaataggttagcttctttttgagttatacttagacaaatgccgggttaacattcgtcctctggcacaattgtcactccgggcataacctgggtacattggtagacaatattcaacgggattcaacgaagctatgccgcgtaagattat

SEQ ID NO: 669366 - DNA, 925 bp, Homo sapiens
  misc_feature (20)..(20): n is a, c, g, or t
  misc_feature (264)..(264): n is a, c, g, or t
  misc_feature (447)..(447): n is a, c, g, or t
  misc_feature (518)..(518): n is a, c, g, or t
  misc_feature (650)..(650): n is a, c, g, or t
  misc_feature (663)..(663): n is a, c, g, or t
  misc_feature (714)..(714): n is a, c, g, or t
  misc_feature (799)..(799): n is a, c, g, or t
  misc_feature (831)..(831): n is a, c, g, or t
  misc_feature (844)..(844): n is a, c, g, or t
  misc_feature (859)..(859): n is a, c, g, or t
  misc_feature (910)..(910): n is a, c, g, or t
ccaagatgtgggcgggcctngtctaaacagttgaaggcctccactatgccacccacagtaaccaccctcccacacaggcagggcctccctcctcaggtggcagaaagaagtaaggacactgggggcgggaaaccaactaataaaactgaaagggccaggacagaactgaaagcacccccccagggaggtcaggagcaggagggggtggccacagaagtccaccagcggcccaaggagcccttcccccaaatgtccatgggaacngcgtgcttggcagcaaagaggggctgtggccctccacgctggactggggaggcctggaccctctggccctcctcacacgggaaggagaggtttctccctgaatggagggcagggagggttcgggagggggcgtgggaacccacccctgcggagccttcacagagggggtccttgaccttggcnctaaggaaggagcccgtcccagcagaaactggagtgggagtgggtaaagaccctccgggctcccgagcccnagaggaaggtggtcctgaaaaggttggggagcagagaagaaaggaggttgaggttggggaatccacccctgtcctgggctgggaagcacttgcagaccacagagatttccagtgggaagtgatgtggccccnccctggctatgtncctggctggcccctgcgctgatcagagcaacagaaagtgggccactttggnggaccccctagtccccctagtgacaagagaagagaaggtggtggcaggatggtggtcaggcaggacgtgttaattcttgcccgcnggggccaggttgcgggggagcagcttggtgtngccagaaggcganaaaacggtccctgcnggggagttcagcttcaccttgttcaggatggtcttcttgaaggcggctggngaaaactgcccctgg

SEQ ID NO: 669367 - DNA, 601 bp, Homo sapiens
  misc_feature (54)..(54): n is a, c, g, or t
  misc_feature (153)..(153): n is a, c, g, or t
  misc_feature (208)..(208): n is a, c, g, or t
tactctagacgatcccgtccagggtagatttgcccactgtagattagaagtagnatttagagaaagagaagaaaaagaaaagtcataaaaagtagatataattttttaaagtgaagagtgctctggggtcacacacagctcagtaatcctgangtcagtcactgcattgtgactgatgtaataattcatttatatcttgatgacctcnaattgtcattaaatggttaaattaattttggtatatatcttttaaagtcagaaatacaaaaaaatacacttttcaactatattgttcaaactggttaaaaaacataagaagtgaacccttagctgtctagaaaacctagctacagagaattattccttttcactgggttacaaataaacaagatcctatagttaaaactactggtttcttcccagtatccattccaccattcttctgctattcagaagccatgctcttggtgggactgaccacacctctggctccagacataggctgtacttggcctaagctactcatgataatcacatctgcctgccagagtaactagtccaggaatgagcctgtagccatgccgtacaccaacagctcata

SEQ ID NO: 669368 - DNA, 277 bp, Homo sapiens
  misc_feature (91)..(91): n is a, c, g, or t
cataagctaagtttgtgtcaagatttaagctgattttctcattcttatcaaagtctcacctgggggtagggaggggtaggcctacctcccncctctatctatcattttaggaacagacaggcataaatctgttcatatggtagaacacatgatgttagagtatattttgttgaatgctatggaatattaatataattaattctaaaatatcacctaaaatatgtcaactgaagatctgactgtactaaatatgaaaaataaagcagcacatactttc

SEQ ID NO: 669369 - DNA, 124 bp, Homo sapiens
gtcatgcacctgtagtcctagctactcggggtggtgaggcacaagcattgttgagctgggaggcggaggttgcatgtgagtcacgattatgccactgtactctagcctaggcaataaagcaaga

SEQ ID NO: 669370 - DNA, 578 bp, Homo sapiens
taggcccatttgagtatttggttttcaattagggaaatagtgggtataaggattaggattgttgtgaagtatagtacggatgctactgttgtccaatgatggtaaaagggtagctaacgggttgtccttccgattcagggttacaaaatgaggaggctctgcaggcataggagctcaacataaacgtgactcggctatagcggtggggcgaaagtatcatgcatatgtgttcggtttgggactactactggagcgatggggaatcactgcgcataggcatgcagcgactgacattaggcaactcagggcgacaagggacagccctcccatagccttgtggtatgaggggaacgggacttcgcgcagacaaatggggtgtctacgagggcgcagaaataggagaaactcaatcatactcagcggcctcgacaaatggctgcgcgcgaacgggggcatgactctcacccgccgcggcttgcgccctacgggcaatcaatacaccagcgctgccacgcggctcggccccctaagcacaggcacacaaggaccgcacgcacaatcagcggcaggtcaaaggg

SEQ ID NO: 669371 - DNA, 561 bp, Homo sapiens
  misc_feature (180)..(180): n is a, c, g, or t
aggcggggtataaaactgtaaagcggtgtcggtcgatccgggaatggacagctcgatggtgtgcagaactattatgtgcttttgtactgagagctgtctagtcttgcaactgttaacattatgcagaaaagccccggggccccccgttggatttgcccataaattatttagcaaaagcgntgtaccagtttttccttggaccaggcgaggtggtcatgcctgtaatcccagcactttgggaggccaaggtgggcggatcacttgacgcgataaaagacgttgagaccagcctggctagcatggcgaaacccagtctctactaaaaatacaaaacattagccggggtggaacacttagccgggcgtggtggtgtgtgcttgtaatcccagctactcgggaggctgaggcaggagaatcgcttgaatccgggaggcagaggttgcagtgagccaagatcaggccactgcactccagcctcggggtcaagagcgaaactctgtctcaaacaaacaagaacgacaggaaggcaggaaggagggacggaaggaaggaaagagagaa

SEQ ID NO: 669372 - DNA, 434 bp, Homo sapiens
ctgctggacgcaacgtgtcccatactgggttctctgccctagaatgtattaagcagagtcacgtctcggttacttcaagacacttcttctggctgctctgaagtctcgcatcttatccccatgtttctctcgttccgctcgtacctgattcgagaagtcatcctctccattgtcatgcatcgcaattatccccccagtaaatgtgcctcttcatctgcatctcagccagacccagtcttcggcagggaagtacttgcacactcgtcgtctaccgctacacagtcacgtaagtctaccggctgctttgtctctgacatctcggactgtcctgcgcgcaaacacgtcctcagataagccgaaagagttggaaccctcactcttcctcacggaaacgccagcgttagctcaccgcctccgacacttggcatccagag

SEQ ID NO: 669373 - DNA, 383 bp, Homo sapiens
cggctgcatatagagcgtagtgcatagctgcctacaggactccaggagtgtgactacagagtgagaccttgtaacaaaacaaaacaaaacaaaacaaaataacaatgtaaagagttgtataagggcaactagctgtagcctaatatagggaatttctattgtaatccagactaaaggcagaatgaaacataactagccagtaattgaaaattgatttatttatggatttacagaatttccttatgccatattttcccatttaatgatctccagcattgtttgcacattgttttcattactgcacttagttataattcatcatttataccatccatattctttcttatcttacagattgtgatatctttagtctgaatttaaac

SEQ ID NO: 669374 - DNA, 104 bp, Homo sapiens
cacaagtcattactaagtagcgcaaacgagtttttcatctattagcataaagggcctctctggcagcagcagattaaaacactggcccaacttcattatccata

SEQ ID NO: 669375 - DNA, 149 bp, Homo sapiens
  misc_feature (37)..(37): n is a, c, g, or t
gggcaagccagcccgtgcaacggaaagccaggccaantggcccccggttttcagctgttttgcatcccccgcgcccccccactgagagctgctcctttgggggaatgtttggcaacctttgtgttacagattaaaaattcagcaattca

SEQ ID NO: 669376 - DNA, 1118 bp, Homo sapiens
ccgggtgaggcacgggtgcgcaagcgggagttccggctggagacccgtgctctgggccggcgccttcaccatggcctcggcagagctggactacaccatcgagatcccggatcagccctgctggagccagaagaacagccccagcccaggtgggaaggaggcagaaactcggcagcctgtggtgattctcttgggctggggtggctgcaaggacaagaaccttgccaagtacagtgccatctaccacaaaaggggctgcatcgtaatccgatacacagccccgtggcacatggtcttcttctccgagtcactgggtatcccttcacttcggcagcctgtggtgattctcttgggctggggtggctgcaaggacaagaaccttgccaagtacagtgccatctaccacaaaaggggctgcatcgtaatccgatacacagccccgtggcacatggtcttcttctccgagtcactgggtatcccttcacttcgtgttttggcccagaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtaggggctctgcgggccctggcagccatcctggagcgccgggccgccatgctgcgcctgttgctgctggtggcctttgccctggtggtcgtcctgttccacgtcctgcttgctcccatcacagccctcttccacacccacttctatgacaggctacaggacgcgggctctcgctggcccgagctctacctctactcgagggctgacgaagtagtcctggccagagacatagaacgcatggtggaggcacgcctggcacgccgggtcctggcgcgttctgtggatttcgtgtcatctgcacacgtcagccacctccgtgactaccctacttactacacaagcctctgtgtcgacttcatgcgcaactgcgtccgctgctgaggccattgctccatctcacctctgctccagaaataaatgcctgacacctccccac

SEQ ID NO: 669377 - DNA, 227 bp, Homo sapiens
tcactataattgcggggataaaatggcacgcattagttcgtctgccgtttggcttgccatcactttgggcgcacccgatccgcaatctcgctaaacctagtgttaccctttggtcccgatatatccattgaagtagtggtgcatagtaagactagcgagtcagactaattgccttgttagctcgcagtacgtcccccaggacataaggtggggaggatcgtcgagaa

SEQ ID NO: 669378 - DNA, 479 bp, Homo sapiens
catagaggacccgcaagtggttgtgggtaggagcaggaagggagagctaagagcacagaccctggagccgggtggcctgggtttgtatcctagctctgtgactttgtttttttttggttgttgttttttgggtttttttttttgaaaaaaagtttccctttttttggcccaggttggattgcaatgatgtaatctcggctcactgcaaccttccacctccggggttacaagtagatctcccgcctaaacctcccgagatgcctggatagacaggtgcccagcaccatgcccggtaaatttggtattataagaagagacggggttcaccatgtgggtcaggctgttctcgaactccctgactctcagtgtgtccacccgcttcggcctcccaaagtggctggaattacaggctgtagagccatggcgcccagccagttcagggatttggtgtcagtagattgtcctctctgggtctaagt

SEQ ID NO: 669379 - DNA, 686 bp, Homo sapiens
  misc_feature (275)..(275): n is a, c, g, or t
  misc_feature (335)..(335): n is a, c, g, or t
atacaagtaaagatgaaaatagagggttaatatagttttaaaaaaaagaagaatgtatgaaagaagaagtagcaagggtgtttaacgattagtatgtgagtgaagtcaagggaaatggtgcatgatgtaatggttatgaaaatatgtatatgaaacaaggacatataagaagtaactgaagtaaggtcacacgtgtggaatggatagtctgtagtttgatggagataatatgtaggaagtgagaaggattttattatttggaagagtacaactgntatggttttaaattaaatatatacattattaacatcctattggtatactggtatgttganttgggaatatgtcaggtttatatggcagttcagaatagtaaatatttggaagtttacaaactcttgcttccttaaaggtcagaacatcaggtcaaagtacaacgtttaatttcagaacttgccttccaatttatgcattttcaatttgctctccccatttgttgagtcagaagaagcagcattgcccagaaacaggtattacgtaacatgcacatactctaaaaagtactcatcccttgttttctgctcatttcttccagcctgaggaacagacgtcagaaaaaaagcaaccacccagacaacttccccttttagctgagctgtcttctgaccaatcaacagggaccagcc

SEQ ID NO: 669380 - DNA, 799 bp, Homo sapiens
gctctgtggcgggcgccgcagttccgcggtccgcgcgccgtcctcccagcgcagacttcaaggggctaccactggacccttcccctgtcttgaaccctgatgccggcaccatgcacggacgccgtgaaggtgaagacgtcaggaaggagcaggcggaggccaaaaggctagagcgagagcagaagctgaagctataccatgtcaggcaccacaggccgtattccacgagagcgccaggcgtggtgagctggatgacgtccgtgctggaactgacaagccagattcgtgggagccaaccctgattgttgccaccctctggaagctgccgacgagaggtgctcctagcagctggagactcagaagtctccgtgaagagttggctgctctggtgaaggcagaactgggcttcctggagagctgctgcgggtgaaccccaagtcttatggtacctggaaccgaccgatgctggctgctaggccgcctgcctgagcccaactggacccggagagctggagcgtcgtgtgcccgtttcctggaggtggatgagcggaactttgcacgtgctgggactatctggcggtggagtggccacagcatggccatgcctgtgccccgctgcaagaagggaagctgagccttgcactgagcagcctcatcacccgaaacttctccgaactgactcttgctgtgcattaccgctccttgtctacttggcccctagcgtgcaccccagccggatcctggaacacagggtgcgcctccctgaaggatgtgctgctcacaggagctggagctggtg

SEQ ID NO: 669381 - DNA, 128 bp, Homo sapiens
ctaaatggctgtcagaggacacttgctctacctgaacaggacaccttgagctgagctgccttcccctcccgggagtggcagagccgggacaacacatggcatggccctctagtgtcctgccaaagagc

SEQ ID NO: 669382 - DNA, 996 bp, Homo sapiens
  misc_feature (264)..(264): n is a, c, g, or t
  misc_feature (267)..(267): n is a, c, g, or t
ggcagagagccatcctctataagcggctgaaagtgcctccgtgcggattaaccaggttcgacccgagtgcccttgtgactcgccaaacatgcgtacttctggcgtgcttaatgctgggccctacaaacgtacatgacctacgagactagaagcgagataataaagataagataagaatataaaatcaaacaacaaaattttcgtgcacgcgctggagaggactcgtcgtagaatggttgtatatgaaccacagcatctccattnggngcgtgaacgaggggccacgccattagtgggtcaagcgtacgcatgggtggcttacacagcggagcatccgcaagggggcaatgaccttgcgtgtcccttcgaagctgaaaagggagtgcgcaggatatgccgctctcctcgataacataatccacgccgggaggtcaatccggaagttgtttctagagaggaacaattgtaatcctgctggatgaggggatagttcctactgagagggggcgctagatgaaccgcaggggggatatatctatctgcgacttagggagttgggctctacacgggtcgagaaacccatggaaatgtaaagattcaatcttctcgacgacccgcaaggccagtgggtgcgaacactgctggaaacgaaccaaaagtttcaacaaaaaattcccaaaaagacttgggttatacttacggccaatttacctatccggtccaagtgcatctgacttcgaacgggtggtttaaggacaatcaccaccaccagagggaatttgcgaggccagccgtggggacaaagccccttaattcccaaggaagcgggacctgggcccttggggcgatacttcttagaagtgcagcaaaacgcttacccacaacggacagaaacccgttgggcacttaattggggttcgccctttacatcgaatcgccacatttattcaacatggaccacgttggccacggtttcattcacacgaaccgccctat

SEQ ID NO: 669383 - DNA, 129 bp, Homo sapiens
  misc_feature (27)..(27): n is a, c, g, or t
tcctctgcacacgcgaattcagctaanttgggttgtgggcagcacgtgctggggaggtggcccctctctgtgctgccccacgttggactctaacagctgcccagcccgcacgtcacataccaaaagctc

SEQ ID NO: 669384 - DNA, 1023 bp, Homo sapiens
tgcggtgtgtgtacacatactcacgtatctgcacatattaatatacaggaagaaaaaagacagacaagatggggcttggtttataaccaccttgccctgtcttccttaactccagaagccagttggtgaggtggtgggggtgcggcatcaggtctgagctcttcctactgtggaatgtgctccagaaggcccttcacaaggagacccctcacactggatccagtcagactgatggagggctttgcccctcattgtgggcttgggcctccatcgggccacgtccaaatgctagtcacttgctactgcttcaggctcacatcgcccaccgacctgatgagcagtgcacagaccccactcttcactgcgggccatgccacaggtttattgtgttcatgcattaagtagataagaacccacatatacgcgacaggaacacgaactcaccggatcatccaagggatggtataaccaaagtgtctgttgaataaatgttcaacggcaaaaaaacatcatcacaagaggacacaaagatgaccaaagatctaaatggaacgcccgcactaggtgtgcaaattgagcccatgtgagaccagaacgcaagcaagccaaggagcccgacaggcacaaagacattcacaatagaaccaaacgtaccctcccttggactctagacaagacaccaacacagcaacaaatagacataaaccctgacggagacaacactacacaagcggcaatcagagagcaccagacacccggacggaaaggggatgagaaagagatgaactaagacggaaaccagacttacgggaatgagtcagaccaaaacactagaaggaatacagaagaacacagaagtaacacgctgagacacaacagagtcaaaggactcacatacaaaacaaaaaacaacgatccagaatccaaaagagaaaaagagaaagaaaaaacacaaagagaaagcaaacaaaaacaacaagacaaaaaagacgcacacaacaacaacaaaacaaataacacaac

SEQ ID NO: 669385 - DNA, 1249 bp, Homo sapiens
ggggaatcggtggctgccctggacccgagggtcagcgcgggcggacggccgggtgtgggtactggccgtggggtggctgtgctggctgccgggactcgctgccctccggacccagcctggacgtcgtgccctgcatggctcaactttccagtgctgtgcaccccgtgcgctgtgtgtgaatgagcttgcgaggctggggagcggtggattcgcgtccggctgtgccactcgggagccgcgatctgggaaaaccgctgccgaacctcaatttcccctgcagtaaaactggagtaggatgagcatcttggcggagactctgttgagataatataataaaacatttggcacataggaggcacttactacgtatctgggtcattgtaagctctccgacaaaatgagcgtgaagatgttatcgattgcatagggtgaggatcacgttgacgcgtgtgcatgctaaagaggtgagatcattagttagcacccaatgcaggctagctgcgtgtaaacgaggatataacgaaaagagcgtggctaaggaacggcagagagagcccaggttccaaattgaacgtttaacacctgtgttgacctattgaggcaactggcatacacctcactgatgacctagcgaatacccttaatactatcacactgaggactacagactagccaaccaactatcgatcaagctacgtacatacacagatacagcgacaacactaccactgagtcacaacggtgctaacacacaggaaaacttgacgaataaacacgaacaaagaacatatggtaccacgatcattaaaaaggttaaccaacaaacgtcacagtaacacacatttacagcagtcgagcatatgcagatataatagacaacccagcgtagcaagactacatcagccatgcacagtctaacactcacattaattacaaatcagatacaaaaaatcatacaacaaatagacatatacaaaacaaacaatcctcatactagttcaatcaaacaaaaaccacacaacacaatattagacaccatagactaatacacacagcacacccaataaaacagacgtagtccataacacaaccacacaacagcatcaaactaaacataacaccatatcaacacaatatcagatatcaacatagaactaccaatacgcactatatcgaccaaaccatcaatactcaccgacaaaattaaacattaaataacatatcatcaactcatacacatctacaagag

SEQ ID NO: 669386 - DNA, 482 bp, Homo sapiens
cccaggtatggtggcacacgtctgtaatcccagctacttgggaggctgcggtgggagaattgcttgaacccaggacggcagaggttgcagtgagccaagatcacgccatgcactccagcctgggtgacagagtgagactccatctcaaacaaaagaatttcgtgcagaacttcaagacactaaggaaacaatctttaaatatttaggactggggccaggcgtggtggctcacacctgtaatcccagcactttgggaggcggagatgggcggatcacgaggtcagaagattgagaccatcctggctaacacggtgaaaccccgtctctactaaaaatacaaaaaattagccgggcgcggtggtgagtgcctgtaatcccagatactcgggaggctgaagcaggagaatcgcttgaacccgggacacagaggttgcagtgagctgagatcacccactgcactctagcctgggccacaagagcaa

SEQ ID NO: 669387 - DNA, 157 bp, Homo sapiens
tgacctgatcaacgaggcgaccggcgagatctacatcgaagccggcgacgaagtctcggccgagaatctcgagaagctcgacaaggccggcatcgaccggatcgagctgctcgacatcgatcacatcgccaccggtccgtggatccgcaacacgctc

SEQ ID NO: 669388 - DNA, 282 bp, Homo sapiens
  misc_feature (128)..(128): n is a, c, g, or t
  misc_feature (137)..(137): n is a, c, g, or t
cgcgtgtgatctagaggatcccttttgcggtgcctttcctcgggggctgcgcaataacgctcttgcggggtcgaacagctgcggtcaccaaagcaggtgctggcctcggacctgagagccatgcaggncccatgtgntctgcaaatgggagcggctgtttttgaacacggggtcattctgcagtcaggacgaaccggtccccgtcgcagacggattgcatgtgccctgggcaaaatcctcaagctcggtggagggacgcgtgcggcggccacggtgcctacg

SEQ ID NO: 669389 - DNA, 875 bp, Homo sapiens
  misc_feature (208)..(208): n is a, c, g, or t
  misc_feature (211)..(211): n is a, c, g, or t
  misc_feature (251)..(251): n is a, c, g, or t
  misc_feature (258)..(258): n is a, c, g, or t
  misc_feature (262)..(262): n is a, c, g, or t
  misc_feature (287)..(287): n is a, c, g, or t
  misc_feature (307)..(307): n is a, c, g, or t
  misc_feature (311)..(311): n is a, c, g, or t
  misc_feature (314)..(314): n is a, c, g, or t
  misc_feature (316)..(316): n is a, c, g, or t
  misc_feature (349)..(349): n is a, c, g, or t
  misc_feature (356)..(356): n is a, c, g, or t
  misc_feature (404)..(404): n is a, c, g, or t
  misc_feature (413)..(413): n is a, c, g, or t
  misc_feature (432)..(432): n is a, c, g, or t
cgagatgctcagttccctcctccttgtggccgttgcctcaggctatggcccaccttcctctcgcccttccagccgcgttgtcaatggtgaggatgcggtcccctacagctggccctggcaggtttccctgcagtatgagaaaagtggaagcttctaccacacgtgtggcggtagcctcatcgcccccgactgggttgtgactgccggncantgtatctcgagctcctggacctaccaggtggtgttgggcngagtacnaccntggtgtgaaggagggccccgagcangtgatccccatcaactctgngganatntntgtgcatccactctggaaccgctcgtgtgtggnctgtggnaatgacatcgccctcatcaagctctcacgcagcgcccagctgggagangcgtccagntcgcctcactccctcccgntggtgacatcgcttcgccaaacgagacatcccgtgctacatcaccggctggggccgtctcgtataccaagcgggccaggtcccagacaagctgcaggaggccctgctgcccagatggtgggactatgaacactgctccaggtggacacatggtggggtacctccggtgaagacaaccattggtgtgtgctggagcgggacatccgaatccgtgctgccaacgggtgactcatggcagagatccccctcgaacatggccccacagcatggattggttggctgacacgggtcccttggtggttaaacccagcatatggaatactgacctattgggcatgcataccaaggcacgcaggaaaggcccaagggagtttcactacgaggttatccgcgctccatcgacctggaattcgaggaagacgattcgtaaggcccactggaacc

SEQ ID NO: 669390 - DNA, 946 bp, Homo sapiens
  misc_feature (279)..(279): n is a, c, g, or t
  misc_feature (282)..(282): n is a, c, g, or t
  misc_feature (322)..(322): n is a, c, g, or t
  misc_feature (329)..(329): n is a, c, g, or t
  misc_feature (333)..(333): n is a, c, g, or t
  misc_feature (358)..(358): n is a, c, g, or t
  misc_feature (378)..(378): n is a, c, g, or t
  misc_feature (382)..(382): n is a, c, g, or t
  misc_feature (385)..(385): n is a, c, g, or t
  misc_feature (387)..(387): n is a, c, g, or t
  misc_feature (420)..(420): n is a, c, g, or t
  misc_feature (427)..(427): n is a, c, g, or t
  misc_feature (475)..(475): n is a, c, g, or t
  misc_feature (484)..(484): n is a, c, g, or t
  misc_feature (503)..(503): n is a, c, g, or t
cttgtggccgttgagatgaggtcttgctatgttgcccaggctggtctcaaactcgtgcgctcaagcgatcctcccgcctcggcctctcaaagcactaggattacagcctcaggctatggcccaccttcctctcgcccttccagccgcgttgtcaatggtgaggatgcggtcccctacagctggccctggcaggtttccctgcagtatgagaaaagtggaagcttctaccacacgtgtggcggtagcctcatcgcccccgactgggttgtgactgccggncantgtatctcgagctcctggacctaccaggtggtgttgggcngagtacnaccntggtgtgaaggagggccccgagcangtgatccccatcaactctgngganatntntgtgcatccactctggaaccgctcgtgtgtggnctgtggnaatgacatcgccctcatcaagctctcacgcagcgcccagctgggagangcgtccagntcgcctcactccctcccgntggtgacatcgcttcgccaaacgagacatcccgtgctacatcaccggctggggccgtctcgtataccaagcgggccaggtcccagacaagctgcaggaggccctgctgcccagatggtgggactatgaacactgctccaggtggacacatggtggggtacctccggtgaagacaaccattggtgtgtgctggagcgggacatccgaatccgtgctgccaacgggtgactcatggcagagatccccctcgaacatggccccacagcatggattggttggctgacacgggtcccttggtggttaaacccagcatatggaatactgacctattgggcatgcataccaaggcacgcaggaaaggcccaagggagtttcactacgaggttatccgcgctccatcgacctggaattcgaggaagacgattcgtaaggcccactggaacc

SEQ ID NO: 669391 - DNA, 1065 bp, Homo sapiens
gtggttgttcctgccggctgtattcgggccttggacttggactgagaagctacggatggagaccatccatggtgaagaagccccgctgatgatacgggccccgtgcacagtgccatttggggcatattgtggccaatgagaaatggtcgcgggtcataggtggctgcaggagatgcaaggtgaaaaattaaggctcattttcgaggatggcttgacacacagacttttatctgtacgaacagatgctgacattctttagtgtcaccgaaggctgattaaggatggcaggaaatggggtacagaaagaggacttgatacgggatatagaaattccaataatcttaaaggaagtagtagtcagatagaaaaaacccggatgagtgaaacagtacttacccagacctacagacagtttactgttgctggagcttggaatggtgctgcttaccagatggccagccagatggacagccatcctgactcgtcatccagattgcgttcaagagcaaacccaaagaagccaagataaagaacccatcttactcgggcaagcacactgggcccctgaatgctgtacttgagaccatatcgcataccattccgaaggcggtgacaaggacagaattccccaagaagatctggaaacacgtcaacaagcatccacctttactaccctcccgagaaacggttataccaaagggcgattcacagtgacaaacctgtggacgttcaaattggatactgccgaaaatggacgagaaaactttgggatagccaaatgttgggtcagggaagcgaaaggcacagatatgaggacaacaaaaggacagggaatcccgaattggccccatttacctctccgaccacgcaagagagccccaaaggcgtggacaaggcgagcattgggagcacaatcaatggagggaccccaagcgtggagcacatcagatacgatacaccagagaagaagagacagcaaacagacaaacagaaggaggagtaacataggcgaaagcacaacgacgctataaaccaagaaaagccaaaaagcaagcgaacaacgga

SEQ ID NO: 669392 - DNA, 681 bp, Homo sapiens
gggcacaagtgctattgcgcgcccgccggtcgccgggccctgtctgcggacgccagccttgcggagtacggtgaaccttctgctcaggcgctccagttcgtgccggagacgcaggcttagcctgctggacaacgggcctgcgtgtgggcctccgatcaggtcctctcagcccacttgcacggctgggagtgtgtggattggatgtgtgggcagccgtgtttggagactggagaaggaatacatggggcgaggctacgttttcgggagcatctggcgtttcaaggggaacaaagaatcggcctggcagtgccctgggagaaggaggtggagagcatgggggcccatctgtaagtgcctacagcacccgggagcacacaggcttactacatcaaggcgctgtccaaggagtctgccgaagtgctgtggcgctcctgggtgacatcgtgcataactgtggtctggacggctcacagattgagtacgtgaccgtgatgtggtcctgcgggagatgctggagaatgatcgctctatgcgagctgtggtctcctactacctgcctgcctcacgcgttccacgggcgcatctctagcccaggctgtggcgcgggcccggtgaccactgtcagggaagctgtgctcggtgcggagcttgcccgggttacctcagccgccctttccatgg

SEQ ID NO: 669393 - DNA, 1005 bp, Homo sapiens
gccacgcgtacgcatctcacttctaggaatactagtatatcgctcacacctcatatcctccctactatgcctagagggaatagtactatcgcgtgctcattatagctagctctcataatgcctcaacaggccactccctcttagccagtattgtgcctatcgccagtagctagtctgttgccgcctgcgaagcacggtgggcctagtccctactagtctcaatctccaacacatatggcctagactacgtacataacctaaacctactccaatgctaaatatctaatcgtcccgactattatattactaccactgacatgactttccacataacacataatttgaatcgccacaaccacccacagcctaattattagcatcataccccctactattttttaacccaaatcatccaacaacctatttatgctgttcccctaactttcctcgcgagccgcctaacaatccccctgcgtaatacgtaacgtacctgatcgttgcataaccctgcacaatcatggcgagccaggggccactgattccagtgaaatcactatcaggagggatgacactagctctctatactaatcgtccgctactgatctccgttagtttttagcatgcactagtcactgcactaatcatattttataatctgctacgaaccatattatccctcctggtattgtccccggagtacgctattcagcaatgaacgactgacgcggcattggtcattttaaaacctggtaggtggccttccttatcatttgataatttaagcagaaacctagggcatacaatttattggcgttccaggcagtattaagttcggcgaattattgcagtacaaactttggtgagagctaaggaccttgacccagcgtgacccgtgtaatgcgactaaacggggatgcacaccgaccggaaaacctgtacagaataacgggcaatgtggagtgctccgcgcactataaccctcttgtcttttcaagaaggagaggt

SEQ ID NO: 669394 - DNA, 341 bp, Homo sapiens
gaattccggctctcaggggaaaaaaagtaaaagcatatactggtgcattcaggacatttcaatccgaacacaaacaaaaatggtatttaaatactttttttgagacggagtttcactcttgttgcccaggctggagtgcagtggtgtcatctcggctcactgcaacctctaactcccaggttcaagcgattctcctgcctcagcctcccaagtagctgggatcacaggcacccgccaccacacctggctaatgtttatacttttattagagaggaggtttcaccatgttggtcatgctggtcccgaactcctgacctcaggcgatccgcccacctcagcct

SEQ ID NO: 669395 - DNA, 687 bp, Homo sapiens
  misc_feature (30)..(30): n is a, c, g, or t
  misc_feature (92)..(92): n is a, c, g, or t
  misc_feature (94)..(94): n is a, c, g, or t
  misc_feature (98)..(98): n is a, c, g, or t
  misc_feature (153)..(153): n is a, c, g, or t
  misc_feature (158)..(158): n is a, c, g, or t
  misc_feature (164)..(164): n is a, c, g, or t
  misc_feature (183)..(184): n is a, c, g, or t
  misc_feature (194)..(194): n is a, c, g, or t
  misc_feature (213)..(214): n is a, c, g, or t
  misc_feature (218)..(218): n is a, c, g, or t
  misc_feature (286)..(286): n is a, c, g, or t
  misc_feature (356)..(356): n is a, c, g, or t
  misc_feature (402)..(402): n is a, c, g, or t
  misc_feature (407)..(407): n is a, c, g, or t
  misc_feature (409)..(409): n is a, c, g, or t
  misc_feature (433)..(433): n is a, c, g, or t
  misc_feature (461)..(461): n is a, c, g, or t
  misc_feature (469)..(469): n is a, c, g, or t
  misc_feature (477)..(477): n is a, c, g, or t
  misc_feature (501)..(501): n is a, c, g, or t
  misc_feature (570)..(570): n is a, c, g, or t
  misc_feature (572)..(572): n is a, c, g, or t
  misc_feature (687)..(687): n is a, c, g, or t
aggttaaatatgagctgaaaagtgtaaaanaggaagacgaacatcactttacaaatcattaaattaaccaaataaacaaacagaacccaaancnccanccccccatgctgagttctctccttgtgcaactctgcaaaatgagaacagaaaatnacgtnggccgncccccccccggcccccccnnggggcggganctgggagccaggaacaggnngganggggctgctggggcatggatgctggctttctgccccgtgtgcctggtggtttctggtacctggtcgtngtacctggtggctctacccaggctgggggttgaggggaggggcccccagaggcccctgccagcctgtggnattcaagcactgccaggacaagccagattggggggtggaaacacangggananggaggtggccaccagtgcccaggntggtacctgccgcagtgccagcctgcanctcttctnatctgaanttgccccaagttcacctgcgtctncctccttttcttcagactgcgccctcccagatcctgaaagcccctgcagcatcaaatggttgattttantntttgtttaaattaaaaaattaaaatatatatacatatatataatgtacacacaggacaataacagagagtgttgaaaagggaggtacaagagcgggccggggaaaagccaggggn

SEQ ID NO: 669396 - DNA, 285 bp, Homo sapiens
ctcccctatataccaatacatataattgttttactgaataaggcaagtatttccccatgttactgagtctttaaataattgttttttatacagctatatgaatcatattctttctttcagaagttatttaaacattcaccaatttggggggatttttcccctactttttgaaaattaagatgctgctgagattattcttatatattaatctttgactatgtgtctggttatatttccttagcttaactctctagaattggacttgctaggtcaaaaggcatgaat

SEQ ID NO: 669397 - DNA, 119 bp, Homo sapiens
tgtggcttactctagagtgatccctatgatatatctccacacagcagagaccaacctgaacccgccttcgcacttgctgaagggaagtcggaactagtctcaggcttacaatatcgaat

SEQ ID NO: 669398 - DNA, 571 bp, Homo sapiens
agtagagatgagcatttcctgttctctctccagagtcactcaggctgggtgaaggtaccagaattgccaggaacataactttaaaggtcaatcacgaattcttgttgtagtcactgttagtaccagttcctggcaaaaactgcctgggaaattctgatgtttcccccctccttggtacccctttaaatccattcagttaatttgaagactcaatataaattcaattcattaaaacatactcgataatttaatgggctgaagactgcacgtggttcttagagcctacagtggctgacagagtatagggtattaacgttaacggatcctgtgatgtggcggtgagctgcagctgtgatccacgaagtctctgaacagggcttagaatctgactgcactttgtatttaacaggagcctacgtgaagaagagagcacacaattttaacagttgattttatattccctgagttattcttcttgcttcaaaaaaactctaggaaatgccatacgctgcaagaacatgaccttcctcagacatctcttctctccctttccaaacacaactaggagtca

SEQ ID NO: 669399 - DNA, 4132 bp, Homo sapiens
  misc_feature (3604)..(3604): n is a, c, g, or t
  misc_feature (3608)..(3608): n is a, c, g, or t
  misc_feature (3613)..(3613): n is a, c, g, or t
  misc_feature (3617)..(3617): n is a, c, g, or t
  misc_feature (3625)..(3625): n is a, c, g, or t
  misc_feature (3636)..(3636): n is a, c, g, or t
  misc_feature (3643)..(3643): n is a, c, g, or t
  misc_feature (3735)..(3735): n is a, c, g, or t
  misc_feature (3757)..(3757): n is a, c, g, or t
  misc_feature (3960)..(3960): n is a, c, g, or t
  misc_feature (3993)..(3993): n is a, c, g, or t
ggacagccgctggactccagtcatatcgccagcatccgcatgggcaccacagtggccaccaacgcactgctggagcggaagggggagcgggtggcgctgctggtgacacgtggcttccgagacctgctgcacattggcacccaagcccgtggggacctctttgacctggccgtgcccatgcctgaggtgctgtatgaagaggtgctggaggtggacgaacgcgtggtgctgcaccgtggagaggcgggcacgggacgcctgtgaaaggccgcacgggggacctgctggaagtgcagcagcctgtggacctgggggccctgcgtgggaagctggaggggctgctatctcgaggcatccgcagcctggctgtggtgctcatgcactcgtacacgtgggcccagcatgagcagcaggtgggtgtgctggcccgggagctgggcttcacgcacgtgtcactgtcctcggaggccatgcccatggtgcgcatcgtccctcgggggcacacggcctgtgccgacgcctacctcacgcccgccatccagcgctacgtgcagggcttctgccgtggcttccagggccaactcaaggatgtgcaggtgttgttcatgcgctccgatggcggcctggcgcccatggacaccttcagcggctccagtgctgtgctctcgggcccggccggcggcgtggtgggctactcagccaccacctaccagcaggagggtggccagcctgtcatcggctttgacatgggaggcacgtccacggatgtgagccgctatgctggggaattcgagcacgtcttcgaggccagcacagctggcgtcaccctccaggccccgcagctggacatcaacaccgtggcagcgggagggggttcccgcctcttcttcaggtctggcctctttgtggttgggcccgagtcagcaggagcccacccaggacccgcctgctaccgcaaaggtaagagtcaggatctggccggcctggccttgccctccgcttgccgccgcaggcccagcccctcctgtcagccctatccctgctgcctactcctgctcccctgcctccagcccccaagccccacaccctgtccacctcccagggggccctgtgacagtgacggatgctaatctggtcctgggtcgcctgctgcctgcctccttcccctgcatttttgggccgggagagaaccaaccactttcccctgaggcctcccgcaaagccctggaggctgtggccactgaggtcaacagcttcctgaccaacgggccctgcccggcctccccgctgagcctggaggaggtggccatggggttcgtgcgcgtggccaacgaggccatgtgccggcccatccgtgcactcacgcaggtacgtccacctctgctctcccgcctgtcctgcccccagcctttgtggagcggtacatgagggagtttggctttgtcatacctgagcggccggtggtcgtggacgatgtgcgagtgcggggcaccggccgcagtggtcttcgcctcgaggatgcccccaaagcccagaccgggcctccccgggtggacaagatgacccagtgctactttgaggggggctaccaggagacccctgtgtacctgctggcagagctgggctatgggcacaagctccatgggccctgcctcatcatcgacagtaacagcaccatcctggtggagccaggttgccaggcagaggtgaccaagacaggggacatctgcatctccgtgggggccgaagtccccggcacagtgggcccccagctggaccctatccagctgtccatcttctcacaccgcttcatgagcattgctgagcagatgggccgcatcctgcagcgcacagccatctccaccaacatcaaggagcgtctggacttctcctgtgccctctttgggcccgatggggggctggtgtccaatgccccccacatccctgtgcacctgggtgccatgcaggagacggtgcagttccagattcagcacctgggggccgatctccaccctggcgacgtgctactgagcaaccatcccagtgccgggggcagccacctgccagacctgactgttatcacaccggtgttttggccgggtcagacgcggcctgtgttctatgtggccagccgagggcaccacgcagacatcgggggcatcacaccaggctccatgcccccccactccaccatgctgcaacaggagggtgccgtctttctgtccttcaaacttgtccaggggggcgtcttccaggaggaggcggtgacggaggccctgcgggcgccaggcaaggtccccaactgcagcggaaccagaaacctgcacgacaacctgtcggacctccgtgcccaggtggcagccaaccagaagggcatccagctggtgggggagctcattgggcagtacggcctggacgtggtgcaggcctacatgggccatattcaggcaaacgctgagctggccgtgcgagacatgttgcgtgcctttggaacctcccggcaggcccggggcctgcccctggaggtgtcctcggaagaccacatggacgacggttcccccatccgcctccgtgtgcagatcagcctgagtcagggcagcgctgtgtttgacttcagcggcactgggccggaggtgtttggtaatctcaacgcaccgcgggccgtaaccctgtccgccctcatctactgcctgcgctgtctggtgggccgcgacatcccactcaaccagggctgcctggcgccagtgcgcgtggtcattccccgaggctccatcctggacccgtcgcccgaggcggcggtggtgggcggcaacgtgctcacgtcgcagcgcgtggtggatgtcatcctgggggcctttggggcctgcgccgcctcccagggctgcatgaacaacgtgaccctgggcaacgcccacatgggctactacgagacggtggcgggcggcgcgggcgcgggtcccagctggcacgggcgcagcggtgtgcacagccacatgaccaacacacgcatcaccgaccctgagatcctggagagccggtacccggtcatcctgcgccgcttcgagctgcggcggggctcggggggcagaggccgcttccgaggcggcgacggcgtcacccgcgagctgctctttcgtgaggaggcgctgctgtcagtgctgaccgagcgccgcgccttccggccatacgggctccacggtgcgcggttccccagccctcgcggccctccccgcccccgcccccacccccgcccctggtctctctggactcctcgcctccctccgcagggggcgagcctggcgcccgcggcctaaacctgctgatccgcaaaaacggccggacggtgaatctgggcggcaagacgtcggtgaccgtgtaccccggggatgtgttctgtctccacacgcccggcggcggtggctatggggacccggaggaccccgccccaccgccggggtcgcccccgcaagcactggcctttcccgagcacggcagcgtctatgagtatcgccgggcccaggaggccgtgtgaggatcccgcaataaagatgccttaagtctcccggttctggggacgcagctacggcgcctagttcgtgctccnagtngtgtntgtngcgccacngcgcgcccctnatctgtncttgccttaggaggacactgagactcggagctgcaggcgcactgcccggtggtccgtgagcccctccagggcggtactgaacgtcacctgcnccacctcctgggggcgggagtnaggttgagggtcgtcccagtgccgcagccagccacccgggaactccgcggtacgtgatgtagtccaggcgccgacctctccagggcttagctcggcggcttctgccgggaaggccggccaggtagaggtggcgccctttctcctgctccagggccctggtaggggggcggtgtcatcaaggccagggcccctccgcgcgcttngggcgggcagtgcctacatccaggtcgcaactnaccgcctcggcatcttgggggaggaggccatggactggtggagcacggaggtctcagcgcggtccccagggcccagggctgcttttggcgcgtgcccagccggcagggatcctggaaacagcggaagagctcgtgctcc

SEQ ID NO: 669400 - DNA, 417 bp, Homo sapiens
gtactcgcactctagttccagcggtagccggcctgcgtgtgtgcgccatctcggtcatcccgacgacaccctgtgctggagtgcagtgcacaatctcgtgctcatcccaccgtcacccgggctgtagtgcagtgccgccatctcggattcatcccaccgtcagccgtgctggagtgcagtggcgccatctcggctcatcccaccctgtcactctggctggagtgcagtggcccaatctcggctcactgcgtcctcaaaattccaggctcaagcccatctcccacctcaggctcccgagcagctgtaaccacagggcgcatgccaccattgcttgctccactttaacatcttctgcagcagcggggtcttggaatggtgccccagggatgatctcaaaccgctttggtccatgccatc

SEQ ID NO: 669401 - DNA, 957 bp, Homo sapiens
  misc_feature (106)..(106): n is a, c, g, or t
  misc_feature (117)..(117): n is a, c, g, or t
  misc_feature (429)..(429): n is a, c, g, or t
  misc_feature (433)..(433): n is a, c, g, or t
  misc_feature (438)..(438): n is a, c, g, or t
  misc_feature (442)..(442): n is a, c, g, or t
  misc_feature (450)..(450): n is a, c, g, or t
  misc_feature (461)..(461): n is a, c, g, or t
  misc_feature (468)..(468): n is a, c, g, or t
  misc_feature (560)..(560): n is a, c, g, or t
  misc_feature (582)..(582): n is a, c, g, or t
  misc_feature (785)..(785): n is a, c, g, or t
  misc_feature (818)..(818): n is a, c, g, or t
ctcccggccccatcccacagagggggaacagttgcagacctgaccagaggccgagtttaatttggccccggaagaaagggggcggtcgggcctccgtggtccatgngggcgggtganggacgctgcccggtggggaggggactgcgcaggtgacagggaggggccacgcctgcactgagcccgcctccccgcccccccccgcgccaacaggatgtgttctgtctccacacgcccggcggcggtggctatggggacccggaggaccccgccccaccgccggggtcgcccccgcaagcactggcctttcccgagcacggcagcgtctatgagtatcgccgggcccaggaggccgtgtgaggatcccgcaataaagatgccttaagtctcccggttctggggacgcagctacggcgcctagttcgtgctccnagtngtgtntgtngcgccacngcgcgcccctnatctgtncttgccttaggaggacactgagactcggagctgcaggcgcactgcccggtggtccgtgagcccctccagggcggtactgaacgtcacctgcnccacctcctgggggcgggagtnaggttgagggtcgtcccagtgccgcagccagccacccgggaactccgcggtacgtgatgtagtccaggcgccgacctctccagggcttagctcggcggcttctgccgggaaggccggccaggtagaggtggcgccctttctcctgctccagggccctggtaggggggcggtgtcatcaaggccagggcccctccgcgcgcttngggcgggcagtgcctacatccaggtcgcaactnaccgcctcggcatcttgggggaggaggccatggactggtggagcacggaggtctcagcgcggtccccagggcccagggctgcttttggcgcgtgcccagccggcagggatcctggaaacagcggaagagctcgtgctcc

SEQ ID NO: 669402 - DNA, 523 bp, Homo sapiens
  misc_feature (65)..(65): n is a, c, g, or t
  misc_feature (90)..(90): n is a, c, g, or t
  misc_feature (105)..(105): n is a, c, g, or t
  misc_feature (429)..(429): n is a, c, g, or t
  misc_feature (437)..(437): n is a, c, g, or t
atgaggcacaggaaccctgctccctgctctacgcgcctgagaccttcgtgcagctggaccagagnctgagccgcctggaggagcagtgtntggatgctctgcagncccagggcttcgccaggtgggcttccagggtgcccctggacagagggcttacgttgtcctcaccacgcccttggtgggtgttcctcctgatgactttccaggtggtcccgggctctgcgagaagcagaacaggtgtccttgccgggcgctgggtggggtggggtcagggcagggggtttggtttgagtgcccccaaccaacctgctgcaggtcccagatcagcactgagagcttcctgcacctgcgctaccagggcacggactgtgctctgatggtgtctgcccaccagcacccagccacagcccgctcgccccgtgcgggggncttcgggnagccttcgtggacaggtacgtgcttcctgactccgagtcctggcaagggccctcccttgtgcctctggggatcctctaagtaccag

SEQ ID NO: 669403 - DNA, 131 bp, Homo sapiens
  misc_feature (1)..(1): n is a, c, g, or t
  misc_feature (63)..(63): n is a, c, g, or t
  misc_feature (88)..(88): n is a, c, g, or t
  misc_feature (98)..(98): n is a, c, g, or t
  misc_feature (113)..(113): n is a, c, g, or t
  misc_feature (121)..(121): n is a, c, g, or t
nagaccagaagctgcaatatacaatgatgaaaatgaaacgaaaaggaagtacccccatcagantctggacacccaggaataaaaaganaaaggactanattggtgaataaatnaaagtgtntggtttgggg

SEQ ID NO: 669404 - DNA, 3901 bp, Homo sapiens
  misc_feature (3373)..(3373): n is a, c, g, or t
  misc_feature (3377)..(3377): n is a, c, g, or t
  misc_feature (3382)..(3382): n is a, c, g, or t
  misc_feature (3386)..(3386): n is a, c, g, or t
  misc_feature (3394)..(3394): n is a, c, g, or t
  misc_feature (3405)..(3405): n is a, c, g, or t
  misc_feature (3412)..(3412): n is a, c, g, or t
  misc_feature (3504)..(3504): n is a, c, g, or t
  misc_feature (3526)..(3526): n is a, c, g, or t
  misc_feature (3729)..(3729): n is a, c, g, or t
  misc_feature (3762)..(3762): n is a, c, g, or t
ggacagccgctggactccagtcatatcgccagcatccgcatgggcaccacagtggccaccaacgcactgctggagcggaagggggagcgggtggcgctgctggtgacacgtggcttccgagacctgctgcacattggcacccaagcccgtggggacctctttgacctggccgtgcccatgcctgaggtgctgtatgaagaggtgctggaggtggacgaacgcgtggtgctgcaccgtggagaggcgggcacgggacgcctgtgaaaggccgcacgggggacctgctggaagtgcagcagcctgtggacctgggggccctgcgtgggaagctggaggggctgctatctcgaggcatccgcagcctggctgtggtgctcatgcactcgtacacgtgggcccagcatgagcagcaggtgggtgtgctggcccgggagctgggcttcacgcacgtgtcactgtcctcggaggccatgcccatggtgcgcatcgtccctcgggggcacacggcctgtgccgacgcctacctcacgcccgccatccagcgctacgtgcagggcttctgccgtggcttccagggccaactcaaggatgtgcaggtgttgttcatgcgctccgatggcggcctggcgcccatggacaccttcagcggctccagtgctgtgctctcgggcccggccggcggcgtggtgggctactcagccaccacctaccagcaggagggtggccagcctgtcatcggctttgacatgggaggcacgtccacggatgtgagccgctatgctggggaattcgagcacgtcttcgaggccagcacagctggcgtcaccctccaggccccgcagctggacatcaacaccgtggcagcgggagggggttcccgcctcttcttcaggtctggcctctttgtggttgggcccgagtcagcaggagcccacccaggacccgcctgctaccgcaaagggggccctgtgacagtgacggatgctaatctggtcctgggtcgcctgctgcctgcctccttcccctgcatttttgggccgggagagaaccaaccactttcccctgaggcctcccgcaaagccctggaggctgtggccactgaggtcaacagcttcctgaccaacgggccctgcccggcctccccgctgagcctggaggaggtggccatggggttcgtgcgcgtggccaacgaggccatgtgccggcccatccgtgcactcacgcaggtacgtccacctctgctctcccgcctgtcctgcccccagcctttgtggagcggtacatgagggagtttggctttgtcatacctgagcggccggtggtcgtggacgatgtgcgagtgcggggcaccggccgcagtggtcttcgcctcgaggatgcccccaaagcccagaccgggcctccccgggtggacaagatgacccagtgctactttgaggggggctaccaggagacccctgtgtacctgctggcagagctgggctatgggcacaagctccatgggccctgcctcatcatcgacagtaacagcaccatcctggtggagccaggttgccaggcagaggtgaccaagacaggggacatctgcatctccgtgggggccgaagtccccggcacagtgggcccccagctggaccctatccagctgtccatcttctcacaccgcttcatgagcattgctgagcagatgggccgcatcctgcagcgcacagccatctccaccaacatcaaggagcgtctggacttctcctgtgccctctttgggcccgatggggggctggtgtccaatgccccccacatccctgtgcacctgggtgccatgcaggagacggtgcagttccagattcagcacctgggggccgatctccaccctggcgacgtgctactgagcaaccatcccagtgccgggggcagccacctgccagacctgactgttatcacaccggtgttttggccgggtcagacgcggcctgtgttctatgtggccagccgagggcaccacgcagacatcgggggcatcacaccaggctccatgcccccccactccaccatgctgcaacaggagggtgccgtctttctgtccttcaaacttgtccaggggggcgtcttccaggaggaggcggtgacggaggccctgcgggcgccaggcaaggtccccaactgcagcggaaccagaaacctgcacgacaacctgtcggacctccgtgcccaggtggcagccaaccagaagggcatccagctggtgggggagctcattgggcagtacggcctggacgtggtgcaggcctacatgggccatattcaggcaaacgctgagctggccgtgcgagacatgttgcgtgcctttggaacctcccggcaggcccggggcctgcccctggaggtgtcctcggaagaccacatggacgacggttcccccatccgcctccgtgtgcagatcagcctgagtcagggcagcgctgtgtttgacttcagcggcactgggccggaggtgtttggtaatctcaacgcaccgcgggccgtaaccctgtccgccctcatctactgcctgcgctgtctggtgggccgcgacatcccactcaaccagggctgcctggcgccagtgcgcgtggtcattccccgaggctccatcctggacccgtcgcccgaggcggcggtggtgggcggcaacgtgctcacgtcgcagcgcgtggtggatgtcatcctgggggcctttggggcctgcgccgcctcccagggctgcatgaacaacgtgaccctgggcaacgcccacatgggctactacgagacggtggcgggcggcgcgggcgcgggtcccagctggcacgggcgcagcggtgtgcacagccacatgaccaacacacgcatcaccgaccctgagatcctggagagccggtacccggtcatcctgcgccgcttcgagctgcggcggggctcggggggcagaggccgcttccgaggcggcgacggcgtcacccgcgagctgctctttcgtgaggaggcgctgctgtcagtgctgaccgagcgccgcgccttccggccatacgggctccacgggggcgagcctggcgcccgcggcctaaacctgctgatccgcaaaaacggccggacggtgaatctgggcggcaagacgtcggtgaccgtgtaccccggggatgtgttctgtctccacacgcccggcggcggtggctatggggacccggaggaccccgccccaccgccggggtcgcccccgcaagcactggcctttcccgagcacggcagcgtctatgagtatcgccgggcccaggaggccgtgtgaggatcccgcaataaagatgccttaagtctcccggttctggggacgcagctacggcgcctagttcgtgctccnagtngtgtntgtngcgccacngcgcgcccctnatctgtncttgccttaggaggacactgagactcggagctgcaggcgcactgcccggtggtccgtgagcccctccagggcggtactgaacgtcacctgcnccacctcctgggggcgggagtnaggttgagggtcgtcccagtgccgcagccagccacccgggaactccgcggtacgtgatgtagtccaggcgccgacctctccagggcttagctcggcggcttctgccgggaaggccggccaggtagaggtggcgccctttctcctgctccagggccctggtaggggggcggtgtcatcaaggccagggcccctccgcgcgcttngggcgggcagtgcctacatccaggtcgcaactnaccgcctcggcatcttgggggaggaggccatggactggtggagcacggaggtctcagcgcggtccccagggcccagggctgcttttggcgcgtgcccagccggcagggatcctggaaacagcggaagagctcgtgctcc

SEQ ID NO: 669405 - DNA, 2880 bp, Homo sapiens
  misc_feature (65)..(65): n is a, c, g, or t
  misc_feature (90)..(90): n is a, c, g, or t
  misc_feature (105)..(105): n is a, c, g, or t
  misc_feature (233)..(233): n is a, c, g, or t
  misc_feature (241)..(241): n is a, c, g, or t
  misc_feature (2352)..(2352): n is a, c, g, or t
  misc_feature (2356)..(2356): n is a, c, g, or t
  misc_feature (2361)..(2361): n is a, c, g, or t
  misc_feature (2365)..(2365): n is a, c, g, or t
  misc_feature (2373)..(2373): n is a, c, g, or t
  misc_feature (2384)..(2384): n is a, c, g, or t
  misc_feature (2391)..(2391): n is a, c, g, or t
  misc_feature (2483)..(2483): n is a, c, g, or t
  misc_feature (2505)..(2505): n is a, c, g, or t
  misc_feature (2708)..(2708): n is a, c, g, or t
  misc_feature (2741)..(2741): n is a, c, g, or t
atgaggcacaggaaccctgctccctgctctacgcgcctgagaccttcgtgcagctggaccagagnctgagccgcctggaggagcagtgtntggatgctctgcagncccagggcttccaggtcccagatcagcactgagagcttcctgcacctgcgctaccagggcacggactgtgctctgatggtgtctgcccaccagcacccagccacagcccgctcgccccgtgcgggggncttcgggncagcctttgtggagcggtacatgagggagtttggctttgtcatacctgagcggccggtggtcgtggacgatgtgcgagtgcggggcaccggccgcagtggtcttcgcctcgaggatgcccccaaagcccagaccgggcctccccgggtggacaagatgacccagtgctactttgaggggggctaccaggagacccctgtgtacctgctggcagagctgggctatgggcacaagctccatgggccctgcctcatcatcgacagtaacagcaccatcctggtggagccaggttgccaggcagaggtgaccaagacaggggacatctgcatctccgtgggggccgaagtccccggcacagtgggcccccagctggaccctatccagctgtccatcttctcacaccgcttcatgagcattgctgagcagatgggccgcatcctgcagcgcacagccatctccaccaacatcaaggagcgtctggacttctcctgtgccctctttgggcccgatggggggctggtgtccaatgccccccacatccctgtgcacctgggtgccatgcaggagacggtgcagttccagattcagcacctgggggccgatctccaccctggcgacgtgctactgagcaaccatcccagtgccgggggcagccacctgccagacctgactgttatcacaccggtgttttggccgggtcagacgcggcctgtgttctatgtggccagccgagggcaccacgcagacatcgggggcatcacaccaggctccatgcccccccactccaccatgctgcaacaggagggtgccgtctttctgtccttcaaacttgtccaggggggcgtcttccaggaggaggcggtgacggaggccctgcgggcgccaggcaaggtccccaactgcagcggaaccagaaacctgcacgacaacctgtcggacctccgtgcccaggtggcagccaaccagaagggcatccagctggtgggggagctcattgggcagtacggcctggacgtggtgcaggcctacatgggccatattcaggcaaacgctgagctggccgtgcgagacatgttgcgtgcctttggaacctcccggcaggcccggggcctgcccctggaggtgtcctcggaagaccacatggacgacggttcccccatccgcctccgtgtgcagatcagcctgagtcagggcagcgctgtgtttgacttcagcggcactgggccggaggtgtttggtaatctcaacgcaccgcgggccgtaaccctgtccgccctcatctactgcctgcgctgtctggtgggccgcgacatcccactcaaccagggctgcctggcgccagtgcgcgtggtcattccccgaggctccatcctggacccgtcgcccgaggcggcggtggtgggcggcaacgtgctcacgtcgcagcgcgtggtggatgtcatcctgggggcctttggggcctgcgccgcctcccagggctgcatgaacaacgtgaccctgggcaacgcccacatgggctactacgagacggtggcgggcggcgcgggcgcgggtcccagctggcacgggcgcagcggtgtgcacagccacatgaccaacacacgcatcaccgaccctgagatcctggagagccggtacccggtcatcctgcgccgcttcgagctgcggcggggctcggggggcagaggccgcttccgaggcggcgacggcgtcacccgcgagctgctctttcgtgaggaggcgctgctgtcagtgctgaccgagcgccgcgccttccggccatacgggctccacgggggcgagcctggcgcccgcggcctaaacctgctgatccgcaaaaacggccggacggtgaatctgggcggcaagacgtcggtgaccgtgtaccccggggatgtgttctgtctccacacgcccggcggcggtggctatggggacccggaggaccccgccccaccgccggggtcgcccccgcaagcactggcctttcccgagcacggcagcgtctatgagtatcgccgggcccaggaggccgtgtgaggatcccgcaataaagatgccttaagtctcccggttctggggacgcagctacggcgcctagttcgtgctccnagtngtgtntgtngcgccacngcgcgcccctnatctgtncttgccttaggaggacactgagactcggagctgcaggcgcactgcccggtggtccgtgagcccctccagggcggtactgaacgtcacctgcnccacctcctgggggcgggagtnaggttgagggtcgtcccagtgccgcagccagccacccgggaactccgcggtacgtgatgtagtccaggcgccgacctctccagggcttagctcggcggcttctgccgggaaggccggccaggtagaggtggcgccctttctcctgctccagggccctggtaggggggcggtgtcatcaaggccagggcccctccgcgcgcttngggcgggcagtgcctacatccaggtcgcaactnaccgcctcggcatcttgggggaggaggccatggactggtggagcacggaggtctcagcgcggtccccagggcccagggctgcttttggcgcgtgcccagccggcagggatcctggaaacagcggaagagctcgtgctcc

SEQ ID NO: 669406 - DNA, 217 bp, Homo sapiens
gtgtgaggtactctagagatccctgtggctactgctgagactgggggtaaccagtcccgaaggcactactggccagtctacaaccagtattctcagagataccatcagagaacaaacactaatgttaattgcccaacttgagtgcttcatgccgtttagaatgtacatggctgacagcagaagattcccgcagaggggtaccgacgctcgacattcg

SEQ ID NO: 669407 - DNA, 3840 bp, Homo sapiens
  misc_feature (3312)..(3312): n is a, c, g, or t
  misc_feature (3316)..(3316): n is a, c, g, or t
  misc_feature (3321)..(3321): n is a, c, g, or t
  misc_feature (3325)..(3325): n is a, c, g, or t
  misc_feature (3333)..(3333): n is a, c, g, or t
  misc_feature (3344)..(3344): n is a, c, g, or t
  misc_feature (3351)..(3351): n is a, c, g, or t
  misc_feature (3443)..(3443): n is a, c, g, or t
  misc_feature (3465)..(3465): n is a, c, g, or t
  misc_feature (3668)..(3668): n is a, c, g, or t
  misc_feature (3701)..(3701): n is a, c, g, or t
ggacagccgctggactccagtcatatcgccagcatccgcatgggcaccacagtggccaccaacgcactgctggagcggaagggggagcgggtggcgctgctggtgacacgtggcttccgagacctgctgcacattggcacccaagcccgtggggacctctttgacctggccgtgcccatgcctgaggtgctgtatgaagaggtgctggaggtggacgaacgcgtggtgctgcaccgtggagaggcgggcacgggacgcctgtgaaaggccgcacgggggacctgctggaagtgcagcagcctgtggacctgggggccctgcgtgggaagctggaggggctgctatctcgaggcatccgcagcctggctgtggtgctcatgcactcgtacacgtgggcccagcatgagcagcaggtgggtgtgctggcccgggagctgggcttcacgcacgtgtcactgtcctcggaggccatgcccatggtgcgcatcgtccctcgggggcacacggcctgtgccgacgcctacctcacgcccgccatccagcgctacgtgcagggcttctgccgtggcttccagggccaactcaaggatgtgcaggtgttgttcatgcgctccgatggcggcctggcgcccatggacaccttcagcggctccagtgctgtgctctcgggcccggccggcggcgtggtgggctactcagccaccacctaccagcaggagggtggccagcctgtcatcggctttgacatgggaggcacgtccacggatgtgagccgctatgctggggaattcgagcacgtcttcgaggccagcacagctggcgtcaccctccaggccccgcagctggacatcaacaccgtggcagcgggagggggttcccgcctcttcttcaggtctggcctctttgtggttgggcccgagtcagcaggagcccacccaggacccgcctgctaccgcaaagggggccctgtgacagtgacggatgctaatctggtcctgggtcgcctgctgcctgcctccttcccctgcatttttgggccgggagagaaccaaccactttcccctgaggcctcccgcaaagccctggaggctgtggccactgaggtcaacagcttcctgaccaacgggccctgcccggcctccccgctgagcctggaggaggtggccatggggttcgtgcgcgtggccaacgaggccatgtgccggcccatccgtgcactcacgcaggtacgtccacctctgctctcccgcctgtcctgcccccagcctttgtggagcggtacatgagggagtttggctttgtcatacctgagcggccggtggtcgtggacgatgtgcgagtgcggggcaccggccgcagtggtcttcgcctcgaggatgcccccaaagcccagaccgggcctccccgggtggacaagatgacccagtgctactttgaggggggctaccaggagacccctgtgtacctgctggcagagctgggctatgggcacaagctccatgggccctgcctcatcatcgacagtaacagcaccatcctggtggagccaggttgccaggcagaggtgaccaagacaggggacatctgcatctccgtgggggccgaagtccccggcacagtgggcccccagctggaccctatccagctgtccatcttctcacaccgcttcatgagcattgctgagcagatgggccgcatcctgcagcgcacagccatctccaccaacatcaaggagcgtctggacttctcctgtgccctctttgggcccgatggggggctggtgtccaatgccccccacatccctgtgcacctgggtgccatgcaggagacggtgcagttccagattcagcacctgggggccgatctccaccctggcgacgtgctactgagcaaccatcccagtgccgggggcagccacctgccagacctgactgttatcacaccggtgttttggccgggtcagacgcggcctgtgttctatgtggccagccgagggcaccacgcagacatcgggggcatcacaccaggctccatgcccccccactccaccatgctgcaacaggagggtgccgtctttctgtccttcaaacttgtccaggggggcgtcttccaggaggaggcggtgacggaggccctgcgggcgccaggcaaggtccccaactgcagcggaaccagaaacctgcacgacaacctgtcggacctccgtgcccaggtggcagccaaccagaagggcatccagctggtgggggagctcattgggcagtacggcctggacgtggtgcaggcctacatgggccatattcaggcaaacgctgagctggccgtgcgagacatgttgcgtgcctttggaacctcccggcaggcccggggcctgcccctggaggtgtcctcggaagaccacatggacgacggttcccccatccgcctccgtgtgcagatcagcctgagtcagggcagcgctgtgtttgacttcagcggcactgggccggaggtgtttggtaatctcaacgcaccgcgggccgtaaccctgtccgccctcatctactgcctgcgctgtctggtgggccgcgacatcccactcaaccagggctgcctggcgccagtgcgcgtggtcattccccgaggctccatcctggacccgtcgcccgaggcggcggtggtgggcggcaacgtgctcacgtcgcagcgcgtggtggatgtcatcctgggggcctttggggcctgcgccgcctcccagggctgcatgaacaacgtgaccctgggcaacgcccacatgggctactacgagacggtggcgggcggcgcgggcgcgggtcccagctggcacgggcgcagcggtgtgcacagccacatgaccaacacacgcatcaccgaccctgagatcctggagagccggtacccggcgacggcgtcacccgcgagctgctctttcgtgaggaggcgctgctgtcagtgctgaccgagcgccgcgccttccggccatacgggctccacgggggcgagcctggcgcccgcggcctaaacctgctgatccgcaaaaacggccggacggtgaatctgggcggcaagacgtcggtgaccgtgtaccccggggatgtgttctgtctccacacgcccggcggcggtggctatggggacccggaggaccccgccccaccgccggggtcgcccccgcaagcactggcctttcccgagcacggcagcgtctatgagtatcgccgggcccaggaggccgtgtgaggatcccgcaataaagatgccttaagtctcccggttctggggacgcagctacggcgcctagttcgtgctccnagtngtgtntgtngcgccacngcgcgcccctnatctgtncttgccttaggaggacactgagactcggagctgcaggcgcactgcccggtggtccgtgagcccctccagggcggtactgaacgtcacctgcnccacctcctgggggcgggagtnaggttgagggtcgtcccagtgccgcagccagccacccgggaactccgcggtacgtgatgtagtccaggcgccgacctctccagggcttagctcggcggcttctgccgggaaggccggccaggtagaggtggcgccctttctcctgctccagggccctggtaggggggcggtgtcatcaaggccagggcccctccgcgcgcttngggcgggcagtgcctacatccaggtcgcaactnaccgcctcggcatcttgggggaggaggccatggactggtggagcacggaggtctcagcgcggtccccagggcccagggctgcttttggcgcgtgcccagccggcagggatcctggaaacagcggaagagctcgtgctcc

SEQ ID NO: 669408 - DNA, 2503 bp, Homo sapiens
ggacagccgctggactccagtcatatcgccagcatccgcatgggcaccacagtggccaccaacgcactgctggagcggaagggggagcgggtggcgctgctggtgacacgtggcttccgagacctgctgcacattggcacccaagcccgtggggacctctttgacctggccgtgcccatgcctgaggtgctgtatgaagaggtgctggaggtggacgaacgcgtggtgctgcaccgtggagaggcgggcacgggacgcctgtgaaaggccgcacgggggacctgctggaagtgcagcagcctgtggacctgggggccctgcgtgggaagctggaggggctgctatctcgaggcatccgcagcctggctgtggtgctcatgcactcgtacacgtgggcccagcatgagcagcaggtgggtgtgctggcccgggagctgggcttcacgcacgtgtcactgtcctcggaggccatgcccatggtgcgcatcgtccctcgggggcacacggcctgtgccgacgcctacctcacgcccgccatccagcgctacgtgcagggcttctgccgtggcttccagggccaactcaaggatgtgcaggtgttgttcatgcgctccgatggcggcctggcgcccatggacaccttcagcggctccagtgctgtgctctcgggcccggccggcggcgtggtgggctactcagccaccacctaccagcaggagggtggccagcctgtcatcggctttgacatgggaggcacgtccacggatgtgagccgctatgctggggaattcgagcacgtcttcgaggccagcacagctggcgtcaccctccaggccccgcagctggacatcaacaccgtggcagcgggagggggttcccgcctcttcttcaggtctggcctctttgtggttgggcccgagtcagcaggagcccacccaggacccgcctgctaccgcaaagggggccctgtgacagtgacggatgctaatctggtcctgggtcgcctgctgcctgcctccttcccctgcatttttgggccgggagagaaccaaccactttcccctgaggcctcccgcaaagccctggaggctgtggccactgaggtcaacagcttcctgaccaacgggccctgcccggcctccccgctgagcctggaggaggtggccatggggttcgtgcgcgtggccaacgaggccatgtgccggcccatccgtgcactcacgcaggtacgtccacctctgctctcccgcctgtcctgcccccagcctttgtggagcggtacatgagggagtttggctttgtcatacctgagcggccggtggtcgtggacgatgtgcgagtgcggggcaccggccgcagtggtcttcgcctcgaggatgcccccaaagcccagaccgggcctccccgggtggacaagatgacccagtgctactttgaggggggctaccaggagacccctgtgtacctgctggcagagctgggctatgggcacaagctccatgggccctgcctcatcatcgacagtaacagcaccatcctggtggagccaggttgccaggcagaggtgaccaagacaggggacatctgcatctccgtgggggccgaagtccccggcacagtgggcccccagctggaccctatccagctgtccatcttctcacaccgcttcatgagcattgctgagcagatgggccgcatcctgcagcgcacagccatctccaccaacatcaaggagcgtctggacttctcctgtgccctctttgggcccgatggggggctggtgtccaatgccccccacatccctgtgcacctgggtgccatgcaggagacggtgcagttccagattcagcacctgggggccgatctccaccctggcgacgtgctactgagcaaccatcccagtgccgggggcagccacctgccagacctgactgttatcacaccggtgttttggccgggtcagacgcggcctgtgttctatgtggccagccgagggcaccacgcagacatcgggggcatcacaccaggctccatgcccccccactccaccatgctgcaacaggagggtgccgtctttctgtccttcaaacttgtccaggggggcgtcttccaggaggaggcggtgacggaggccctgcgggcgccaggcaaggtccccaactgcagcggaaccagaaacctgcacgacaacctgtcggacctccgtgcccaggtggcagccaaccagaagggcatccagctggtgggggagctcattgggcagtacggcctggacgtggtgcaggcctacatgggccatattcaggcaaacgctgagctggccgtgcgagacatgttgcgtgcctttggaacctcccggcaggcccggggcctgcccctggaggtgtcctcggaagaccacatggacgacggttcccccatccgcctccgtgtgcagatcagcctgagtcaggtgggccgtggggagagtgcctctaggcggcaggggcacggtgcggccgct

SEQ ID NO: 669409 - DNA, 857 bp, Homo sapiens
cggaagccctcactgcgctgacggtggctctcggaactcgaatgatggacccagcattcggggggcatcatccacgttggacccacacttcgtgcattgtactgcaccagtcaaactctgtttcgctacaaggagcctaggtgtagtctacattgggtgtcctatagaactaccctcctggacgaatacactcagacgcctcactaggaaatctgccactttctgtcttacggacagcagctcccgagtcgaggcactatgagagacgtactgacgctaaccctaaagcaaggagccagtaggctctcatcaatagagcaggaagttgttcgccctgactcaggagcctgccagatgcaactacgggtctcacgctggaaacatgatcacactgcatcaaactctggtcacgtggccctccgtagcacttacttgggatacctctctgttccgcccaagatcccctgtgctattcaggaaagcatgtcccatcagaaacactctcggggggcaatggtagcactcaccctgaaactgatgtatgctaaagccacagagatagagctgatggagtcgtgtgctccccagcaaggagcacccagggatcatctttactacggtatcactgtgtcctcttggaacactaattcgtctgtagcatactggtctgcacggatctactgaggaggaattggacagtggtctcttattgagtgtcagagggaaccttgagacgccagcttaaattggctcttgcagcagaggattatcagaaatagtttcgatgagctaagtacacattctaaagatgcaaaggatcctcctggcggcagtagccttgacaagggcaatacccc

SEQ ID NO: 669410 - DNA, 857 bp, Homo sapiens
ggcgaaacaagactagaaataattgctgagggcttatagggaagtgatttaagagagaaaaagacaaacaacaacaaaaaaaactcttcggaataaagagggctgtaaattttgaattccagtgtcgagatccgtttcaagcactgagaaattctttctcaggtttcttgtttttgggggagacaggggtctgtgctctgtcaccgcagactggaacacagtggcacgatcttggctcactgcaacctctgcgggctcacgcaatcctcctgccacagcttcccaagtagctgggaccacaggcgtgagccagccacgtgctggccagattttcgtatttcagttattgtattcggtagcagacggggtctcggccatgttgcccaggctggtttaaaacgtcctgagcttcaagcagttctccgcaccggggcctcccaaaattgctaggattcacagacgttgagccatatatgcctgtggccaggttcctggtgggagacccagaatggtggacaagaccattggtttacttcgggaatcaccagaattgggcagctaactggtgccgaaagtggacgggctgccggggcccatcagaatgccctcgggcccagggcacactcagcagaagggcaccaaacccaggtgcgggtctcatcaagaaagaggggaaggcccttcccgagttacgtgcatgtctgagggggctccgcactgggctgactgattttatagtcatggctctctagagaagcccaggcttggctccttatagcgaaaactttctgacctctgctgggcaattttatcctttactcctacttctggccaagagacctgaatgctgcataagg

SEQ ID NO: 669411 - DNA, 137 bp, Homo sapiens
gtctagaggatccggggtcctgagatatcaacattaatatagttctcagtgaaacgaaaaaagtggatggaaataagccctaattaaaatttagcgtatactaagcttttaaaatccattatagagaagtattattt

SEQ ID NO: 669412 - DNA, 301 bp, Homo sapiens
  misc_feature (38)..(38): n is a, c, g, or t
  misc_feature (54)..(54): n is a, c, g, or t
  misc_feature (191)..(191): n is a, c, g, or t
  misc_feature (296)..(297): n is a, c, g, or t
aagtaggaccctagtatcaagtatttaaaaaatacctntcctgccgggcattgngtgtcacgcctgtattcccagcactttgggaggccgaggcgggcggatcacaaggtcaggagttcgagaccagcctggccaacacagcgcaacctcatctctattaaaattataataggccaggcgcggtggctcanacctgtaatcccagcactttgggaggccaaggtgggcggatcatgaggtcaggagatcgagaccatcctggctaacacggtgaaaccccatctctactaaaactnnccaa

SEQ ID NO: 669413 - DNA, 134 bp, Homo sapiens
gtatccccctcttgaagcgtgctgacaggtcccccctagcaccattccacaattctgtgtacacccacttggctgtcgcctcctagctgatgccactcccatcacatccccctagatctacagctctccccatg

SEQ ID NO: 669414 - DNA, 422 bp, Homo sapiens
tcaggctccccaacttgtcccccagcctccacaagagaccctgctcattcatgtatgggctgaggtcctttgaaaattggacctcaggccaggtcactccctgaaacctgaaactcttcagtggcatctcactggatatatgggaatgccacagaataaacctggctgcatctatcaagtttcctaacagcagagaagacatctatcttttcactgctgtgtccctggtacgtagaagagggcctggcaaacaggagaaactccatgcttgaggaaaggccatctgaggacatggagagaagacagccagccttttgcaacccaaagagagaagcctcaccagaaccgagtctgcctgtgccttgatcttagactttctagtctccaaaactgtgataaataaatgtctactgtccaaggca

SEQ ID NO: 669415 - DNA, 421 bp, Homo sapiens
tgatttttctttctcatgggaagcagatagaattaacagactgtggctgctgtttttaaacaaggtatgccagtatctgtatcccttctgagatgcgttgtgtttcttcagtgagggagaacatgtaattaatccctgttgaaagcccttttatttagaaatcatgcttgcttttactctttattatttggatatatatctatgtctggaaatagactgagaggaaacttgcctgttgatatcttaataaaagtaattaaaacattcccagggccaggactaggatgaggtgagtgaggcacttgcttcagctgtaaaatttaaggctacgccaaaaaactcagtaatccaaataaatattttcatgtgatattaaagaaagttaaatctaatgccaagcaatctataatcaaatatcaaa

SEQ ID NO: 669416 - DNA, 290 bp, Homo sapiens
cagctgactcctgaggataaaaactcggcgaggtgccacgttaaagtggttaaagtcctatctggaagtggaaaaaatcagggtgaccagaaaataatgaatacatgattgatatggggtggctgcgtctcctcacccaaaatctcatttttaattggaatccccataagcctcaagggcaggaccaagtagatgtaattggatcatgggggcagtttcccccatgctgtccttatgatagtgagtctcaagagatctgatggttttttaagcatgtggcatttcccctg

SEQ ID NO: 669417 - DNA, 342 bp, Homo sapiens
cgggttggcacccaggggttggctatcccatttggggccgatgagaaagatgccaagatccccaatgatgggcagggtcgctttgggggcaatattagtgggcggcccggtgggaaagacctcccctcctcccttggaccggcccgggggaagactcgccccttttgggatggggccggctggccctccggagggggcccccggggggggggggaagggggaaattttggcccccccccctggcggcccccccccccggggttcccttttttgggtcccccccccccctggacccccctttttggtttggcaggattttttttttcccaaactaaaaatgga

SEQ ID NO: 669418 - DNA, 123 bp, Homo sapiens
ggcaacaggtcaaaaagagcctttattacttttgatgattgccacttatgctttcctgccagatgcctttggagcagagtagctttgtgggctgaagctttttgccccttctgtcgtcttctc

SEQ ID NO: 669419 - DNA, 1121 bp, Homo sapiens
cgctgcctgggagactgctgcctacgtgcccggactgcgcccgcgcccccgcgtgctggagggtgatatctagaaagtacaatgaagacatacatccggaatatatatgccacggcacctacgacccagcgtacggtggacagcataggaccgtagcataccctaccgtggcctaggtgaacggcctaggccctagcagctacaggaacaccagccggtcggaggaggaccggaacagggacctaggccactagccctaggagcagctagctgcaggcctaccctagagacataggagaaggagaagaccatgctggtgctaggccctgctgctaggccaacgaaggtggccagtcacacgcctgtcctatgctccgtgatgtactttcacacaacagtgaatttacattaaccagaacctacgcacctacgtgaggagcttagccagaactggcgatggactgcacacggacagctccagcacactgtagactggctcaaagctcgatgtaggtacacatgctagtatagctagcttccagtgtagacggagccctggcatagtcaacaagcgtaacctaggacacgcaccgcgcctggcaacactacctgtgaccacacaattctaaacgaccactgtatcacacttactactcccactatcacccactatctacacttaattacaccttgacacttgcaccctcgtccactttatcaccgctacttccgcaattgcgccttccatatacatcccacccaccttgcaatactgaaccatcactgctaaacttcctacaccactgtgagcccctaaattaccacatgagccaggttcccaaactaaacacacataactgggacaacgcaggtacacagggtacagtatcaaccgaacagtatacacagtgtatatgggtcaacagataacgaccataacgtgagactatcacgagcataacagcacgaagggcaatggctaatcaagctcgcgccgaacctctgctatgaaggaaactatgcaagtaccacaagaaacatcaacccccttccacttcaacacttcagtcacactaggaccataatgaaaacaactagcagccccacttcctggtagaccg

SEQ ID NO: 669420 - DNA, 848 bp, Homo sapiens
gcgaagaaaactacggctaggtacgaggctgggttttaaattcggccgagccggctgctgcggacctcctcgtgacccggacccagccccatgcccggccccagccagccccgacggcgccactgcggggtccgatgcggggctctgtggctgctcctggctctgcgcaccgtgctcggtggcatggaaggtgctggctggtgcgccaccttcggacccagtagcagcacaaatgtgctggctaaacaatgagcgaggccttccgtggaacgtcgggtcaatccatgcccttccctcctctgcagtccgggtgctacctccgcccgtaccacttgctgtccatgcctcagtctgcgtgcacccaagcgacggctagacggccgatcaacttctttggatcgtgaagcgacgccaatcctaatatatgcgccgtggaaaggcgacgctacggtgcctttggaacgccagttgtgcgttggggctgaatgttgtcactgaatctaagacgcgctcggataccctctcctaaattaccgccggcttgggctcgttcgtgtcccatggcgaaagtgcatgcctccccaattgatcgacccaattttcgactaccccctcgtagaagggcgggtttaaaaaagctccccgttgccgcaagcatcagggggcccagtctcaatttgcttcccatcaaggattgcggggcttggtgaacccttgtttgccccctgtttggcgggccttacccccttgtggtagcgaaggaatgcctgtgccccgcgacttcgtccgggctgaatgtgcgcgcttcgtcggaacttgtacctccctagaaggcgttgttccacagc

SEQ ID NO: 669421 - DNA, 132 bp, Homo sapiens
ttgctgacaggtcactctagaggactccccaatgatagtatgactgggtagtattggttatggttccttgtccgcgcgagtatattgttggaagaggatagctatcagaaggattatggatgcggtggcttg

SEQ ID NO: 669422 - DNA, 507 bp, Homo sapiens
tgcttttcaccatttcttaaggaaatcatgttctcttaaaaggttggttctaagaattccaagacggaaacataatggaatggtagaagactgtaaataaatgacaaaaatttgaatctgtgatctataaaatattatcaaggagattatagatctctaagaggttacgtgagttgctggaagtaaaaaggaaacgtgttatttctcatttggactttgtctaaaatattatgtttaaatgaaacttctgctttagtgctatattcactgtttattctcttgaactttcctgagtaattatgataaataggcctaaagaaagtgcgtgttcttgtttgaattcacagtgatatatgttggtgtcttaatctctttactttcagtcagaattttaaaaaactgatattttgattgtttttataaaactgtatttcaaattgttttatacatttatgctactgtctcctctacgtaaataataaacaaaaagttgcccttaaaaaaaaa

SEQ ID NO: 669423 - DNA, 265 bp, Homo sapiens
  misc_feature (149)..(149): n is a, c, g, or t
ggatgctcgggtccagcaccgtcaacccatcgagaatcaggtgatgggcagcgatatcggcggcggtcaccggcgaagcatcggccttgtccatgacctgcacattcgcccgccagaacggcaggatcacctcgccgacgcggccaggntcagatcaccggggccaggtaggggtgcggcagattcgaaaaaaactcactcacgattgaaaaactccacgctgggtcaacaggtctcgcgccaggtacaacgccgccaggcccgc

SEQ ID NO: 669424 - DNA, 291 bp, Homo sapiens
tgagaggggagctatttggaaacctgtgggtacaaaggagaggttaattccagacccacgtatagaatgttttgaccagagactaccatctaaaccatccagacctacgaaggatcaggcaatattccacaaacagtggaaaatcggttgcctaagatggtaacaaccccatagcaagcagcattgagcactacgactcatcgtgagctacatgccagtcacgatggcacctctttcctcagaacacacgatgtaccccgatgaacgtataatcaacaagatcgtatgcga

SEQ ID NO: 669425 - DNA, 158 bp, Homo sapiens
  misc_feature (9)..(9): n is a, c, g, or t
  misc_feature (82)..(82): n is a, c, g, or t
  misc_feature (114)..(114): n is a, c, g, or t
  misc_feature (119)..(119): n is a, c, g, or t
  misc_feature (141)..(141): n is a, c, g, or t
  misc_feature (158)..(158): n is a, c, g, or t
aactctgtngcacttatttggtgcgccaagattcatagctgtgatgaggagtgcctggcatacaagcactatataagtgttngatgacatcatcatagtcactgtcatcatcancatanataaaccatcaagagcagaagntcagaatatgacggggn

SEQ ID NO: 669426 - DNA, 263 bp, Homo sapiens
agcgggttaacaatcactgatccaggaggtggaggttgcagtgagccgagatcacgccattgcactccagcctgggtgacagagcaagagtctgtctcaaaaacaaaacaaaacaaacaaacaaaggccgggcacagtggctcaagcctgtaatcccaccactttgggaggactacctgtgagcgaccgcgcctggactgttcttcccagtgttacatgacagctagatttgcactctcctctctccagtagtttgaaacttt

SEQ ID NO: 669427 - DNA, 686 bp, Homo sapiens
tgtcacactcaaaaggaatgcaacaaccgccccccgtctctccgggggttgcgcgcccccccccccttatgggccccccagggcgacgcacacccgaggctgtctgacgaagcgcacggagacatttacaataaaggagactcaactgggtggaccacctccagaacacgcgttgagtcctccaacttgtggagattttgagatatcccaccctctccttccgcagcaaacaatgtcaggtctggaccacagcagcccccctggtgggtggaggcccacaagcgatccccccactggggccccgccacacaagaatagggagccgccctcgcccctccccccaaaaaacatgtggggtgaaatacgggccccccgcctctccaaccagcccccgataggtaggccccctccccacacttatagcctgcaacaacagcgaggaggcactcacaggtctcgccgcccgtgatgcagtagcgatcccccgggtcatttaccccatatcccactattgtcacccaaaaactttacaacatccttctcctcgggcaagactcatccggtatttaacagtctctccccccttcctccgactccgtcattgtagagatcttcattggtcaaacgttctcgctatgaacacttctcccattcaagaaaacagtagttcgcccccacaatgacaa

SEQ ID NO: 669428 - DNA, 359 bp, Homo sapiens
ggggatcgcctcgttaatgctccgggtgattttcgtggaggttgataacttggctcgcagtagattttctttaagagaaggggccgttccatgcataccctcaaaagtattttcctgtaaaaaaaaaaaggtataatggtttggttgccatcctacattcgggtggtacccttggatgttaccacactttgtaataattgtaccgaatagctgtatcgaacccggtggtacccaatattgggtgggatttattggtgttaaccaatttaacccccttttggtcccttttttttccaaaaaatacttccccgaggcggaggtccggggtaatttcttgcccgtctcgttcacaaaatggt

SEQ ID NO: 669429 - DNA, 301 bp, Homo sapiens
  misc_feature (9)..(9): n is a, c, g, or t
  misc_feature (18)..(18): n is a, c, g, or t
  misc_feature (26)..(26): n is a, c, g, or t
  misc_feature (62)..(62): n is a, c, g, or t
  misc_feature (153)..(153): n is a, c, g, or t
  misc_feature (157)..(157): n is a, c, g, or t
  misc_feature (183)..(183): n is a, c, g, or t
caagtgaanacactcatntccacccntgttggttctgtgggatccggtcctcaccactgccngcgccagagggcgcactggcgtgcagacaggccgtggtgctgttcggagacgtcgctgggactcgccgaagctccaggcccagagaagagncgtnacgctgccccgaatcttcacctgcantcctgagcatccctggctggcgctaagtccaaccacatggagacttcagatctcggaaggcatcgaggggagccaggctgacctccgcctgtcctgtgcggtctaccactgtatgaag

SEQ ID NO: 669430 - DNA, 1185 bp, Homo sapiens
gcgacgggtctgtgctcaagagcggacaggtgctgcagcgagataagatgaaactggtggctgccggtggggatgtgtgtaggcttcagagcacatggtgatcacggaagactgaagcagaaacagtggattaagacttcgctgagcgatagctaggcactgccttccccacaatggcatgagtgtgtgttggctgagtgttggccgatgatgccaagcatcaggagtgtcaatccatgtgtggcatggtcgtgacggacttgtccaagcaccccctaaattgttctgaccatgaacgatttgaattggtgacggcactgctacagcagcacgcacacggtggaaccgctggacgaaaattggaagcaaccgcccgtattggcggcggcgcatgagggggccctccggttttgtgacccctattccacagttaccccagtgttccatatttcctttttcgccacatccagattccaccgccaagtgatcatccacgttagtttgcgccttcctttggagaataggactgaattggggtattggcagcgcgaccacgtggcccgccagtattccgcgtttacagtttaactcacacctcctacgttaccaaagtcacttttatggagaggcacgcgggtgagcaactcagacggcgattatccaacctcttacccatatccccacatcccgaaacccccccatagtagtgacatggcaccaaggctgaaccacgttgttacccgttttggcctcttgtgatccataccacgcaagggacatggtcaaggtggccgaccgtatgacgcccatcactgcacgccgacagtgctccacactcactctttggctgcactttccgtgcggaggaccgcccgccctcattttgtgccgcacaccggcgttaccctacaagatgacgtgaaaacagtagggctccactcactattttggtcagtcataataagtagccacctccctacagtagtgcaaagaggagacatcttgtggtcactaatatcgggtgacaatcatcaatgcggaccgaatccctaccgcaatttttaacgcacaaatcggatcgagtaattaggacaattgtgaaccacgtcgtggtcaatgtcaaccagatgtctattaccgatatcttcacgccacttcacatttccgccacacgaatgatttcat

SEQ ID NO: 669431 - DNA, 472 bp, Homo sapiens
tttgagaatgaaatgtttctcatcatagtgtattcttattcacgttctccacgtatgcgttgtgctatgctggatgtcttttggcataatttttacacgtttggttatggatagtatacaggttggtgtcttcaaaaaggccaaccagataggcctcacttgtctccttcaaatcaccgatagctgcgttctgtaagcgagactctgttttatagtcctgatgcaatttctcgcaccagacgttggatgggaattttgcgaatcagaagttcagtggacttctgattacgtctaatttcacggagcgctacattacttggcctgtaacgtttaggtttcttcactcctctagtatagggcgtactcttgtcatcggcttttgtagccagtttgctccggtgggtcttaccaccgttctatttgtcgtgagtctgttttgtacgaaccattgttccaagaccccttatctacc

SEQ ID NO: 669432 - DNA, 377 bp, Homo sapiens
ggactgcgtgctcacggtgctctactcgtgctgggtgcacatgtcggttatggttgcattggtgcccagacgttgtgcggtcatcattcatgactcctatgtaccttctgttcggctaaccatcatacggtaggcttgcgactgacccgagtacgggcgttggttccggctgtcacaccttgtagctgcttcttcgctcatgaccagtgttgccttttatctgtccagcacagaagagtcgttgacccacatgagtctccgtggaatgtgtgatctgacggtggatctcagttatcatactgaacgccgtagcctggcggggggaggttgtggtgagccgagatcgctccattgcactccatcctgtgcggcaagag

SEQ ID NO: 669433 - DNA, 860 bp, Homo sapiens
ctgcgggtccaagccatgaattgggagtacctcggtcaatggtggaaagttgtcccaagctggtacctgccgcattgtcttaatgggctcaaaatagctatggtttttcaaaggaacgcttctcccgcctgggggacacttttcggactgtcgacagagtcacctagtcgcatccatgcagcccctgcctaacatggccgctcagtcttcccaccctggtctcgcggtcctgctgtacctggcttattatcacttcacgtggagcatgtcctcccggaagcgcctggctcggatctctcagtaagcctgtgtctgtgtcaaagcggtgcccgccagactgttcgcaccagcatcgcttgggcctcgcggggtgcgagccttagaacttgctctttggagctctggccatcttgccacctggacctacctggggctccctgtttgatgtcgatgtggatgacaccacagaggatgcagggctactgcgcatggcatacatctgtcacacaagtgtttcagagatcagactgggccagtcacatgggtcacttttggatgctggatcttctaccgtgctgcataggctgaggcacatctgtggaccctcataaccctctttagacccctctcagggtgccactgatgggggatgagggaagaccctctctctattctgtgaccccctccatcctagacccccacacctctacacacactacacacacacacacacaaaatcacaccattttcatgcatgtccatttcaccaccccaccacaaggcaggtagggggtgtgcctgctggggcctagagggggatgcttggggtaacagagaaggggagatacatggcctcccgc

SEQ ID NO: 669434 - DNA, 376 bp, Homo sapiens
gcccgagggttcaaactttccccagggcaaagaatgagggaaaggaaaaaaagttttagaaaaaaactttccggcatttcgagactcaaaaaaaacccccctgatttacaaaaaaaaaccaggaaaggggttttgtgtggtcggctctttctccgggaacttgaaaaacttaggagtcatggggtggcaaccccgggggttttccaaattttccatctaggccctattatgagattgagttttatttttaccacttggctaaccagagcccaagggtaagtttttcaaaattttcaccagcgggcaaacccaaaggcaaagggtggacaaagttgggttaaaatccattgaaaaataaaaattggggggttttcca

SEQ ID NO: 669435 - DNA, 148 bp, Homo sapiens
ttcaggacgtacagaagtaagagtgaccctattatgcttctcaaggaccagtatggtgaacagcaatcttgcaagtatggaagaactaaaggaaattgattgtgcgaagtgaggaaggagattgacggatgcatgcccagatttgtcc

SEQ ID NO: 669436 - DNA, 952 bp, Homo sapiens
aaatgatgtcacaaatggggaaagtagctaattgaaatttacaaaatgataaaaatgaggtataacatatatgacctgttccttgtgaaaaccttgctatgacatatatctatgcttgaacttataatgacagtgtggaatgaaaaacagataatacatttgccttgaacatatggtcttttatttacttttacttattcactttacatccaagtcactcccgcacaatccttctcccattcccctttgaattttgttagtgattttttatctctcactctgcttgtattcctctctggataaaggagttagcctcttccagttccatatccccaatgtattgagtcatagctaagctcaccctcattgattcttgagtgccttccttttgtcagatttctgtctcctcctggagattcccccacctcctcacccacttcagttgcagatttccattcatctttgtgaccatttggccatctctcctgtccttcctcgcaccaaatcttaaacccacaattccccttcctaatctcatactccaagttcccttccttcatctgcctcatatgactattttattcccccttctatgtgacattcaagttcctagcttgggtcttccctcttgtttagcctcttggtctgcggagtgtagcatggtacttgaatttatggtaataatcactataagtgagtacataccagctgtcttttcagacaagggtaatcactccaggagaaatatccagttctccattgcaaaaaaaatcctgaatcttgattaaaagcgaaagttccatggggattttccacgtctaccctacacggagaaactaaaggtccagcggttaagagaggcaacagcgccactctcgggggcccggaccaagacggcgaacaccaaactatggtatatcccaaacgctttatgtatttaagctcctcttcc

SEQ ID NO: 669437 - DNA, 114 bp, Homo sapiens
gcctttagtgttgtaatatgtatcctcagtacagctttagttgcatcacacatttgatatgtcatgctttcaatagcactcgaatgctatgcacattgtttattgttatctaga

SEQ ID NO: 669438 - DNA, 235 bp, Homo sapiens
ctttaagaaacccatgctgttctatccctagtctacgtttttctccgtatgttgaaataagattcccacagcttctgatgcgtgtgtttatagccttcaatgaatgtcaacatgttaccaactgagtatccctagagacgccccacaatgctgtagtcttaatagatttgcctttatgtagttttaatcagataggcgtggtccgcacggaagtaacttaaaaagatagggcctg

SEQ ID NO: 669439 - DNA, 415 bp, Homo sapiens
  misc_feature (86)..(86): n is a, c, g, or t
tcagctttgacgtatgtctgtacccgtgaaaccattgccacaatcaagataataaacattttcatctctctcaaaagtttgcctangtctctgccatttcttcctccactcctgtccacgggcaccactgtacagtggtttgcatattctaggattttatataaatgaagtcacacagtatgttctcatttttttcatgatttctttcactcagaataatgattttgagatgacaaatagtttttattgctgggtagaattccattatggataccataatttgtttagccatctatcttgattgacatttgagttattttcagttttagggtgtcaaacaataaggctgctgtgaacgttcatgtacaagtcttgtgtggacaaatgctttcatttcttttgataaatatctaag

SEQ ID NO: 669440 - DNA, 272 bp, Homo sapiens
tggggccttaatgtgcttaaataacgctaattaataataagccacacaaataatgagagtttaatttttttttctcgggcccaccccaattcagcctgtaagggttattatcctcttcaacagccttccctgtatttggctatgtcctctatccccaaagtaatctaccttatttaacactcaagaggtaccatttgtggaaacttcacttgacaaaaacgggctgcaaaggtgaacagaggggaagcttgcccctcttgtctggataattc

SEQ ID NO: 669441 - DNA, 254 bp, Homo sapiens
tgatctaagatctggcgatgatggtgtatgtgccacagtgtgtgtgtgtcttgactgagcagaaggttgtatgaaatggacatcatgtgaaggctgaatagaggttgtatggagggagatggttaaggggctgtaaagtgattctgccggactctgggatgttgcaggagggtggagggtctgctgcgggtgcaagactgaagctgcactctgaccagacaggttacctgaaagctgggggcttttttggagta

SEQ ID NO: 669442 - DNA, 278 bp, Homo sapiens
cccttttaccggttgggcccccttgaaatgcctttggctcccaagggaaccttggagggtttatttggggttttaaaaaataaaattaaaaggctgggctagggtgcttttttttctgaaatttccccctttttaaattcccaaatttggttttggggattgggaagtcttaagccaaattgtccccggtctcccccccgaacataaaaattgtgtgttatcggattgtttaaatttgaaattccctcttttttaatttaaattgtttgggcccttta

SEQ ID NO: 669443 - DNA, 278 bp, Homo sapiens
tagtcctagcttgtctgtcctggtggctccttggtactgttccgtgtcatgtctttgtgaaggcgcatctttcttccttgtggtcattttctatgcttgatgattggagtagttattattgagggcaattgtcccaattctgctagtggatgcttagcagctcttggccaatggagcttgcggtttgatacttggtggatgacatcctcagcgctcttcgatcgcgttagaagtagcgctggtaccagcattgaggagcggcgcatccacctaggaga

SEQ ID NO: 669444 - DNA, 199 bp, Homo sapiens
  misc_feature (147)..(147): n is a, c, g, or t
acctgatagagcatactaacgattcgtaagagaaagtccaggcatgggcctcactttcacatctgcacaggggttctggacactgatggacctcatgaacaaagggctctcagcggaagaacacgatatgtcagagttgacagccanttgagaaagcacataccttgtgatttggtgactcaagaggcttaaaggggta

SEQ ID NO: 669445 - DNA, 104 bp, Homo sapiens
tcaagcttctaacgatgtacggggacatgacaggcattgaatagagtccacagtaatgggatcaaattaattctatcacaagaactggaaccagaggcaaaaaa

SEQ ID NO: 669446 - DNA, 1157 bp, Homo sapiens
  misc_feature (40)..(40): n is a, c, g, or t
  misc_feature (92)..(92): n is a, c, g, or t
  misc_feature (143)..(143): n is a, c, g, or t
  misc_feature (145)..(146): n is a, c, g, or t
  misc_feature (243)..(243): n is a, c, g, or t
  misc_feature (248)..(248): n is a, c, g, or t
  misc_feature (259)..(259): n is a, c, g, or t
  misc_feature (266)..(267): n is a, c, g, or t
  misc_feature (270)..(271): n is a, c, g, or t
  misc_feature (279)..(279): n is a, c, g, or t
  misc_feature (289)..(289): n is a, c, g, or t
  misc_feature (291)..(291): n is a, c, g, or t
  misc_feature (297)..(298): n is a, c, g, or t
  misc_feature (366)..(366): n is a, c, g, or t
  misc_feature (384)..(384): n is a, c, g, or t
  misc_feature (389)..(389): n is a, c, g, or t
  misc_feature (474)..(474): n is a, c, g, or t
  misc_feature (577)..(577): n is a, c, g, or t
tcaagattagatgtgaacaaaaccccggaaaatctgtggnttccctcatcaggagaaggacacatcactaaaggctaaggccccaagagctngggatcagaagtcagaagtttggaatgtggtgggtcaaaggacaatatggntnngcattctggagagttgtttttcagctgaattctcatggtgaaaacaggggaaaggacaaaggaaaccttaagttgtattgtctactttcttctccancctgntttaaaacacncctgtgnnggnnattatgcngcagagttgngngctacnnaagctattttaaatgggagggggcattcattcctaacacctcttgtaactaaaagaaccatagtaccncacatcacagtgctggtngaaanggaactaaaccacagtctgtaatcccaggagtccagctcagatccttatattgcgaggtaagtttgcagattatctgtcttgccntcaaacactgcagacagatttaaaataaagagaaaggttttagagcataagaaagctctcgttgaaggattttttaagctgacaacttttttttttttttttngagacagagtttgctcttgtcctccaggctggagtgtgatggcaagatctcagctcactacaaccttctgtgccttcccaggtttcaaggtgatttcctccgtgccttcggccttcccgaaatagcgtgggacatacagggtgttccacacaccacaccgtggcttaatttgtggagtattttcgggataaagacacagggtcttggctcagtgttgtgcgccaggcgtggctcacaacacctccgtgaccctcaggtgtgactctgcccgcgctcaaagcctcccgagagggtcactgaggaattcacgagggcgttgaagccaatgcgaggaccgcggaccttaagcgtgaacaatcttttatgacattaagagggggcaagaaaatattattccttatgaagtggcctcttaatattccacaaaacggtggcaatcttctagacacatctcggcgccagggcgcacagggcgtgggcctcaaccacgtgataaaccacacaagccacctttctggcaacgcgcataaagggtgggccgagaatccaaggaaagctccaaggaacgttccaaagacca

SEQ ID NO: 669447 - DNA, 746 bp, Homo sapiens
  misc_feature (40)..(40): n is a, c, g, or t
  misc_feature (92)..(92): n is a, c, g, or t
  misc_feature (143)..(143): n is a, c, g, or t
  misc_feature (145)..(146): n is a, c, g, or t
  misc_feature (243)..(243): n is a, c, g, or t
  misc_feature (248)..(248): n is a, c, g, or t
  misc_feature (259)..(259): n is a, c, g, or t
  misc_feature (266)..(267): n is a, c, g, or t
  misc_feature (270)..(271): n is a, c, g, or t
  misc_feature (279)..(279): n is a, c, g, or t
  misc_feature (289)..(289): n is a, c, g, or t
  misc_feature (291)..(291): n is a, c, g, or t
  misc_feature (297)..(298): n is a, c, g, or t
  misc_feature (366)..(366): n is a, c, g, or t
  misc_feature (384)..(384): n is a, c, g, or t
  misc_feature (389)..(389): n is a, c, g, or t
  misc_feature (474)..(474): n is a, c, g, or t
  misc_feature (577)..(577): n is a, c, g, or t
  misc_feature (746)..(746): n is a, c, g, or t
tcaagattagatgtgaacaaaaccccggaaaatctgtggnttccctcatcaggagaaggacacatcactaaaggctaaggccccaagagctngggatcagaagtcagaagtttggaatgtggtgggtcaaaggacaatatggntnngcattctggagagttgtttttcagctgaattctcatggtgaaaacaggggaaaggacaaaggaaaccttaagttgtattgtctactttcttctccancctgntttaaaacacncctgtgnnggnnattatgcngcagagttgngngctacnnaagctattttaaatgggagggggcattcattcctaacacctcttgtaactaaaagaaccatagtaccncacatcacagtgctggtngaaanggaactaaaccacagtctgtaatcccaggagtccagctcagatccttatattgcgaggtaagtttgcagattatctgtcttgccntcaaacactgcagacagatttaaaataaagagaaaggttttagagcataagaaagctctcgttgaaggattttttaagctgacaacttttttttttttttttngagacagagtttgctcttgtcctccaggctggagtgtgatggcaagatctcagctcactacaacctctgcctcccaggagaattgcttgaacacagagcgagctgagatcacgccactgtgctccagcctgggcaacaaagtgagactctgtctcaaaaaaaaaaacan

SEQ ID NO: 669448 - DNA, 219 bp, Homo sapiens
aaaaacccaaaataggggggaaattaaaaattttttccggggtttttttttgtccccggcccttggaaaaccccgggttttggggggccccccttttttttaaaaaccctttcttgttttccgtccccccccccgccccctgggccattgttttgaaaccctggggggccttttttttttcccccgggggggaaaaaaaacccctttttttttttccca

SEQ ID NO: 669449 - DNA, 664 bp, Homo sapiens
  misc_feature (40)..(40): n is a, c, g, or t
  misc_feature (92)..(92): n is a, c, g, or t
  misc_feature (143)..(143): n is a, c, g, or t
  misc_feature (145)..(146): n is a, c, g, or t
  misc_feature (243)..(243): n is a, c, g, or t
  misc_feature (248)..(248): n is a, c, g, or t
  misc_feature (259)..(259): n is a, c, g, or t
  misc_feature (266)..(267): n is a, c, g, or t
  misc_feature (270)..(271): n is a, c, g, or t
  misc_feature (279)..(279): n is a, c, g, or t
  misc_feature (289)..(289): n is a, c, g, or t
  misc_feature (291)..(291): n is a, c, g, or t
  misc_feature (297)..(298): n is a, c, g, or t
  misc_feature (366)..(366): n is a, c, g, or t
  misc_feature (384)..(384): n is a, c, g, or t
  misc_feature (389)..(389): n is a, c, g, or t
  misc_feature (474)..(474): n is a, c, g, or t
  misc_feature (577)..(577): n is a, c, g, or t
  misc_feature (664)..(664): n is a, c, g, or t
tcaagattagatgtgaacaaaaccccggaaaatctgtggnttccctcatcaggagaaggacacatcactaaaggctaaggccccaagagctngggatcagaagtcagaagtttggaatgtggtgggtcaaaggacaatatggntnngcattctggagagttgtttttcagctgaattctcatggtgaaaacaggggaaaggacaaaggaaaccttaagttgtattgtctactttcttctccancctgntttaaaacacncctgtgnnggnnattatgcngcagagttgngngctacnnaagctattttaaatgggagggggcattcattcctaacacctcttgtaactaaaagaaccatagtaccncacatcacagtgctggtngaaanggaactaaaccacagtctgtaatcccaggagtccagctcagatccttatattgcgaggtaagtttgcagattatctgtcttgccntcaaacactgcagacagatttaaaataaagagaaaggttttagagcataagaaagctctcgttgaaggattttttaagctgacaacttttttttttttttttngagacagagtttgcagcgagctgagatcacgccactgtgctccagcctgggcaacaaagtgagactctgtctcaaaaaaaaaaacan

SEQ ID NO: 669450 - DNA, 965 bp, Homo sapiens
  misc_feature (691)..(691): n is a, c, g, or t
ggtctacaagctcccagcgtgagcgacgcagaagacgggtgatttctgcatttccatctgaggtaccgggttcatctcactagggagtgccagacagtgggcgcaggccagtgtgtgtgcacaccgtgcgcgagccgaagcagggcgaggcattgcctcacctgggaagcgcaaggggtcagggagttccctttctgagtcaaagaaaggggtgacggacgcacctggaaaatcgggtcactcccacccgaatattgcgcttttcagaccggcttaagaaacggcgcaccacgagactatatcccacacctggctcggagggtcctacgcccacggaatctcgctgattgctagcacagcagtctgagaccaaactgcaaggcagcaacgaggctgggggaggggcgcccgccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgctcctcaagtgggtccctgacccctgacccccgagcagctaatgngagggaccccccagcagggggacactgacactcacacagcgggtattccacagacctgtctggggtctgtctgtgagggaactacaccgatgctttaacggaaccttgtgctccctctccagacagtgtaacccagtggggaccgacgcaaggggcttaagggggctcctctccaggggggtcccagcgaacgtgggggttggggagggggctctggggggccgggggtggatttcaccgggggggcggagccgcggtagcggggtttggttgg

SEQ ID NO: 669451 - DNA, 292 bp, Homo sapiens
tctttaggaggactaggaggacattgtgcccagtactaccacagcttggatctaggctcaggaatacttgggggtgaagagagagaaaggggtggggcgggctggtgccagtccaggtagcagccacggtaagactatagggagcagtgaggaccggaaggcccgtaactcctgtccaaggggcagccaccactcaaggctctggccactgtttgtccatagagctgatttgtgcctgtcattttccaggcaatcacgtttgggagcttgaaaatcaggtcctcctcaagct

SEQ ID NO: 669452 - DNA, 223 bp, Homo sapiens
gacacaccacctaatctgctccgttcgactgggcggttcacccctccttaggcaacctggtggtcccccgctccgggaggtcaccatatagatgccgaacttagtgcggacaccctgatcggcatagtcgcactacagccctagaactcctggactcaagcgatcctccagcctcagcctcccgagtagctgggactacaggcacgcggccaccgcgcccggc

SEQ ID NO: 669453 - DNA, 500 bp, Homo sapiens
  misc_feature (252)..(252): n is a, c, g, or t
  misc_feature (278)..(278): n is a, c, g, or t
  misc_feature (345)..(345): n is a, c, g, or t
  misc_feature (349)..(349): n is a, c, g, or t
  misc_feature (371)..(371): n is a, c, g, or t
  misc_feature (432)..(433): n is a, c, g, or t
  misc_feature (438)..(439): n is a, c, g, or t
  misc_feature (441)..(441): n is a, c, g, or t
  misc_feature (448)..(448): n is a, c, g, or t
  misc_feature (454)..(454): n is a, c, g, or t
  misc_feature (456)..(456): n is a, c, g, or t
  misc_feature (469)..(469): n is a, c, g, or t
  misc_feature (488)..(488): n is a, c, g, or t
ccagcggattctggcgcggagcggagcggcggcgggcgcagctagcgggtcggccgcggagcggaggtgcagctcggcttcccccggcacccctccccctcgggcgccagccactccggggcggcgaccgcgatatcccctgggggaccggggggccggccccagacctatgggcagacagagctccaaggctccccggggcgacgtgaccgccgaggaggcagcaggcgcttcccccgcgaaggcaacggncaggagaatggccacgtgaaaagcantggagacttatcccccaagggtgaaggggagtcgcccctgtgaacggaacagatgaggagccggggncacntggcgatgccatcgagccagancccctagccaggctgctgaggccaagggggaggtccccccccaaaggaagacccccaaagnnagacnnanagaacantcctcntntccagaagccttncaacatgagcggcctgtcnttcacgagcaac

SEQ ID NO: 669454 - DNA, 87 bp, Homo sapiens
aacctgtcaaaaaggattcagatgctgtgcgagtggatgctgcctgtaaaaggaaaccatttgggatttttcaaacgactccttaag

SEQ ID NO: 669455 - DNA, 595 bp, Homo sapiens
accacattcgagctcggcaccccagcgccctagcctcatcctgcacagcagaaagagtgaatggtgatgaatggatctatattatttcaactctcctacattttgtaatcatattacaatattaattcagcagtacctctcttgtttttactcccctcccccattacactggattcctgtctgtctgggattctgtctgtgtgcactctttcctctatgtccactactgtccctgccaccgatggcatttgtcacctctgcctgggcagcccctccagactctttgcaagttcatggactttggggttaatgatggctgtgcctcagctcctgtgaatggaaactgctgaggaaaggaagggccgtgccatgttcccgatactccacggctccttgcatatgcggtcgccaggcgcctacatgccttccatgaatgaatgaatgagtaacgtggattctaggaagctgcactaacccagacgttgtgtcctcagcctgctcatagagtgtgttaaacatgagaggtggggagtgtggcaagcaggctgaggacagaacagaggatctgaatagagtacggaggatcacccaagtc

SEQ ID NO: 669456 - DNA, 544 bp, Homo sapiens
  misc_feature (296)..(296): n is a, c, g, or t
  misc_feature (322)..(322): n is a, c, g, or t
  misc_feature (389)..(389): n is a, c, g, or t
  misc_feature (393)..(393): n is a, c, g, or t
  misc_feature (415)..(415): n is a, c, g, or t
  misc_feature (476)..(477): n is a, c, g, or t
  misc_feature (482)..(483): n is a, c, g, or t
  misc_feature (485)..(485): n is a, c, g, or t
  misc_feature (492)..(492): n is a, c, g, or t
  misc_feature (498)..(498): n is a, c, g, or t
  misc_feature (500)..(500): n is a, c, g, or t
  misc_feature (513)..(513): n is a, c, g, or t
  misc_feature (532)..(532): n is a, c, g, or t
ccagcggattctggcgcggagcggagcggcggcgggcgcagctagcgggtcggccgcggagcggaggtgcagctcggcttcccccggcacccctccccctcgggcgccagacccacgcaccatcacgacggacaggccgaccccgacagtactatcccactgcggacgcagagcccggggcggctccaagcgcccacccaagagacccccatcatgggcagacagagctccaaggctccccggggcgacgtgaccgccgaggaggcagcaggcgcttcccccgcgaaggcaacggncaggagaatggccacgtgaaaagcantggagacttatcccccaagggtgaaggggagtcgcccctgtgaacggaacagatgaggagccggggncacntggcgatgccatcgagccagancccctagccaggctgctgaggccaagggggaggtccccccccaaaggaagacccccaaagnnagacnnanagaacantcctcntntccagaagccttncaacatgagcggcctgtcnttcacgagcaac

SEQ ID NO: 669457 - DNA, 103 bp, Homo sapiens
gtctgcgacacctcatcccggtcgagctgctcaagatgccgccgatcaccaccgtgccgccgttctcgacatgtacctggtcttcacgtgctttgtgttgatc

SEQ ID NO: 669458 - DNA, 774 bp, Homo sapiens
  misc_feature (556)..(556): n is a, c, g, or t
  misc_feature (757)..(757): n is a, c, g, or t
tgtctatgtatttaactatattttttcaatagataactacatccaagtaatgaaacacaggattatacaattcccctccgaaggcagaggaaaagcaaattcacacacagttcacagaggaagtcaccagtgagacgcccggccagacggcagccaaggacgcctcgtgggggcaggggcggggcccagcagcaaaagctcaccacagctcccacgtgggtgctaatcggtggggacgcggcgcaggctgtgggtggagggcagggctagcccgtgcatcgtgtccagagaaacctacaatctatccagagaagggtgcccgaaattgagggagtccacaaggaggagaaaacaccagcgcgaaagtgccaaacgtggacccccagtggaagatcgaatgaagcgatcactgtgttacgactgaatagagaagaagagacgacgccactattaccctcgttatacagggacacctccgtggttcaacagtctacggatagctacacaacgagggatgactactcactattggcgccgtgaagagcgggagagcccncacaaagcactgcccgcaatatatatcccacgacacgaagctccacgtatatagagagctcctctgcacaacaacagggggcgatgagcactaccaagattgcttacccccggatacacatccccaaagcacctcttagagattggagtaccccttttccaaaagaaggctatcctccagagaatgatcccttggaacatnccatggagaggaatcca

SEQ ID NO: 669459 - DNA, 253 bp, Homo sapiens
ccccccagcaggagcgccgctccagagccacgtaccaggccctccaccataaccacagttcacgccgcctccggtagccgcccagtctgatcccccagacacaaaccgagttgaacaggtagagacaccagggcctcctcccaggtggcaaggagccagcccctaaagcagctccatagctggcagaggagctctggaggcgggcgggccctgtgctcggggggccccccgggggcggggggtggctggtccg

SEQ ID NO: 669460 - DNA, 1264 bp, Homo sapiens
  misc_feature (846)..(846): n is a, c, g, or t
  misc_feature (869)..(869): n is a, c, g, or t
tagagtgcacacctactatgtgattttcggcatagagtttcgtaatcttatactcttgattgcatagcctgctcgatagacatacatctctccttttagttatacagggcccttttcgtgatgctaaagctttaaacaacagggggcccccaaaccctccttgttggatcacctgagggctcggaacaaaaggttctccgtgaaagggttatcagagtgttgcacagacctaatagccctttgttaagtaagtctccagtgatccctacaagacatggggacccccgcattttttgactttaataggcccggggaccccatgcggccgcacaaccccccggactgggtgcaaagaaattggtgcaccaatccaagcaacggcaagcgagcataccccaagccaatttggtcccaagctccgggcaccaccgtgggatgaccacccccgcgagaatgaattgctaaattccgctgaaggacaattccccccctcttggacccaggggccagacaaaccatagcgtgtaaaacctggcccacaattgaggggaactttgcccagcattgatgaacgcgatgtaagaagactgggaaagatgagccacactcttgggagcttggaggaacacacggggtttagtaccctagacccctcgtgagaacttctgttaaaacggcttacaatagggttttcccctcttagctatagacttctagcgacttccccacttcccactcttgaacacctcggggggcaaagggttctttctttgcacatagttggggtttatataaccccctccccctgagatgaaataacacgagagtggtatagctatagggcgnttggttaatcacatcaagaaagngtggtcttcccctcacaggcctgtggggaataaaggaacgtgggcccacaccacacacatgccaaacctcaatgtccacaatatactgctttgtcctggtgttggggaaaggagattgggtctttgttcccccacaacaccacgcttcttgttggctgaacctgtaaatactggacacactgtttcctgagccacttaaaatgctgttgtaactcctgtgtggcctctgctgtgtttcctcggggagggaaagcacgcacctaaggagataatagaaaattcacattcgtcactaaacacggcacaatttaagccactcttatactacaagagatggatttaaattgtaacctgtttttacccaagaactaaatcacaaatgagtacagagccca

SEQ ID NO: 669461 - DNA, 799 bp, Homo sapiens
  misc_feature (383)..(383): n is a, c, g, or t
atatcgctcctcgtaagaaatggtatcgttgttctctgaagcctcctccaaagagttccccgggtccaggatccacaacatcaacatcactgcctaaggaaaagagaacaattattagcattgtatttgcaagtgattccaacagtcaggctctgaagcaagtgaacctttaacatagaggaaatggctaattaactacctaccagaatcttactgactacatacgaattatacagtggacaatttcctctctctcgcgccatttgcgtagtatactgaacactgatgtatcttattcataagtgtgatagaaatggtaattataaatacgtggatagtgttaagaattatgatacattaaaaatcacctatctgctccgtgnaggtgaattgctactaccgttggagctcttaatatatgaaccttatgtggagctatttatttctttctttctctggttgagactccagttaaaatgaataaactatctgtgaaactagttaaaagcaactctttttgtcaaaatgccaaaattatgcgcctgggtggggctcacccggtgggatctttgtgggcgggtgccgtttaggggggggttaattcataatcctcggctcactaactcacttgggtccggcagtacgcttgcagctatcaggaaggggttatctatatgcccgaataccgggcttccacggattcaggggtattccgcggggagaagttgtaacccacctgacagcctaagtgcgggatccgtcaaaaggcgggtgttatgggcgtctccccatagggacg

SEQ ID NO: 669462 - DNA, 82 bp, Homo sapiens
gcggccgcctactactactactgctcgaattcaagcttctaacgatgtacggggacatgtgtataaaaataaaaaagatccc

SEQ ID NO: 669463 - DNA, 1185 bp, Homo sapiens
  misc_feature (701)..(701): n is a, c, g, or t
  misc_feature (775)..(775): n is a, c, g, or t
  misc_feature (785)..(785): n is a, c, g, or t
  misc_feature (1185)..(1185): n is a, c, g, or t
ggaggggccgaggtgtgcgcaggactttagagcggtagataaggatcgagcaggcatccggacgctaccaggtgtactcagacacatcttgccaaggggcctgcgttctactgcacagggtacacagttccgcttactgtgcgtggtgcaagattgatctgtgcgaagtagtgctggtagggccctaagggctggcccagatcgtaagccgaacgattccccaaaagcgcgaaagagtctcacgcatgggcaggtcacgcgaatgaacccgagacactgcaatcgtactaaaggggacaaggtgtgcggcccggtgtcgcatggcgatgcgatggcagcttgcgttgttatccacgtggagctgcatgctgtaccaatcctcatcaccttaacctaggctggctcactgctcgctccccttttctatgcggttcgtcaccatatcgtttccaatcctagtggggcgttgggttgtaccacgatggtcatccacgcatgcctggcgcgctttgtagcaccgggtcctcgttggttcgcgctagaggaagcaagtacggctcccactctgtgaacccaatgcctatccgcgtgttctgtcggagcgccactgattcagtgaggagccaccccagagaccacatcctcaccgcttaattaacaccgacagagagcagacagtgcccgtctctccagagctgtcntcaatcacccagtttgactgggcggtccacaccgttctctccgagggacttggcgtatacggatagttaaacanacaagttganttccttctccaccatgaaatctcttacctagggcgcaaataagacacgtttttcattaccccccaagcggcgttagcgggttagggcgaggaggcgaataccccaatagggaagggggggcgtggcccaggaggggacaattccctttcgtcaagaggcgggggctttgagtccggaccaacgcaaccacgtataatttcctaaggaattccaaaagttggagccccttaggggttaagggaccctttggggagttcactttccaaacggcaacaccattgccggccatgcgctgcaaggcgaggtaggcggccaccaaatggtaacgcttgtttgcccctggggtgtgcctcccgcgccaaaccattgacatcctgttctgccgaaacattgggggtcn

SEQ ID NO: 669464 - DNA, 212 bp, Homo sapiens
cctgattaggttcatctttaataaagatggggaccccttaattaaagggcactaaaacactctttggacagagatatggtataaaaaatgttacagaagaaacacatattcaaaatattgtgaggccaggcacagtggctcacacttgcaatcccagcccgggccggacccccaagaccggaccggacccagggtacccgagctcgaaattc

SEQ ID NO: 669465 - DNA, 149 bp, Homo sapiens
ccgcggtcgatcttacaagatcgagcgaggagtgctgatacaggagctcagatgattctatcctaggtgaactggaaccaccggatactgtggagggtctcgtcgtcgatctctgtcgtcacatgcaactatcatacaacatgtccgca

SEQ ID NO: 669466 - DNA, 207 bp, Homo sapiens
atgtatccactaatatgaggtaactggagtagtcaaattcatagagacagaaaatagaagttaccaagggttacggggaagaggcaatgatcagttactgtttaatggatacagagtttcaggtttgggatgatagaatagtacagatctggaaatggaccgttgcacattgtctattaatgccacttaattgtacacgtaaaaatg

SEQ ID NO: 669467 - DNA, 390 bp, Homo sapiens
  misc_feature (1)..(1): n is a, c, g, or t
ntagtgcaagctgactccaagcacatccaggaatgcacttactgataagatattgaggcaagctgtcccaacagctcctgggcacgtgctcaggggtttttgggggggccaattagggtcacccaagcccctgaatttatctctttgtgatagtttaagcccctgcccctggaacggtgtatttttctgtaactatctctgtaaccattaattttttttaactttttgcgtgttccgcttctgtaaaaattggttcaggtaggctcccccggccctatttagcccccggtataaaaagaaatctatccccttcttcggggctgaaagaattttgagctctacccatctctcggtccctggcaataaaagaactcctgaattagtctcaga

SEQ ID NO: 669468 - DNA, 103 bp, Homo sapiens
tcttctcaacacatgtgcaagtcattttgatttgatattgtgctctagttaggtaagatataagcactgaggagactgggggagggtacatgcatctctctct

SEQ ID NO: 669469 - DNA, 107 bp, Homo sapiens
gtgaaaacagaggctattaaacaaaccaataatagaacagattggggtaacaaaggaatgccactaaatttttcaatgggaataaaattttcagaaaatggggatta

SEQ ID NO: 669470 - DNA, 1178 bp, Homo sapiens
agcggtgtgattgccagccgcgacagcttattctccttggcacaacaaatgaagactctggaagtgttcatgcatgtatcaaccagcatatgcctacgtgtaatcgccacgcatactagatgaacgtagtctactccatccaccctgtggatacccaacgaacgctgacttgatcctttagaccgtggatggactgatggcctacgcaaagtgatatcacgcgccacaaactcgactcaggacgacacgaccctaactacataccactagtagctacaaacatgctacttgtgccagaactactgatccgataacacacctacacgaacacgcgagcccaccatacgcaccctacacactgtgtgcacacctctgctaaagcgccccactcggaacttcgcatccgcgctgctccacgctctcgcgcaccaccacgatatctcctcctcgaccccacgccgcacctggcgcactttcgggcacttacacgcatagtcctcaacagttggaggcaacgccagaagggatgatgctccgtcccctacttgcaacttcatgccgcgcgcctacgcgggatccaaacacacggggcacacactacccatgtcgcccgccaccagccgacaactgtacgcccgccttcggccgcacatccggcctcatacagccatcagacattggaccacacacacgcttcatggtccccatcgagacacgttcaccattacttggagtgtcgtaacgcaccagttaggcggctttacaacaaccatctggcgttaaccgcgcatacgtaggactaccacagccaaccccaccatatgccaacgggacgcttccagattgattgcgcctctgcagcgagaccagaggcaccccccacttgcgagcgccattatacatcgtcctccaccaccggagcgtaggacagcgtgcttacatcacagcacagtcttcaacggcatccatccaccccaaacacgccgcacaaacaaacccagcacactttcgccaacatagcaggctattggagtctgacttttaaatcagcctcgactgagcgtcacacacctcaacacacgctacagcagcgacaccatccacgcgcgcaaccacagctatacaaccagtcttacccaccattcactgtcctcaccccctgcaccaccaacacggtc

SEQ ID NO: 669471 - DNA, 155 bp, Homo sapiens
atgacatgcatccactagagtcccagtcagtggcagacgaaaggtcacccataattgtcagagactcaggcatccaaggtgtagaggaactccagctcgaggtagcagccttaatgctcagggctggctgtaggaaccctgtgtggttttatttt

SEQ ID NO: 669472 - DNA, 598 bp, Homo sapiens
gatcgtgaataggtaggtgtgactgacatggctgtggtctatagatagtaatcttcatgtgccactgttcagcagaataagacatgtcttacaatcagcaggacaaaagcgtttacataaataagggaagggaggcgcaacctaggactggccgtcgataaaaaaatcccagctgcagccaatgggaggtaagcagggagaagtaacagaaaagacacactgaaaaaaatcacatccaggtgaaagtcttcttgaggtagaacatggctaataaatttcttggatcactcacatgcaccatttaaatagtaattctgaagatgttaactacagttaaggaaatcagagcttaaggaagttaagtacaagcttatatacccaagtctcatttgaatacaaatccatctcaccccaaagcctgtgcttatacatcccctaagtaattaaggccaaaactaggcttctaaaaaccatttccaaaataaagacagatttattcccaaagctgtttatcacatcaataaggcatcaaggaaagagaaactactttagaaataaatacaggaagcatacctacctatatcacaatcggggtacc

SEQ ID NO: 669473 - DNA, 167 bp, Homo sapiens
accgagagagatgattagtggaaggagagagagataggaggatgtgagacctaagatggattttggaggatgggaaagatgagtctttagtgctaaaaaaatttccaagtgactcttaatttcttctttgagcaccgtactatatgccaggcatggtaccagataga

SEQ ID NO: 669474 - DNA, 354 bp, Homo sapiens
cttgaattcggctatagcaggggaacaatcacttacctacccagtggtcctgaatccaggacaggagtatgtaaggagaggtaccctgtactctaggctactaacctggagctgacgcctacgctagacctcggcctaccattccctcgggtctaaaatgcgagtactcagtaatatactctgtggagggagctggagagggtacgcttgtgacgtgggtcctgtctatatcagttgctcggagcagcctacactctaggtgccgtctttgacagaaggactctctaggtcctgctgtagtataaaggggatcattccagcgaaagtctggccctaacaaaagctgggagaggg

SEQ ID NO: 669475 - DNA, 533 bp, Homo sapiens
  misc_feature (34)..(34): n is a, c, g, or t
atttattcgtttatgaattggttattaacaagtntatataaggttaggattccaatttaaagttttcacttgaaagctttcagggtttagttgtatgttatgtaacgaggagtagtactgaatttggtataagacttaatgactttatttatagcttttaagaaatctttctcggtagtaatttttcgtcgtgttctgatggtaaatatattagcttctgtgtagatgcttctaatcttagtatcagtgctatttggatacagttgtgctaacagtttaaatctgatatctcttttaacactcattgaatgagtgtgaattttaaatatgtgggtctgaccttctagattgggcaagctaaatttaatttttctatccaatctccctggcctcatcagtgctggatccaaagtatcaggtttgttagtggccatcagcactttaatattgcctcgaggatcaaaaccatcaagctgattgatcagttccaacattgttctctgcacttcattgtcacctccagcaccatcatc

SEQ ID NO: 669476 - DNA, 304 bp, Homo sapiens
  misc_feature (177)..(177): n is a, c, g, or t
ctggggaatgtgggaagggggctcagagtctagaaatcctcatcctcataggttggctgggatagggatcaggctcagtccaggatggcaaaacaagagaagctttgttggggtgatccatgcctgctctgaggctctgacccccggtggtcttgctgtggttggaaaaccaaaccncagtacctgagggactgtagggtggatgattcatgtgcaagtttgcacacagcaggatgtgggaggctgaggcaggcagattagcaacctagtgagcaaggagcccaccaagcctcctgggctcctt

SEQ ID NO: 669477 - DNA, 510 bp, Homo sapiens
gagaacactgacttcagacctaccaccatctaggcgtgagttgagaggatccctctctgcaaaatacaggccagaccgggagcacagttctacaggatgctgacatagaccactaaagatatatagtataaaggtcagaatagacaagccccactcatagtagtttacagctaccactcaactattaagtcagtcactactaaaatataagtggccaagcaaggattaacagacatctgagaaacagtcatcacaaaaaagtagacactgaaactatatggactaaacacgcctcacatgaaacagagactgagcagagagaagaagaaaaatatcctccaaatgatgaggatattatgaccaatgaaagccgtaccgggtattgtctgtaaacaaggaacagtaaaggaagcagacaaaagttcctgaaattaaaaatcagaaagtagaagtgaacatgaaatataccagacagtacttgagacaatctcccttaccactagaaagacg

SEQ ID NO: 669478 - DNA, 436 bp, Homo sapiens
atacaggagttggtatacagtaatgcgcatccttatccagtaagagagacgactgtagtacaagaaagcagcaggtctcacgacagcaggggcaagttcctctctctctgaagcatggctcaggtgtggagaagggttcagcaacacttctgggaatccgtcattcacagctgacgcgacgacgatgacagaccagcaccttgaattatgccctaaacccaagcaagaaaccaccacatctaaaagcaccagtgggcttacagacataacatggagctccagtggacagtgatttgtcggatgaagatcagacacctttctcacgttacccgacgacgactaataacagtttactcgacctgagacgacttgacagtgaccgggcagaggctagtgactgtgatgaatttgaagatcaccgggagtgatgctttga

SEQ ID NO: 669479 - DNA, 446 bp, Homo sapiens
gagcattgatattaggttagaatcgtaagataaattttaagtagaaaaagcgggattctgtacagacaaaggaaaccgccagcacagtaaaaagaccacttatggaataggaggaaatatttgcgaaccatacatctgctaagaggttaatatccaaaatatataaagaactcaaaacaactcaatagcaagaaagcaaataacctgattggaaacattgggcaaaagatctgaaaagacatttctcaaaagaagacatacaaatggccaataggtatataaaaaaatgctcaacatcactagtcattagagaaatgcaaattaaaaccaaaatgatatatcacctcacacctattagaatggctattaccgaaaagacaaaaggtaagtgttagcaaggatgtagagaaaagagcaccttgcacactgttggtaaaaaccaaaat

SEQ ID NO: 669480 - DNA, 188 bp, Homo sapiens
cccccggggggggccccgggggggggaaatttaaaaaaaaaaagggttttcccccggggggaacccccgggggggggggggttttttttttggggactttgggggccccttttggggggttcccccctttttttttttttttttttagggcccccccccctttttttaggggggcccctggtttttta

SEQ ID NO: 669481 - DNA, 203 bp, Homo sapiens
tgttcagttcgggacgtggctcgggacggagcagcgcagcccggtgcctcctccccttgcatgctggtatctatgggaagctcggggcttggccagcaggcctgagcaccggactcaggctggggaaggctctaccacacggggagccctctccgtgccggtgggctcttcccctcactggtcacatcagctctcgtggatcc

SEQ ID NO: 669482 - DNA, 101 bp, Homo sapiens
tccaggcatggtgtgactaatatggcgatggtgggggcagggctgcatctattacggggagaggtatgagagttactcatcattctgcggttgtcttctgc

SEQ ID NO: 669483 - DNA, 195 bp, Homo sapiens
  misc_feature (76)..(76): n is a, c, g, or t
  misc_feature (119)..(119): n is a, c, g, or t
  misc_feature (127)..(127): n is a, c, g, or t
  misc_feature (178)..(178): n is a, c, g, or t
ggggacataacgaaggaaaactgccataacataccacctagtggagactaagaatgaggaatagttttctcctccntggttcatgtgttgttgcttttgataatccaaagcgatcatgnagtcggcnctttaatatttccaatgcgaaagattatttaaatgtttctaaatctgcagnacattgataagatggtt

SEQ ID NO: 669484 - DNA, 323 bp, Homo sapiens
  misc_feature (11)..(11): n is a, c, g, or t
  misc_feature (24)..(24): n is a, c, g, or t
  misc_feature (61)..(61): n is a, c, g, or t
  misc_feature (70)..(70): n is a, c, g, or t
  misc_feature (73)..(73): n is a, c, g, or t
  misc_feature (260)..(260): n is a, c, g, or t
  misc_feature (279)..(279): n is a, c, g, or t
  misc_feature (291)..(291): n is a, c, g, or t
attgaaattcntctttttttgggngcctttttgactgaaggcaagctcacagatgaagcanaggactgangancgggggctgaacccatttgccgatgtaaactcatgtctaaaatgcttgttagaattgagacagggtcagtgtttacacacagcccttcattatatttagagataaaacctatttcttgttcttgcattcacattaagtcatgatgtaagaatatgggggtgggtccttcagagaattcttgaaaagntcaatttacagaagactgntatcatggatgntctgaaaaataaaaaataaaaaaatcaggatc

SEQ ID NO: 669485 - DNA, 148 bp, Homo sapiens
tttggggggtggttttttttttaaccccctccccccttcctttggggaagatttgaggggggcccctttttttgtaaattccccaatttggggttgatgtttttgggcttgaatgttttcaaccctgattaaaatttggtttttttta

SEQ ID NO: 669486 - DNA, 202 bp, Homo sapiens
gtatgtgactcagtttccacgtcatggcttttagtccacccaggagtaaagagccaggaaaagtgagtaagacctttcatctcagccaggtgcagtggctcatgcctataatcccagcactttgggaggctgaggtgagaagatcacttgagcccaggaatttgagaccaccctaggcaacatagcgagaccctgtctctac

SEQ ID NO: 669487 - DNA, 230 bp, Homo sapiens
ggcacgaggcggagaagctgcagcagtacattgctcctggaatgaaggtttatattgacccttttacctacgaggaccctaatgaggctgtttgggagtttgccaaggagatcgacgtgtactgcgttaagatcgaggaggtgatcggagctggggaatttggggaagtgtgccttggtcaactgaaacagcctggccgacaataggtgttagtggcctttaagacgctg

SEQ ID NO: 669488 - DNA, 146 bp, Homo sapiens
cgcactgccggctgccactgtctgggaagtaggagtcctctgttcggccaccccgtctgggaagtgaggtgcctctccgcctggccgccgccccatctgggaagtgaggtgcccctctgcccggctgctgccccgtctgggaagtg

SEQ ID NO: 669489 - DNA, 100 bp, Homo sapiens
gtagtccttgactgtctccacccactcccagtgtagaccataagtccttcatacatctcaagttgggggacacaaaagggtggaagggggggcacgaagg

SEQ ID NO: 669490 - DNA, 803 bp, Homo sapiens
ctactgatctgaaatatccacgtgtgggccaggagcactggctcatgcctgtaatcccagcatcttgggagagcgaggaaggaggatcatttgagcccaggagtttgagaccagccttaaatttttttttttttttaaatctacagaggggctggccttgacaacagagtcaacgttgcttacgggggcactcaagacaggtggcgggtaaataatacgtggtccacgattgattaaccattattgggtgcgaacgggaccggtacagaccttgcacaaggtaacacgcgggcgggagtaccacttcagtggctactcaggaacagtggccatagacggtggactaacaggcgggcacttgtggggaatgccgactttaatcacggtctatcaggtcccatttacaaagaacttttactcaaatcgagctatgcacagattttaataccttaaaatcctaaaagcctttaaatatacttaaaagctaacaatgggtccacacacattaaagcacggtttgcacagatgtcccaaggtacgcctgtgcactattggtcaggcgagtacagcagtgttgggaaggcctggaggaggaaaagggcatcccagctggcccttctaggaccgcgtaaccattcgggcatacacggcagcgtggcacaaaatggctcccacggggctcgcacaaccccaacgctgcgcccacatggccagaaccacatgggcgcggagccacgcactgttccgaacttgccttggaccacaagcaaactaatcccaagcaggcgacatactagccggaa

SEQ ID NO: 669491 - DNA, 149 bp, Homo sapiens
gagcgagttctccatgccgtcagacttccagagatagctgggactacacccaggctacataatgtattatcagtagagacgggatttcaccatgttggccaggctggtcttgaactcctgacctcaggtgaaccgccccctcccccctg

SEQ ID NO: 669492 - DNA, 376 bp, Homo sapiens
aaaaagccagtcacaaaagatcactatggagtggtctcctatagaaatagaagataggttagttggttgcttagggctaggaaggaagggactgggggacagggtttcttttgggaagatgaatatggtctaaaattgactatggtgaaggttacatgtatctttgaaatataccaaaaaatcattgaattggtacaattttttggatgggtatatgacttatctcactgtaacttattaaaaagaaaacacggttgggctggttggctcacatctgtaatcccagcactttgggatgctgaggctggaggatcgtttgaggccaagagtttgagaacagcctgggcagcaaaggccctgtctctacaaaaaaaaa

SEQ ID NO: 669493 - DNA, 145 bp, Homo sapiens
aggtcgctctagagatcccccttacttttttttgtggctacgaaacctagacccctttgttcttctaaacaatatatgtgtattccatcggaattaacctcaattcaataactggagtaaaagattttaagtaaggatcccctag

SEQ ID NO: 669494 - DNA, 187 bp, Homo sapiens
  misc_feature (18)..(18): n is a, c, g, or t
  misc_feature (125)..(125): n is a, c, g, or t
  misc_feature (157)..(157): n is a, c, g, or t
  misc_feature (169)..(169): n is a, c, g, or t
ggtccagtgattataccnatatcacgagggttttctgtcttttattagttttcgggggtgtgtagtagatctcattttggttttaatttataatttccctgatgttaaaggggtgtctgtaaatntttcttttgtgaaataccatagacacatttangggtaaagaggncgtccagagcaatgttgc

SEQ ID NO: 669495 - DNA, 1703 bp, Homo sapiens
gcaccttactaccagacaaccgttagtgcaaatccatttacgacgagaatatcagtatacggcgatagtacatagttgagagaccgtggtggacaaatagatagtagtgagccgacacaggggaaaggagtgagagacagtgtatataccaacgcgataattatagccagggtacctacacctcctaataccttcctgcatagatgacacttaacctatgaaataacgtttgccaaggcacgacgccaagaggctaaaggaccgcgcacggagaaacctatgactgacgctacccctagaagtagatcagcatatagaatgaagcacgacctctggtctgatgtagcaaaaacagttacgtgggcgcacatgactttcataccggtgagagtgcccgcacgaagaacgcttcacgctgcacgacctgggggtccgatgtacgtctgcgtgttggtgtccaaaagaggcatgcacattctataacgttctcagagctctctcaagattctgggcacactaacaaggaaacccgctcctgacaatacgccacgttggttgagaacgtatccaacatcgtggctaatcaggtccccacgaaaggcgaaggcagaccagagaccgtgcgtatggagaggtacacaaactgaaggggccaagaaaagaaagcccctatggttgaggcacggacgaaggattcagagcacaccacaagtttctcacatcgagcgcccaacttaaggttacggcctcgttataaaaagaccgaggatacaagctgcgacacctttcacaggtagagcaaggcgtgttatccaaaaaggcgctactacataggtaccaccccaaatattaacgccttgaaacacagtatagttcaccgccaatacaggcggagttgaattacaaccagttgtcagaacctgttccctattcaagcgaaccccctaagagtgtgggtgtatgccaaagtgtcccttatgtggacgcccccgtaagttagggcacaagggaaaaccttaacacgtgctctcgacggatcaattacaaatggttcacaacgcatttggtaacacaacaacataattttgtccctttccacctttccgccgggcgcaatttaacacaggacctctcgggcggtctcatcacgcaactctttcacacagaaccaactgtctggacaaaactgtgtgatcccaaactttgcacagtcgaagggtcgcccccaaaattaaaattgcttaaacacgaatagctcaaacgcccccaaaagaccaaagggtctcccaaactcaaagatgtcaagccgccccttccaaagccgggggttccaagaacaccccaaagaagcaccagagcgtgcacatgtgagccacgccacattcaaaacgggacaacagcgggcgtctacgacccgacacacagagaacacacacaacaaacccacaaacacgccgcaggacgagcgacaccccaccgatcagaaaccaagcgaggaagcgcggggacacaacaacacaagggtggtcaaccagcgaacacgaggcgcaccactcgtcgcacccactcatcgagcggcaattcccgaccgaaccgacacaccaccgcgtccgtgcggcaccaccaacgcgccagccacgaactacgagcggacagatacctcccaccacaaggcgacagcccgccacatacatacggcaaga

SEQ ID NO: 669496 - DNA, 229 bp, Homo sapiens
tatttaatttatttatgtaatacagggtagaaagcgatcatgtcataagcaagtgattctgtacaatcatcctgcagaaaatggtttgggagaattctgggtaatggaagaccagcagagcacccgtccccacccgcccgcgtaaaagtgcttacaaggaacagggattcataccttaaatcagagagcccaaagatacggtggacaaaaaaaaacacacaaaaaaaag

SEQ ID NO: 669497 - DNA, 316 bp, Homo sapiens
tggtcatgcacaactagggtcagttcgcaggtggtaagccatttaccaagatagttgtaggtaaagaagggcagatttattagagaaatgtgaaaatatgttgcagtgggcagctcagcagagaaggggctacctgcaaagaggcaagggctggaggaaagttttatagggtcctgctgaagggtgctacgtgtgggatgaggtcattgtgcccgcaggttgtttgtgattagctgtttctaacaattgttcatacaataattgttcattattgttctcaacttggggctctccccaacctggggacccttcctta

SEQ ID NO: 669498 - DNA, 171 bp, Homo sapiens
atatatataatcagagctcgagctcaactacatgagcaacacaaaggaataggcgatggaatctcatgtcatccatatagataataacatacgaactattacgaccatcatgcctgccatctatctacccttcacctcatatcataagctaatatatccactaagtcgttc

SEQ ID NO: 669499 - DNA, 133 bp, Homo sapiens
tttcgacactacggatgtgtattagttggccttacctgtttccggtggtataatgttcgaattcataagaacagggaggttagaagcagggtcttggtgacaaaatatgttgtgtagagttcagggtcttggt

SEQ ID NO: 669500 - DNA, 432 bp, Homo sapiens
cgtccagacatgacagatgtcactggaaggaggacaggaaacagacaggtactgtccagctgtaggtaagagagtgcagctaagtgcaggttgaggggcagggagagaggctgggtggagcagtattgcagcacatgcagtgactgtagccccagtggtcctgtcctgcagcggctggtcatggttagcacagctgtaagattcccatgctggagctcctgaccctgaacccatggtagacgggctcaccacgttgtgcggtcctacttggatgagcatggtggctcctcataccaccatgcttgagacttgacggttgctcctatgtaacgcccaggatgtctccagtgccactatggagattgtcttgcttctcacacgacccaaatttccttgtgcaaccttgctgaatgagtctgaaggcagtctgga

SEQ ID NO: 669501 - DNA, 440 bp, Homo sapiens
aattcatcagccagcagtgccaaggctgaatgagcctacttttagaaggatagtaagaaggctggagcacagggagtagagaggggagtggtatgagttaaacagggaggggtaggcaagggccacatccttcagcaccttggaggctagaaaaaggagtgagattttattgtgtgatgggaaaccattggaatcttttaaacagggaaataagcaagttttttaaaacttgcttaatttttacttccttaaaatccttcagtgcttacacattgccttcagtgtaaaatccaaactacttagccagtcctttgaaatttaaccttatcttccctcttcagctgcatctctaaaggctttagccacatagagcctcttacagtttccagtgcttggactaccctccctcttacccttatttcactgctggctgatgaatt

SEQ ID NO: 669502 - DNA, 1293 bp, Homo sapiens
  misc_feature (1293)..(1293): n is a, c, g, or t
ggaattcaggcttttcaaagtaaggttaaaaggcagtggcaagaaggggtcttcaggttagggggatgattgagggaacaccaaacttggctagtttgggccactgccaaaagccaaatgtgggaaccctgtgggctggaaggggtgtgtgagaggggtggacaaggggccaccctataaaggagcaaacggggtctcagcggattggtgtgttattcggacattatgggaacctctcgaaaattctctctcggccgttcttcgttcgtttacagcacagctctcaagcaccagcgccccgcacgttgtgggggccacagcttttcgctttcgaaacacgcgggcttcaaaactcttcttggtcactcggctgtgattccaagccggttcctttgagcctttggacagctgtggcattgtaaaaaagggaatataaaccatgtggacacgcgcccgtgggaacagccatgtgggtagactttcataatttgtgggctcgtgtgttttaaaattatgctccgaggagaacttgtttgtgagggggcaaatcttccttcgacccattataggggcgtgtcaagccccctttgtgttaccctcttcaaagaggcggattcccccacaaaagtgtgtcccaacttcttgtggggttatatagaataccgtgtgtttgaaccgtgtgtggtgccgggacaaaaggggggggtttccaggaagaaaaaacccaaaaagaaaagggcaagggcccccaaagtttttgagggaaaaacccaatttcctttgtttaggggagctcaaagactctcgggtgcccggaaatttccccaggacccacaaggggggcgaaatgaatattcgcagatatcttgccggggatcctccccccatatttaaggctgaagggtcggatatttcaaagtttgcgcgaataaaagccgcgggttttaaccccgtgcgtatttatgaaggatcacgcagggaaacaaacacggaacgaaagacgagaagacagagaaagaaagacgacgacgaagacacagaaagaagatgaacagcagaaaaagcaaaaagcaaaaggagaaaaacataagcaaaaaaaaaaccaaaaaaagaaagaacgacacagagaaaaaaagagcgagcaaaagcaaagacaaaaagaaaaaacacagagaaacacaaagggggagagaaaggaagcagcgggaagaaaaaaaaaagacgccaacaacaaatgcagccagaaagaaaaacagagagaagcaaacaaagaccaacacaacaaacaacaan

SEQ ID NO: 669503 - DNA, 195 bp, Homo sapiens
tacgggtgaggtacagctacgggtgaggtacagctacgggtgttgagcttgaacgctttcttaattggtggctgcttttaggcctactatgggtgttagttttccttctaacaggcccctcagctgcaggtctgttggagtagccggccgtgtgaggtgtcagtctgcccctgctgggggctgcctcccagttag

SEQ ID NO: 669504 - DNA, 219 bp, Homo sapiens
tagacgtgtattcacagctgtacgtgcagttcgtctctactggtgatgcatgctgataatgtttatgtgaacataagaagtctgcatgtgtgggtgaactctccacatcatgtcatttcattggggtacccaacttcagttacgtatctgtggtgtctagcacattcctctaccttattttctgtcattgtacctacttctacctgaagcacgtcggac

SEQ ID NO: 669505 - DNA, 1383 bp, Homo sapiens
actagttctagatcgcgagcggccgccactgtcctgaatttgaggaatgtgaagtttcattatacagttgatatcatataactatagaatactcagtgataattataaaacataagtgagagactaatgtgaagtgagaattggagcaatatgtttttaagtgtagagtaggtgtttatgagatttacggttctcagactaaacttaggtatactgacaagacagataaataaaggggcttagatgtactgttagggctcaatagtcttgagggtaggataacggttatcctctttcacatatagagcatcgcttgtgtacatatttcataacgtcatcataaattctactttatatagtcataaacttttacataaatactatgagtcatagtaagtgctagttcgacgtgtgaaacgaattatcgtcacaagtatgaaggattgttgggggtacaacaattgctatactatcatgctaggatcaataatgtacataactcttcttatacatttgcgttaatccgtgagcaagggtgaatgaatggctgttgagggtagaagcgagtattgtcactgaacgcagtgaatctaatttcgatccaatcgtccaacgttagctagcatatccttcttaactgtgcataccaatacactggtaaatgcgtggaggatcaggagtccttattgcaaagcaaagccatgccgaaacaggaaagagattggcgaccgttactcctcgttacagcaaaaagatctaaaggggacttgggacctacaatgaaggaaacctgggaatacgtttccctaattagtcacgaggggaactggtggccaaaaacagcggaaggaagcaaaaggtggacacacagggggaaatccacgggaccagggtcccctaagggggagaaaccggcataacagaatttcggaaaagtggaccgttaggagaataagttcacaagagagagccctgggaaaaccagaaatagggaggaaagataaatagagaggggcgcaaatcttggtaaaggatcaatgagagagaaaacaggtagtagtaagaaaaaagcgactagggaaagctcgatgaaagagacgacaaagcgaggagcatacggacggacacataagctgggtacgaactagtatgtgacacacagtgggagaacagaaggaacataagagtaggaagcatggacacaaaggagaataactcacgaccgagcagcaccattgagctgacccgaggaacgttcgagaggaacacaccggaagacagtgaacacaagtagtgagcgaacagcaagtgagagagggacacgctaagtacaaagaagaacaggtcgtcggccgtgctctcctgctcgtggcctgccattgt

SEQ ID NO: 669506 - DNA, 256 bp, Homo sapiens
ttgctctatgcggctagaatatgatgagctgggactggtagctggctattgagggccttcaggtcctgggagcccgactgatgtggcagaggccttaatatgtagacagagcgggttacgcgaagtgctggctggcgtgcgtgctctccagtgccctgtgaagggcttctggatctgggagtgcccagtgcccatgatccccctgcttgctgtggaaacagtgtagtcggggatcatgggaggccattcaacgcgg

SEQ ID NO: 669507 - DNA, 291 bp, Homo sapiens
gacccaggctgttaagtctgggaaattcaagcttatgactggggaaagcccagttcagaataggatgcactatgatcagtcccaaaactccctactacaatgtgacaggccatgtaatgttacccacattgcagctgtggaaccggtggcaaggacctgttggcgtgacccaccaaagatgttggcctatttgcttccaacaactccccaatacttattataccacacaggagattcctattttacaatcacttggactttatactgggcaagtggatgccccgtcaagaa

SEQ ID NO: 669508 - DNA, 1078 bp, Homo sapiens
  misc_feature (269)..(269): n is a, c, g, or t
  misc_feature (391)..(391): n is a, c, g, or t
gagttgagaagccagatactaatagagaagaaacccgaatccaatgcaaggttgatgcttggtgtgcaaggtgaaaaagggtaacctcaaagctaagaagcccaagaaggggaagcctcgcattgctagcacgcaagcggctctgatcctttgtcagcaagtgaattgggactaggtattctcgcgatctgctcatgtacttccaggaaaggtccgatgatagcaaggagagtaacgtacgtcgagaccagctaaagagtccgaagggntgtgcagagacatgaagaacacgaacggacgaagagtatctacgcaaacgtgtgtacaagaagccacgattggctggctgacaatgaaacggcggtacccgggctggcttaacacctttcgncaacatagtgctctagattgattcatcctagctgaatgaatgttgcccatcaggagacaggatctgctaagaagagcgcaaactgggcgaaaataagactccttatcagaatcaaggcgaccgttgcaggacaacagcgtggactagaagacccaagacaaatgtgaccgcgcacgggaagaccctagtgtcctggaatccagtcgcttcgacatggaggaagcgacccatcatgaggagacacaatgacaggggatgcgtatctatagcccttgaaaagcgcagccctggcggcctcaagttcgggacttatatttgcactttggatggaactcgggaacccttctcgggattccttccaaagtcagagctttcgcctctaacggaaaggaaaccgactaacccaaggaaaagaatctctgggtgccagtatagaccgacgttttccgaaaccccaaagacattcggaaattaagtcgagtgccaaaacggttaaaaagagagaattctcaccaaaaaaacgaatttctttatagccgtggaatttggctttataaccttctgccaaacgaaaaacgaacacggaaaaggtcgttgacgggcacaatggcccccgaggaaatcaacccaggggaacagggtgcaggaattcgtttatcgaacacatcaaggaaaacaaaaggacga

SEQ ID NO: 669509 - DNA, 122 bp, Homo sapiens
accaaaagttgtttgtttatactctattaaatgtgacctcatttaatggttcggtcatagtggacatgtgcttgaatttgtgatgatacgggttttttatttcctttgttaatgataccgcg

SEQ ID NO: 669510 - DNA, 96 bp, Homo sapiens
actcacttctttctcagcctccaggacactattggccttttttaagagacaatcttatttttctaaaggtgaatttctagatgatagggtgaccct

SEQ ID NO: 669511 - DNA, 381 bp, Homo sapiens
tctcggcttttttcccgcggaacgttgatgcacctttgctccgaggtactcgcctcatgtcttgctctatcgacgtgctcactgatgccctgttcgtgtcgactacccccgtcggctgccttgtgcagcaacctctttataagcacacagctcatctctaatcttttccattcatattagaggaagtaggacagagttgtgtatttctttataaacaaatgatacactagctttttacaaaagtgactgttagaacttatatgagttctgagtagtggtcccttattaaaactcctggaaacattttagtaaccacataaatcatgttttatggtactcagacatccaaaagtgattgttccccgatggggatcctctaaa

SEQ ID NO: 669512 - DNA, 115 bp, Homo sapiens
agactcaaaatgctgcataacagactcactggggcaggaggatcccaggctcccaccctccacttggcgggccccgtgggccagatgcttgaggggagctctctaccccacccat

SEQ ID NO: 669513 - DNA, 393 bp, Homo sapiens
  misc_feature (234)..(234): n is a, c, g, or t
  misc_feature (375)..(375): n is a, c, g, or t
tccgtctcacgctcaacagagaagtgctaggattaaacatggagtccgttaagcagacctgctgcctgagaatcacttcactgaatatgcgtctagcgaagcttatctatgttagcgcctcctaaagctcatgacataccgacacttgcggacgcttgatgaatgaattcaatatgttacggcccaagatgtttgacatgcctgctatagtcgttgaaccacgtcttccatgtnattggtggttaattttaaaactactgtgccttaacgtgtttcttaaacttttgtagtaaatgaacatttgaaatccattttgataaacctgctgttaatgttttttccccccttgtgaatgttttctaactttgtcttggnaattgcaatttaactagg

SEQ ID NO: 669514 - DNA, 535 bp, Homo sapiens
cttcctgaagagctgggaacacaagggcttcaagaagagctgcgacaatgtagtggcaggttgggcctataagcccaccttgctgggacagggtgtgcgggcaacgaccatcattgtactcaaaggatggagcacgaagcagcaggaggcagagagaggctcacctcagcgggggcaggggcaagcggtgcgtcccagtggtagccttggggagttggcagcacattgggaacacgggggcttcccagagcgcctttcctcccaccacacctatccttctagccctcttctctccgacacccttttcccagcctgaatgtagaccactgtcccttgtcttggaggtgggaaaaacaaattactgtagtaacaggaaacatgtcctcttctaatgtaaccttagagggggaatcaagcccagtgttttccaacgcatttttagcagcagaatcatgttccaaaaaataataataataatcacatgaaattgtaagctgcaaaaaaattaaaactaggactattgtggcttcaaaaa

SEQ ID NO: 669515 - DNA, 140 bp, Homo sapiens
ggtaatattttcagtctcttatatagggttctcctatagctagattcttgaaaaagttaaatagttctgtcaaattctacataaaaaatacaatgtgttatatttgcatgaacatagtggtgtttattaggtattgtata

SEQ ID NO: 669516 - DNA, 393 bp, Homo sapiens
gagatctcgccactgcagtccagcctggcgacagaccgagagtcttgtctcaaaaaaaaaaaagtgttgacaatgccaaaccttgcgggccatacggtgggatctctctctattttggtcatgcaccgagataaggagatcccatatataaattctatggttgtcccataagattataatggagctaaaaaattttctgtggcctagtgacttcttgatgatcctgaccctgtgtagacctaggctaatgtgtgtgtgtctcacgggttcaagtgttccatcttcacaattctaattctagtgactatcctagaaatcgctgtcgcctaaatccaagcctacgtttccacacttctagtaaagcctctacttgcacgacaacacataaaaaaa

SEQ ID NO: 669517 - DNA, 330 bp, Homo sapiens
  misc_feature (22)..(22): n is a, c, g, or t
  misc_feature (265)..(265): n is a, c, g, or t
  misc_feature (288)..(288): n is a, c, g, or t
ggaaataacacaaaaacgccangcactgtcacaaccatagtggggaagatactttgggaaaaggtgtctttgggggttgcttcaagccacacagtgtatacccacccaggatggtcctggccttggttctgaatgacagacctgctggccccatttcccacctccttaacctttttatccaagaagcagaaacacattcacaaatggtcaaggggagttgtttctaagctctgtgtcaaaaaggcccagaccaattccacttggnagtagtcagaagtcccggtcttnaaagcccagactgatggtttctggcctaacctggggtgcttg

SEQ ID NO: 669518 - DNA, 168 bp, Homo sapiens
cccttatactgattgagctggcctcgatatcattgtccttatctgcttcctagtcctgtatgcccttttcctaacactcacaacaaaactagcctaatactaatcatctcagacgctcaggaaatagacatgcgtctgtactatccggcctgtgcaatcaggtgtaga

SEQ ID NO: 669519 - DNA, 739 bp, Homo sapiens
  misc_feature (107)..(107): n is a, c, g, or t
ccccccggcggccaaatttttttgggggcctccccccctcccgcgggccccaatttttataagatcttctgcccgtgcgttttggcgcccgtggaggctaatcgttngtgttttccacgcgaggggccgcctgctggcgcctggtgttttgcgcgacgctgctcctcgttgacactctggtgtaccccgccaagcgttatacctttgttgaggcccaccgtcccccaaatggcgccttctcccatatagaccgttttttttcccccaccattaatgggggcgtcttctactctccctgggtggtctcccccacatttctccgggggatcaaccccttgtgcgcccagcccttattccccgcaaatcgcccgttctcctactcaatatttctcctcggcgggaaatttaacactttctgtcccaccacaaaatgtctcgcgccatctccggatagccccccacacttgtcatccggcttacccccacgatagcgcagtacacacccacctatgctacacatcctccatcaccccattaagggtccaatctcaatttttttcacaccccctgtataaataataaaaatttctcatatgatatttgagagaccgctccccgttccgagaaccgcgaaaatcactaattatttatagaagcacccccccctataacccgggggggaaaatgggggccccccccccccccccccccttggaagaaacccctttaccaaaaaaaa

SEQ ID NO: 669520 - DNA, 823 bp, Homo sapiens
gcatgatgaaatggaaatgaacagtattgcaatgtccggtatacaaaataacattaattcaatgtagataaaattacactagtttaaaatatgtgcattcactgtatttgttagtgttttagtcttttttgaaagatgtgctctgttaatgtgctttttttttttttaactacatgctagtctaacatttccggctctatgccgtgcatctttaacaagggccaaaggtgaagaaaattgctacctttttggttaccaagacactgacttgaaacatgtacatttaaagccttttatttttccccttttggtcttgggctagtggggcattctaaactaaggacaaggaaaaatattttggggggcaaatcaagagcctatgagttctaagtataaagctgaagtgatttcgaatgccagcgtatatattggcattttccacatttacgagggacgtatatgtgtactgtgtgtgcccgcatgcatgtgtatgtgtcgcttcgttccatcaactaatcaaaaggatccttcacgaacatggcgctgatgggaaacagagtttgactttaacgaaaccagatgaggtgtctcataagtagactccactgcggttgaggtttttcaccttaaagataggggagcagaagcttcaggccctggggtatcgaccgcgtggtttcctttgttctagccgttccgacaggtaacaggacagctgctctaaggctcggacgctttcctacatagacggaagggggggcggcagcagggcgactcgaggtcatacaccagggagaagacctaattttgcagtaaccctgtt

SEQ ID NO: 669521 - DNA, 106 bp, Homo sapiens
ctgcttgtggagggagaagaggtggctcttcgggacaaggcgcggtcctgggagccggcagagatcgtgtcagaccacgcacggtgtgacaagaaaaagagaaacc

SEQ ID NO: 669522 - DNA, 163 bp, Homo sapiens
catttttttgggccttttttcgggggggggggttttttgggccccccaggggttttcccttggaaatttttttggggggggccccccgggggggggcccccaaacccctttttttaggggggtttttttttgggtttttttaaaaggggttttccccccccca

SEQ ID NO: 669523 - DNA, 276 bp, Homo sapiens
tttttttgggggggcttttttttcccccccctacggggccggtcctgtttttcaacgggcctttttttggaaatcccgccctttggggggtttttttttcccccctacccaggggccccctttcccggcttttttagccccgttttttgttttgggggaattttaagtttttttggggcccttaattggccggttttccccccaacctttttgtaaggcctggggcatagtgggccgtctttttttgttttgggaataaattgcccctgggggcta

SEQ ID NO: 669524 - DNA, 449 bp, Homo sapiens
aactgccacacattcttaaggaactgccggagaatgggaaagtgtgtcctggggtacacactgaggccttgaggataacgttggaaatgatgtgtcgggtcagtcatggagtttgcatgatgatgctaggaagtatggattgactggctagatctgttcagtggcgagtggtactgagtgtggactgtcatgggttgctgacagatagtgatttgattgagtgagtgacagactgtgcagccgtgctaaatttgagaaagcgtgtttaaaaaaacttctacagaactctagtatgggcgtctgactttgttccagggtgtagaatttgactcaaaagtaaaaatgagtttgttgtaggatattctactttcattaatgttggtttgttctgaaagtgatattatattgtacatgtaaaattagtttaaatattttttcaaataaaaatg

SEQ ID NO: 669525 - DNA, 291 bp, Homo sapiens
ctaggtgtggtggctcacacctgtaattccagagctttgggaggctgaggcaggaagattgcttgagcccaggagctagagactagtcagggcaacatagcatgaccccatctctatgaaaattttttaacaaattggctagtggagtggtacacagctgtagtcctacctacttgagaagcagaggcaggtggattgcttgaacccaggagtctgaagttacagtgagctatggtcacaccactacactccggcctgggtgacagagcaagaccccatctctaatttaaa

SEQ ID NO: 669526 - DNA, 145 bp, Homo sapiens
tagccttcattctgtacatcaatttcatagtaaatataatcatttaattagaatcttaatatcctcatttaatatattattatttctctgttttttttttccttatgagagccgcttccgtagcatacttaatacataaccgtgg

SEQ ID NO: 669527 - DNA, 512 bp, Homo sapiens
  misc_feature (336)..(336): n is a, c, g, or t
  misc_feature (338)..(338): n is a, c, g, or t
  misc_feature (344)..(344): n is a, c, g, or t
  misc_feature (354)..(355): n is a, c, g, or t
  misc_feature (358)..(358): n is a, c, g, or t
  misc_feature (372)..(372): n is a, c, g, or t
  misc_feature (386)..(386): n is a, c, g, or t
  misc_feature (393)..(393): n is a, c, g, or t
  misc_feature (396)..(399): n is a, c, g, or t
  misc_feature (404)..(406): n is a, c, g, or t
  misc_feature (411)..(411): n is a, c, g, or t
  misc_feature (422)..(422): n is a, c, g, or t
  misc_feature (450)..(450): n is a, c, g, or t
  misc_feature (499)..(499): n is a, c, g, or t
aggggcccaccgttcaaccaccgtgcgctcctgtgggggaaagagacatggttgacaagcacacagaagccagttggtgggagtaccttatggagttgatgacgccagccgcctggccggagccaccgcttgaagcacccaccgaagacgaccatgacgagttttaggtggatgggggcaaagaaccttaaaaagggattaagccagcccctgcagtgccgtccacccgcccctttgggcctgcctgtggttttgttgccctcctttgtgggggcaggacctttgtggggctttgtgccctgctttgggggccagggggggggtggtccacatttncnggcccnaacagccttnnaanatgggtaaaggagnttgccctccctggnccccccnccnnnntgatnnnccccnccacccccacnctgtccctgccacccctctagtggggantagtgaatgacttgacctgtgacctcaatacaataaatgtgatcccccncccaaaaaaaaaa

SEQ ID NO: 669528 - DNA, 1675 bp, Homo sapiens
  misc_feature (68)..(68): n is a, c, g, or t
  misc_feature (76)..(76): n is a, c, g, or t
  misc_feature (148)..(148): n is a, c, g, or t
  misc_feature (154)..(154): n is a, c, g, or t
  misc_feature (164)..(164): n is a, c, g, or t
  misc_feature (179)..(179): n is a, c, g, or t
  misc_feature (232)..(232): n is a, c, g, or t
  misc_feature (275)..(275): n is a, c, g, or t
  misc_feature (532)..(532): n is a, c, g, or t
  misc_feature (712)..(712): n is a, c, g, or t
  misc_feature (784)..(784): n is a, c, g, or t
  misc_feature (824)..(824): n is a, c, g, or t
  misc_feature (932)..(932): n is a, c, g, or t
  misc_feature (1027)..(1027): n is a, c, g, or t
  misc_feature (1096)..(1096): n is a, c, g, or t
  misc_feature (1261)..(1261): n is a, c, g, or t
  misc_feature (1267)..(1267): n is a, c, g, or t
  misc_feature (1282)..(1282): n is a, c, g, or t
  misc_feature (1300)..(1300): n is a, c, g, or t
  misc_feature (1324)..(1324): n is a, c, g, or t
  misc_feature (1333)..(1333): n is a, c, g, or t
  misc_feature (1362)..(1362): n is a, c, g, or t
  misc_feature (1369)..(1369): n is a, c, g, or t
  misc_feature (1374)..(1374): n is a, c, g, or t
  misc_feature (1376)..(1376): n is a, c, g, or t
  misc_feature (1469)..(1469): n is a, c, g, or t
  misc_feature (1476)..(1476): n is a, c, g, or t
  misc_feature (1504)..(1504): n is a, c, g, or t
  misc_feature (1520)..(1520): n is a, c, g, or t
  misc_feature (1552)..(1552): n is a, c, g, or t
  misc_feature (1603)..(1603): n is a, c, g, or t
  misc_feature (1675)..(1675): n is a, c, g, or t
cggcgtgactgcgcgcgctgccgcgctcacgcgacgagctaagcaaccggtgtgtatatagccttctngtagtttngtatagttaattggttatgttgtagtgatagtgagagtgacgtgaatgacgcatgcgtcttcgctatgtcgnaccgcngacgtgtatngacgacgattactgngactatgatgggtctgacacggagatcgtgctctcgcggcgagacgcagcatnatgcgactacgcgcgatgctgtgacgtggccgccgcgccgcgngagatctcttctgtacaaccgcaccaagtaacagtaagtctacgtataatatacgcaatctgttcacatgtcgtgtctcgcaatccaccagtcagctggactgtctcggctatatctctggctgatgtatgttattataattatcgtctcatacataattatctcccacaccactgcctattatctctcgcatcagttatgcattacgtaatagcgaatacaggcgtcgcctcgtgacgtcgtcacctactcagcantcaagtacatcgacgacctttcgttaactacgtatcattactctttacgaatgtcatgtgtatactacaacatttctatatactactactgcgccgttcctcgtagcggtgcgttatgatatacacctatagattacagtgtgtcgacgtgccatgcgccgatgtcgatgtacgcatcgncgttcgcgcgcgagtatagctcagtagtttcctactctccttcttgtccgcgccgctctggtcgatatgttnatggagtacacctcatcgtcctccgtctcgctaggagtantctacagttgcgtgcggggtgtgtgtatgcgtcggccgactcgcgcgctgacgcttgcgtagtaatctggcatgtactgatgacatgtcggggcaagatgctccgtgngtgtagtagtagaggcggtgagtgagtacgagaagacaccgactacgtgcatattactatttactagtcgtgcggtgcgtcgcttcgtggactcncagcgtatatcgtgactcgactagcgtgctgatcatctatgtcttgtttcatacgctgcagcggagtcncgcggtcttgcgagctagtacagcttgtcagattcggtgtgtcagtcgcgcgagagcgctgtccgcgcgttgtgagccgcgctgtgtacagtcagtggagtcgcgagtggcgatatcagtgcgcgttgctcatgcatcgctgtcagtacactcgagtcgcaacgnactctngcgtgagctgatgtntgagagatgcgtgtcgcncctcgtacggacttcactcaagtnactctctgntgtcgacacatcacgtgcgagagtgcagnctcgccncgtcngntgtgacgctcgactagtatagtgctgcgtatgcgcgcagagagtactgacgacgtggctaccgtgtgtagtgtagatatatgcttacgtaganagacaangtcatctagcgacgtcacagactgagtngacgatttggcgcacntgactacgacaactagcgaggacacgctatancgcgcgacgcacctactgcgcgttacgacagatgtctactccgcgtgatcnacgcgtactgctacactcgtcctgatagtaatcgcgttactcatgacgtctggggtcgagtgcgtcgcgcgn

SEQ ID NO: 669529 - DNA, 1191 bp, Homo sapiens
gggctgccgttttgccgcggatgacctgggaccctctggcagacgactgttccgcgcggcgttgtctctagagactggcacggtcactgagtctcataggacatgtatggtgcagtgtccaagatgtcagacctgtctagcgagtggctgacagggtgctgggacgcgtcgccagtgaggacgtccatggtctggagcccatgaatccgtgtggactgtgtgcgatggttgcgtgacggattgcgagacggacacgagacgagggcacgacgtgtcgggtagggcctgatgtggaagacatcagtgagggcatcaaggagagaagctacttggcaacggtcagaaggcgttgcagctccttgtgcacccggcccattcggggagatcgcttggttctatagtaagctaggccgtagtgataacctctgcaggaaggcggataacatacatcgtggggccacgctggacgactaccttaagttggtggggtgactgggctatgccggcgtaagggttggaggatatcgcagagttgaagcagagagatatggccactagaggatatgatccgagcagatacgcaagagggaacacaggaagggagccgggcagcccggactcagtggcaatggcaagcacgtaaaacgcaaaagcagcaacgataccagcgcgagcgtaactgggctcccacaggcggcaaaacgccaggcaaactcgggtcaacactgtagccgcggcgcgttggaccccgacacggacacgagggagagcgggtccggcacgcagccagaagtagactgagcgacgcggccacggggtcgccgaggagccgactgccgaccaataccccgagggggacaccctatgaggcaccgtaggacgacctgtatgggtaggccgcacagcgcaagcgaccgctgcgactttgaggtgagcgcctcagaagcagcgggacggcagcgggcgagcaagcagagggacccaacgctgggggatgcgcaacaagacagctggcataccgacacgtgagacaggagccgtcagaacgggaaccaaggcggaggggacaagatggaagtcctgacagtgcagcaggagaggccaacatggcgcacggcaaggaaaggagacacggcggtgagccccaggagcgggctccatgaggagagggcgagcgccccgtacggcaga

SEQ ID NO: 669530 - DNA, 235 bp, Homo sapiens
  misc_feature (39)..(41): n is a, c, g, or t
gggcatatagctgttcggaggttctacagggagcacagnnnctcgtatcccttaccgaataccggtcctcctctatcggggatggtcgtcctcttcgaccgtgcgcgcagcttcgggagggacgcacatggagcggtgagggaggaaggggacacccgcctagccagccagatcagccgaatcaaccctggcgatcaatggggtgacagagctcttattgcccaggctggagggc

SEQ ID NO: 669531 - DNA, 677 bp, Homo sapiens
cagcacaggctaatgtcatatgtgagtagacagtggggtttcaccatgtggccaggctggtctcaaactcctgacctcaggtgattcacccccctatgacctcccaaagtgctgggattacaggcgtgagccactgtgcccagcctgtgtggctctcttttggttaccctgtggtatcctgttttctcaagctcatcctccctggtgggtccatgatccctggaaattgttggtcttctccggccttttgaaattgctgccttatgaatgtccagagttgagtatctgcctttctctcccaaggaggaagaatcctgagggggcatcttggcttttaggtcccagggctttcactgacttcctccttgctggcttcttggtttgttccaaagatgtcctcggtacatcttctgagactaatgacatgataagtttctggaaggactatgatctggatgatgagggtttcatcacagtcctctttcagttctgtcctacggattacacttgttttcttccttcatcctttgtcttcactggttcactgtttccatctgcattcttctgttctcatttcttttagtcgtcgtcttattttttatcttctactctattttttagatggagtctcactctgtcacccaggccggagtgcagtggcgcgatctcagctcacg

SEQ ID NO: 669532 - DNA, 343 bp, Homo sapiens
gcagactggataacgaaaatgtggtatatacacaccatggaataatatgcaaccatagaaaggaatgagataatgtcttttgcagggacatggatgaagctagaaaccatcatcctcagcaaactaacacaagaacagaaaaccaaacaacacaagttctcattcatcagctggagttgtacaatgagaacacatggacacagtgtggggattacacacaccagggccagtcagggggtggggggcaggggagggagacattaggacaatagctatgcatgtggatttagacctagtgattgttgatagtgcagcacccatggcacacgttaccttttacaat

SEQ ID NO: 669533 - DNA, 201 bp, Homo sapiens
gcgagcaggatggacatgtattgagacgagtgttagggatggctgtctggccattcacactatgccatgatgaggaggatgcagttgccagaactgcccaggacatgcagctacaggcgatatattgcagacacattgagtaagtgcatcagcaagggaaccttctcaccaggatgcggataaataatgttttcaaggttt

SEQ ID NO: 669534 - DNA, 163 bp, Homo sapiens
acaaaccttaattatttgcccaaacttattccttcagtgataggcagtagggggtgttgaatacatctcacggcagcctccacctcccaggctcaggtgatctcccacctcagccttccgagtagctaggacctcaggtgtgagctaccacatctggctaatt

SEQ ID NO: 669535 - DNA, 507 bp, Homo sapiens
acaagcttgttagatcttataaatatgaaagtttcccaatactttagaaaaattactaatcattaataagtcgattttatactctaaagtaatggtctaacatgtcgaaagatgaaacaacgctcctcttatgagagcatctcagatgtattaagtaagctccgtgtcccaggcttttgcgggggacagagaagtcctcatattgcaacctgaccagatgactctgggagtgaattaaatgcttaaaagaggtcagtcttgcaaattcgatgaagcacagaatacaggggaactgatactgattctgataaaagataacattactctcagaaaggggtgaagctaaaaatcttgcagttctggggcaggaggagtgcaacaagcaggcaacaaacagcatgaaaggaaaagctgacgtgaactttcaaagttctattgggagatggagttagtggtctttctgcccacccaggtcaaggtcatgtccagaagaggatttcttcccag

SEQ ID NO: 669536 - DNA, 267 bp, Homo sapiens
cagaagctgctggtcccgagggcgagtgttggaggccagaattcaagctgagcacatcaatcagacgcctgttaccttcaagtgccgggcttgatgagctcccaggtgcagattgtgcgggcacccgactgaggtcctgcgcctcattaacattgtggtgtctaaggagctgctggacgacgaggagtattaggagatcggggaggatgttgcggtacgagtgcaagcaagtacggggttgtcgaatccatcgagatccccccgggc

SEQ ID NO: 669537 - DNA, 104 bp, Homo sapiens
ccttccccccaaaaggttttctttgcaagtgcttttggaaataagagctagtatcttggattaactgaggcccggtagggctttctgattactcgcattctgtt

SEQ ID NO: 669538 - DNA, 229 bp, Homo sapiens
ttttttaaaaaaaccccttcccaagggaaattgttaaatcgtctgtcttgcgggtgccaaaactgggtttttgtggaggttcaaaccaggcacccccataagttgctctcaaacccttgttttaaagaacatttttggttatctggacttctgaagcgggggggaagctgttaattgtatgtcccccccctcccccgccgttaaaaaaggccccaaaaaggtttttgta

SEQ ID NO: 669539 - DNA, 749 bp, Homo sapiens
ggatcatcttcttggacatcaggaagagatgctcataaagaggatcgagagcgttctttccggtgaatccagtatttgtgtgctcatatatcaggccttggtggtatatggcttcatttaaggctgtcatataagaacattctgtgagaggtatcgcatcgaagaactgggttataagtaaaaccatcaagccgaacaacagggtcttgagataaccgtttgaagcttattgtactggtgctgcgcagacagatgtctgcattactcattgctaaaaatgtgtagcacagaatgcactaggattactttgtttacaagaagaaatttaaactctacgtttggttttcacatacagcagctctattgaataacatgcatctgaattttaagttgcaaaggtatctgaataatttttcatgtgcatctttgtgtcgaatgtttggttcaagacagactgtttaaagctttttaaaagacttcagttcttaatgtactgtacccttctgcatggaaaatcataaacaacatggtgcagtagacttcttagtgtgtaatccagcgccacttgcagaggggtgtttatcatattgtacttggggtgtaggactctagtgttctgtggggtgtattgcatgggtggatttatctaacagcattgtcccaataacacttaaaaaagggcggatacttccactgatgcttgtcttgggaataatccactttcgggttctcaaggaaggtctgggaaa

SEQ ID NO: 669540 - DNA, 355 bp, Homo sapiens
  misc_feature (27)..(27): n is a, c, g, or t
  misc_feature (33)..(34): n is a, c, g, or t
  misc_feature (38)..(38): n is a, c, g, or t
  misc_feature (42)..(42): n is a, c, g, or t
  misc_feature (54)..(54): n is a, c, g, or t
  misc_feature (68)..(68): n is a, c, g, or t
  misc_feature (77)..(77): n is a, c, g, or t
  misc_feature (88)..(88): n is a, c, g, or t
  misc_feature (93)..(94): n is a, c, g, or t
  misc_feature (108)..(108): n is a, c, g, or t
  misc_feature (120)..(120): n is a, c, g, or t
  misc_feature (205)..(206): n is a, c, g, or t
  misc_feature (217)..(217): n is a, c, g, or t
tgtagagcacccccgactcatacttcngaaagnncctngatncaaaaaatttanttggacctgctatnagcaggtgncaggagccggnttcanntgaatcttcaaatnggaaaatactgnttcaccacctggggacaaagaggaaaaaatagaggccactctgggcaggctacaacacttaacaaaaatttacataaaactgagnnatccctatgtnccactatatgtaaatactgtataacattaaaggtgtgatatgttttgtaaattaacgctgaacagtagagtccatgagctgtaaatccacatgtgcaccactggtttaagaggtgatatccttttacaggtattcttt

SEQ ID NO: 669541 - DNA, 236 bp, Homo sapiens
  misc_feature (103)..(103): n is a, c, g, or t
  misc_feature (125)..(125): n is a, c, g, or t
  misc_feature (133)..(133): n is a, c, g, or t
  misc_feature (191)..(192): n is a, c, g, or t
ggggggacgcgggtcggacgcgtccgggctgtggaagagagcggcggccgcttcacaacatgcacagcctggcgacggctgcgcctgtgcctactacactggncacaagtggatagagagatctntcagtggnttcaatgagctgtccagtcctgagactagggtgctttgctggagctaataaggcgagnnctgttcctgaccttgcacccatgctgtggcattcatttggtact

SEQ ID NO: 669542 - DNA, 376 bp, Homo sapiens
  misc_feature (232)..(232): n is a, c, g, or t
tccaaagatacctgcctgcaaaagtcaaggtcataagaaatatgaagcgcgagggattgatccgaggacgaatgatcggagcagcccacgctacaggagaagtcctggtgttcctggacagccactgtgaagtgaatgtgatgtggttacagcccctgctggccattatccttgaggacccacacacagtggtgtgccccgtgattgacatcatcagtgcagacacacgtcnttacagctcatccccagtagttcggggaggtttcaactgggggctgcacttcaagtgggatctagttcccgtatctgagctgggagcctgacggcccacggccccaataaggtcacctacaatggctggaggcttgtttgccat

SEQ ID NO: 669543 - DNA, 524 bp, Homo sapiens
  misc_feature (472)..(472): n is a, c, g, or t
  misc_feature (517)..(517): n is a, c, g, or t
gtagaattagatctttccaagcctgctttctgtatcaaatgcactgttcattggcacagggtggtctcatggaccagaagacctgagacccctgaggcctgattttggcttgatggtggtctgatgcaggccatctttgggatcttcacttttccatctgtgaaatgggaagaaggccaatctcagtgccatattcaccctcaaagtttttaggcttgtgagagcacatttgatggagagctctgagcctctgtgccttgccttagagaaaactgatagaatccaaacgtgcatttaaaatattttctggagaaaaattttcctcacccagagacacccttattgtataataaatattaacagaaataatatagtgaaattaatgatgacataaaagcagtcattgtggtgatgtgactgggcacacaggccatctctccagttatgggtcccgggagccagcaggccaggncttcaggggtgtcttcaagggcctctggcacacgtgcaacccacnttgtgcc

SEQ ID NO: 669544 - DNA, 121 bp, Homo sapiens
tgatctagaggatcccataatttctgaataattcagaaaataacttaactatctttccagtttagtttataaagtaacaattctgctatatcaaatttctgaattaacttttctgaattca

SEQ ID NO: 669545 - DNA, 434 bp, Homo sapiens
  misc_feature (290)..(290): n is a, c, g, or t
  misc_feature (292)..(292): n is a, c, g, or t
  misc_feature (434)..(434): n is a, c, g, or t
actgaggtcttgagaactggaaaacttcccttggttttcacacaggaatctgtcatttgtgcttatttcacattgcatgcctgtatcaaaacatctcatgtacacccataactatatacacctactatgtgcacacaaaaattaaaaatagggctgcacatgggtgtcacgcctgtaatcccagcactttgggaggccaaggcagggagaatggcttgagcccaggagttcaagaccagcctgggcaacgtggcgaaaccctgtctctacaaaaaatacaaaaaaattangnccagttgctggtgcacacctgtggtcccagtttttcaggaggctaggtgggaagatcacctgagcccaggaggcagaggttgtagggagccaagatcaagccactatactcaagccggggcaatagagtgagactctgtcan

SEQ ID NO: 669546 - DNA, 910 bp, Homo sapiens
  misc_feature (58)..(58): n is a, c, g, or t
  misc_feature (69)..(69): n is a, c, g, or t
  misc_feature (92)..(94): n is a, c, g, or t
  misc_feature (103)..(103): n is a, c, g, or t
  misc_feature (142)..(142): n is a, c, g, or t
  misc_feature (181)..(181): n is a, c, g, or t
  misc_feature (183)..(183): n is a, c, g, or t
  misc_feature (185)..(185): n is a, c, g, or t
  misc_feature (201)..(201): n is a, c, g, or t
  misc_feature (212)..(212): n is a, c, g, or t
  misc_feature (218)..(218): n is a, c, g, or t
  misc_feature (225)..(225): n is a, c, g, or t
  misc_feature (240)..(240): n is a, c, g, or t
  misc_feature (248)..(250): n is a, c, g, or t
  misc_feature (254)..(255): n is a, c, g, or t
  misc_feature (257)..(257): n is a, c, g, or t
  misc_feature (264)..(264): n is a, c, g, or t
  misc_feature (278)..(278): n is a, c, g, or t
  misc_feature (291)..(291): n is a, c, g, or t
  misc_feature (334)..(334): n is a, c, g, or t
  misc_feature (337)..(337): n is a, c, g, or t
  misc_feature (425)..(425): n is a, c, g, or t
  misc_feature (437)..(437): n is a, c, g, or t
  misc_feature (470)..(470): n is a, c, g, or t
  misc_feature (473)..(473): n is a, c, g, or t
  misc_feature (482)..(482): n is a, c, g, or t
  misc_feature (495)..(495): n is a, c, g, or t
  misc_feature (504)..(504): n is a, c, g, or t
  misc_feature (521)..(521): n is a, c, g, or t
  misc_feature (557)..(557): n is a, c, g, or t
  misc_feature (564)..(564): n is a, c, g, or t
  misc_feature (573)..(573): n is a, c, g, or t
  misc_feature (584)..(584): n is a, c, g, or t
  misc_feature (593)..(593): n is a, c, g, or t
  misc_feature (803)..(803): n is a, c, g, or t
  misc_feature (811)..(811): n is a, c, g, or t
  misc_feature (832)..(832): n is a, c, g, or t
  misc_feature (840)..(841): n is a, c, g, or t
  misc_feature (908)..(908): n is a, c, g, or t
cgcgcgggagtgcgccacgcggggccggagcgcctattagccgccaggacctcggagntccccgacctnccctgatcccctctggcttcggnnntccccagcnccccttcccgggtcccctcgcccaccctaatccactctncctccctttcccggattccctcgctcttcccatcctctntncngccccttcctggattncctcacccgtntcgttnccctctncgccctttcccaganacccagannncctnntnccccgcnccctccccggagcnccccgcgcgtgcngcggccatggcggccgtgcgcggggcgcccctgctcagctgcntcntggcgttgctggccctgtgccctggagggcgcccgcagacggtgctgaccgacgacgagatcgaggagttcctcgagggcttcctgtnagagctagaacntgagccccgggaggacgacgtggaggccccgcngcntcccgagcncaccccgcgggtncgaaaagcncaggcggggggcaagcnagggaagcggccagggacggccgcagaagtgcctcnggaaaanaccaaaganaaagggaaganaggtaaganagataaaggccccaaggtgcccaaggagtccttggaggggtccccaggccgcccaagaaggggaaggagaagccacccaaggccaccaagaagcccaaggagaagccacctaaggccaccaagaagcccaaggagaagccacccaaggccaccaagaagcccaaagagaagccacccaaggccaccaagaagcccccgtcaggaagaggnccccattntggctcctcagaaacctggantggcaatnnccccacccccagccctggcccgaggagctacccaggagggaggggggccctctcaaataactggcanat

SEQ ID NO: 669547 - DNA, 334 bp, Homo sapiens
acccagtctcttccatacagagcgcacgcacagtatagacgagtccatgtcttgcactggaacacgagcgggtcaagctcgggcaagactgctacgatgtgtctagcccagcatctccccagccttcctgattatctagcgagaaagggagtctccctgctgagcaccttgaatagggaggacggaagaaggaacctgatgagaaaggaggcagctgccattcctgggctatcctctctctgtagcaaggcagccatcacaggagcaccctgaactaggagtctactgccggatggatgcccgcctcgtgacaggtgaagacacaagtctccac

SEQ ID NO: 669548 - DNA, 1866 bp, Homo sapiens
acaggacaaggtaagtggggaggggcacagagcttccatgccctctgttgggcacactaccctcccaggacctccttgtgtttagcaacacagaagctctccaaaccctgctgtttgggtgtttatggaggcatgattgataaaatcactggccattggtagttaagtcaatctccagttccttttgcctcctggagttcagcaggtgaggctgaaagttccaagcctcaaaaaatgtggttggggccaggtgcggtggctcactcctgtaatcctagcagtttggaaggctgaggcacatggaccacttgaggtcaagagtttgagactagcctgaccaacatggtgaaaccccgtttctactaaaaataacaacagttagctgggcgttgtggcacatccctgtagttccagctactcgggaggccgaggcgggagaattgcttgaacccgggaggtggaggttgtagtgagctgagattgtgccattgcactccagcctgggctacaagagccaaactccgtttaaaaaaaaaaaatgtggttgctttctctggcagctagccctcctcctgaagcagtctcggagcttgcagccaccctgttagctcaacagcatcccacatgcattcttaccatgctgcagatctgaaagaccttagaggcccttgtgtcaggaacctgggactaagactaaatatcaaaacagaaaatgctcctattacctctgtcacgaagggctttataagagctttggaagctttatgccaggaaccaggggcagagaccaaatgtatatttcttttcttatatcggagacagagtctcactctgccactgaggctggagtgcagtgatgtgatcatagctcactgcagccttgacctcctaggctaaagcaatcctcccaccttagcctctccagtagctggaactacgggcatgcatcaccatgtccagctgattttaattttgtaaaggcaggatcttccttttttccccaggctgatctctaactcttggcctcaagcaatccttcctctttggcctcccaaaatgttgggattacagatgggagcccccatacccaccaatcacaaggatctttataagagaatgaggtaggagagtcagaattagagaaagtgatgtggtaatggaagaagaggtcagagagggagatttgaagatgctgcacttctggccttgaatatggagtcacgaggtaagtcaaggaatgggggtggcttctagaagctggaaaaggcaaaggagcacattctgtctagagcctcccccagaaggaatgcagcctctctgacaccttgactttagccttaatagacctagttgggcttctggcccccagaactgtaagatggtagatttgtggtgtttgatgccactaaatgtagggtactttgttgtagcaacaacaaaaaatgaacatgaagctgggacctcatgttacggttgctcacgcctgtaatcccagaactttgggaggctgaggtgggaggatcgcttgagcccaggagcttaagaccagcctggacaacataatgagacctcatgtctaaaaaaaaatttttttaaaggccaggcgcagtggctcacgcctgtgatcccagcactttgggaggccgaggagggtggatcacgaggtcagaggttcaagaccagcctggccaagatggtgaaaccccatctctactaaaaatacaaacattggccgggtgtggtggtgggtgcctgtggtcccagctacttgggaggcagagaatcacttgaacccagaaggcagacattgcagtgagccgagatcgcacccttgcacttcagcctgggcgaccgagactccatctc

SEQ ID NO: 669549 - DNA, 1663 bp, Homo sapiens
gtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtcgggaggccgaggcgggagaattgcttgaacccgggaggtggaggttgtagtgagctgagattgtgccattgcactccagcctgggctacaagagccaaactccgtttaaaaaaaaaaaatgtggttgctttctctggcagctagccctcctcctgaagcagtctcggagcttgcagccaccctgttagctcaacagcatcccacatgcattcttaccatgctgcagatctgaaagaccttagaggcccttgtgtcaggaacctgggactaagactaaatatcaaaacagaaaatgctcctattacctctgtcacgaagggctttataagagctttggaagctttatgccaggaaccaggggcagagaccaaatgtatatttcttttcttatatcggagacagagtctcactctgccactgaggctggagtgcagtgatgtgatcatagctcactgcagccttgacctcctaggctaaagcaatcctcccaccttagcctctccagtagctggaactacgggcatgcatcaccatgtccagctgattttaattttgtaaaggcaggatcttccttttttccccaggctgatctctaactcttggcctcaagcaatccttcctctttggcctcccaaaatgttgggattacagatgggagcccccatacccaccaatcacaaggatctttataagagaatgaggtaggagagtcagaattagagaaagtgatgtggtaatggaagaagaggtcagagagggagatttgaagatgctgcacttctggccttgaatatggagtcacgaggtaagtcaaggaatgggggtggcttctagaagctggaaaaggcaaaggagcacattctgtctagagcctcccccagaaggaatgcagcctctctgacaccttgactttagccttaatagacctagttgggcttctggcccccagaactgtaagatggtagatttgtggtgtttgatgccactaaatgtagggtactttgttgtagcaacaacaaaaaatgaacatgaagctgggacctcatgttacggttgctcacgcctgtaatcccagaactttgggaggctgaggtgggaggatcgcttgagcccaggagcttaagaccagcctggacaacataatgagacctcatgtctaaaaaaaaatttttttaaaggccaggcgcagtggctcacgcctgtgatcccagcactttgggaggccgaggagggtggatcacgaggtcagaggttcaagaccagcctggccaagatggtgaaaccccatctctactaaaaatacaaacattggccgggtgtggtggtgggtgcctgtggtcccagctacttgggaggcagagaatcacttgaacccagaaggcagacattgcagtgagccgagatcgcacccttgcacttcagcctgggcgaccgagactccatctc

SEQ ID NO: 669550 - DNA, 520 bp, Homo sapiens
  misc_feature (219)..(219): n is a, c, g, or t
  misc_feature (222)..(222): n is a, c, g, or t
gtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtncanacccaggagccgggggagtggctggaactcttgcaggagccgggctccctctacatccttaggggctcagcccgttatgacttctcccatgagatccttcgcgatgaagagtcctatctttgggggaacggccggataccccgggaccgacgccatctaccgtgatctgccgctccctccctgatgtgcaatggggccaggggagtctggacagccgcccccagacctgctgaccacccaggttactacagacaccagatttgtgaataactgacgggggctggacactggttaccga

SEQ ID NO: 669551 - DNA, 113 bp, Homo sapiens
tgctgggattacaggcatacgccacccgtgcccggccagacgaacgggttttcacacggacagcaaggtgcagacgattgacgacttctttgaagctattgcttgttccgctg

SEQ ID NO: 669552 - DNA, 538 bp, Homo sapiens
gtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtcttggccaacacgatggggaaaggtcactgagggcatttcatggcttcacttctcagcgctaattttctgtgtgatcatgacaaaaaggggtttaattggctcatggttctgcaggctgtaaagaaagcatagtggcttggggaaatggcgcgggaagcatcactgtattttgcaaagtgagaaggacatgagatttggggagcagggagagaataataagatatggttgtgtatccctacagaaactcatgtggaattgtgatcaaaatgttaaaagtggggccacgtggaaggtgatttaatcacgaaaggggatggaca

SEQ ID NO: 669553 - DNA, 365 bp, Homo sapiens
agcgcggtggctcacgcctgtaatcacagcactttgggaggctgaggtgggcagatcacctgaggtcgggggttcaagaccagcctgaccaacatgaagaaattccctctctactaaaaatacaaaattagccgggtgcggtggcgcacgcctgtaatcccagccactcgggaggctgaggcaggagaatcacccgaacctgggaggcggaggttgcggtgagctgagattgcgccactgcactccagcctgggcaacaagagcaaaactccatctcaaacaaaacaaaaaaacaaaaacaaaaaccaggtcttaactaagctccacagttaaggctatcaaccaggactatgatctgggtgggc

SEQ ID NO: 669554 - DNA, 277 bp, Homo sapiens
gtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtcaataaaacaagaattaggtctcagatccaagagtcgctttctgtcttccagtttatgact

SEQ ID NO: 669555 - DNA, 317 bp, Homo sapiens
  misc_feature (46)..(46): n is a, c, g, or t
gttatggttttacggatttccttgaagcctctttccttttttgccncaaaagacccctaaattttcagtttccccccacccccccccaggagctgtgggaggctttgtgttatttgtgaaactcccaaacaggggtgttgcggaaaagggaaagttcaaggcaaacgcaaggactggatttagctccctaggggccccagtcaaaagccggacccggatttatatataaatatataaatataaatatattaaaccccctcatcccggccatttttgttggaaccatttttgggtttataaaagcattatttttgaga

SEQ ID NO: 669556 - DNA, 246 bp, Homo sapiens
  misc_feature (220)..(220): n is a, c, g, or t
  misc_feature (229)..(229): n is a, c, g, or t
  misc_feature (233)..(233): n is a, c, g, or t
gtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgnccatccccnttcntgtgtccatcccc

SEQ ID NO: 669557 - DNA, 310 bp, Homo sapiens
gtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcggtcgcactagggaggctgggaccaagcaccgtcgtttgtgtccagagggtcccatggcctcaggtgaggtgcatggttttggccgggggaccatc

SEQ ID NO: 669558 - DNA, 1423 bp, Homo sapiens
gcgcctatcatgggccgagttcgcacctgtagcgtgaagaatggcggtgccgtgttcatcactagtaaatagtgactacatgcgcctgggcaaagaattccactcgaacaagtcgcgctgtgcgaggagactcgccattattcccctagtcaatgaagctccgaggatcacacgatagcaaggcttactagtaaggcatctagaatgaaagcgacacttcacgagacggcccagataccgcaggtatcgtccagtcaggcttgcaggcaggaggacgacgagaaccggaagacgcacacatatatgtatccggaaggggtctcggggcctctgtgatccacggaagactctatagaatgctacgaatcatgaccacctaaacggacatactgtctcgaaacgtcgtttgtaggacccttcggagcgcgtcctttgtgccgaagcactttcacgcgtcaacgtcacggctactagatgaggagattgaccttttgcaaaacctgacacgtcggagggtagcgcttgtttcagtagaatgtgtattgacctcctcatgttcgtttcgttaattgaattgtatatccaaaatcacacattccctggggagaaacagagcgagggcatagatatggagatcaggaaaagacatagtagacataggtttccagtgcgaccatgtgtcaattgcattcggagtgcgccgtccgagcacaaagatagggacgaggatggattgccaaacggagagctagggcgctagattcttcgcgggggctataaatggccgcggtggaaaacttccgaagtatccgccaaaggggttgtaacggttcgccgagttcccaagaaagagaagcggagggggaagacccttgtaagcgagaaggcgtttgtccctcgtggttggactaaccccgccggaaaaggcgaaccctatatgaacactcttcccttggacacaaaagcttccagggctggttaggaccctagggcgcctttcctagcaatatttcgcgccgccgttacaacaagaaagagaaaggccctctgggggccaggaaagaaaggggcacaaggatcaaccaggaattagaattggaaaaggcttggggaaagccccaggggcgttgtgccccgggggtccccggaatggtttcttcccttaaacccatgtcaccccctacgaaaatgccctcgggtaccccaggccccccgttgtgaaaagaggctttaacccgttggggacagagcccttttaggggggggggcgttggttcccccgtgtcaaaagggttaatacgttcaccctttcttggcattataacaggaacaccataaaacggttaacaaggccactctgggttgggtgcatttttggcccaacaaaaacacaaacacaacatagacacatacaaaacagtca

SEQ ID NO: 669559 - DNA, 319 bp, Homo sapiens
acatgtttataaattaaaatatgtaacacacacacaaacatcatgcatgtatatatacgtatgtagcacaaagagatatggaaatatagatgtatgtggggtatatatgtgttcatgtacatatgtatgtacacatacacacaattactagctgtttgctgagacagcctagaggcaaggacacactgagtagcaatatgcatacccaccacccagatgtaggtttctaattactatcctccatttaaaagaaccagagcttctcggaaatggctgattccaaggcttagaaaggaaaagtacaaaataaacttgaaaa

SEQ ID NO: 669560 - DNA, 331 bp, Homo sapiens
gtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgaactacttatatatgaacgtgtgagtgttgtatgcaggggcgtcgagcgattaaaatgccactggagggccaggcacagcgcaatatgcctggaaccccagaactttgagagactg

SEQ ID NO: 669561 - DNA, 760 bp, Homo sapiens
  misc_feature (262)..(262): n is a, c, g, or t
ctaaaaatacaaaacttagctgggcgtgctggcagactgctgtaatcccaggtacttgggaagctgaggcaggagaatcacttgaacccaggaggcggaggttgcagtgagccaagatcgcaccattgcacaccagcctgggccacagaatgagactccgtctcaaaaaagtaataaataaataaatctggtcttgaactcctggcctcaagtgatctgcctgcctctgcctcccaaagtggtgggattacaggcgtgagcnaccgcgcccagcctttgttgtttctttaacgtcagaagaaaaacgtgcctgggttcaggacctgaagtggagaggtggcgtttaagcgtctcagccttgaagcagggttgtcacccgtcggcctgagagcacactgcctgtagatggcgctgtgtcctaacatactcgggatgcatccagctcagcccctggggcacacactcagcgaggctgtcaggtccatgtgccgaaacaggtgctttgtggcccggtggggcaggcagcatttctgggaacagcgtaacatcaccaactggccgcagaggaagggcagctccgccactgggatggtcatcgggcccctgtgtcttttggtttgcatcttggattggaacattcccaagtgcagctgaagatgggacttagccaagtcggctccctggcctggggcttcccttgacccttctgagcgcctgtgggttcaggggtgggtgttcttggttgaatcttgaccctggg

SEQ ID NO: 669562 - DNA, 266 bp, Homo sapiens
gtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtcatccgagcagttgccgacgaagggggatgacatagatccggtatt

SEQ ID NO: 669563 - DNA, 119 bp, Homo sapiens
cttatggacgattttaggaagacacgtggattattttagggtcttagggaggaaagaggaggggtggcgtaaactacttggaaagaaagggagaaggactgagaacgatggcaatggga

SEQ ID NO: 669564 - DNA, 149 bp, Homo sapiens
tttggttactgggattctactaatgtatgtcattctcgtaagtatatcacataaagtaagttatcctgactccttttgacactatgtaagctacacaccccacttggtttctacagggaaactctaaccataactaaaagaattgtgaa

SEQ ID NO: 669565 - DNA, 310 bp, Homo sapiens
  misc_feature (8)..(8): n is a, c, g, or t
  misc_feature (140)..(140): n is a, c, g, or t
  misc_feature (149)..(149): n is a, c, g, or t
  misc_feature (219)..(219): n is a, c, g, or t
tgtacgangtaaggaatagcccagaaacaaccaagtaggccatcatgctcgcgggccctgagctccaatgcactcgttaacttaaagatatacaaaactatgtctaaaaatggcttacataagatttgaatacagatcgnactacactngttacataaatttttctacatctgtgtgttaagcagctgggtctggagattagctattctggtggtccangattcccctattttatatatatggtgaaagcttgagagatactctctctatagaggtatttaggtggagccttactctgtacacagcgggt

SEQ ID NO: 669566 - DNA, 359 bp, Homo sapiens
gtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttgtctagcatatccacactgtattcactgccctatcgttggtcacttactggccttctctggtaaaaacatagaatagtaggccagacgtggtggttcacacctgtaatcccaaccctttgggaggccaaggtgggtggatcacctaacagcatgagtttatgacagacttgttcaacatggctaaaccctgttttacaaa

SEQ ID NO: 669567 - DNA, 159 bp, Homo sapiens
gacatttggataatatcaacaccatcgacgccccggggtgggtgggggggtctgtcacatagaacgtaccggggtgatgatgggtgagaacgttgcggcctatcatcatggctttcgtctcgctcatggtgcgaccgtgaaacacggagacgcccagag

SEQ ID NO: 669568 - DNA, 226 bp, Homo sapiens
tgaggttttgccattttggccagggtggtcttgaattcctgacctctggtgatccacctgctttggcctcccaaagtgctgggattataggtgtgagctaccacacccagccttgtgacagtggattctgatctcatagttcaaaagatggcatttggatgggagataataggttcagaaaggttccatttacaacaactcacaaatttgagggaccataggttct

SEQ ID NO: 669569 - DNA, 675 bp, Homo sapiens
tttttttttggtctgtgcccatgggtatttcttggtagctggctccttcggcttcaagtcaggggaatatgtggtagaaagaaaaacagtgaacttagcacatactgttccaaggtccctggccattctgccaccctctctccacctttcagagtctcctgtgctcattttatatgcaatgtccagggttttcattctacttagttgggaagcattagaaaaatctcctctgaagatttaatcttaaatagacatgtttatctatcttgcccatcccttctcgtgaaaaattaacaaaatgtaggaagtgaaaagataccactcatccccagtcatgtgagaagattctgcatggtctagtgaacttccttctggacttttctctgccaatttatttgtgtgcctcacaaataaatcgatcacaaataaaaggatcccgctgtagatcaatgtcctgtttttatgctcctccccagcatgtaagcattggtccatatggttctaaaagctccctggggatcctgctaagtggccgtgtcagattctggaggtgactggagcactgtctgtccacccacctggcccttggacttgggtttgcttctgtgatgccttgactgtctagtcagttttctgtcacttgtaacagaatacctgaaactgtaatttataaaa

SEQ ID NO: 669570 - DNA, 152 bp, Homo sapiens
  misc_feature (8)..(8): n is a, c, g, or t
ctggtggntcctggtgactgtcaacacgacacctggtggctactcacggactactcacgacacggacgacgacactggacacacgactagccggacgacactaccacgactacggggtacccgagcctcgacattcgtacatcactggtcat

SEQ ID NO: 669571 - DNA, 140 bp, Homo sapiens
gtgcgagcatggctggggtgaccatgttgggcttcagtaaggtgccttccaggttgatgtggtggtcctcagaggcttgtctacagctgccaggaccttctcggtcactatactggtagcgcttcaagtcatggtcccca

SEQ ID NO: 669572 - DNA, 123 bp, Homo sapiens
aagcggtccgaacttctcccatcagcaattaacaaaattacaaagcaaggcaaatcactgaatccccaaatactttgattctgccatcatccctgtaaacctgtctgatgggacgaagactgg

SEQ ID NO: 669573 - DNA, 678 bp, Homo sapiens
  misc_feature (228)..(228): n is a, c, g, or t
gagcgagctgcactgctttggctcttgctgcttgggtcgcgtctcggaaaccggtagcgcttgtcagcatggctgaccaactgactgaagagcacgacttgcagaacttcaaacgacagctttattcacctaatttgaccaacagatggctgactgcgaacctataaccaaccaaacggacatcggcgaacctgttaactgagactctcttctgggccagaaatcccnacagaaggcagaggattacaggagcagtgagtgtaagctgagaggtagaagttgcgtggacttggggttaacttgggggggtaccaatcaaattgtgaaaaccttttcccaccttggaaagaaagagtttgtttccctgggagacaaaagggtgtaacttggggggacctcaataagggcaagaaaagaaaaacaaattttgggggaactatgaacactaaaggaacctaatgtgtggcaaactggaagaagtggaaaaacagaggcttttgtttaaagggaaaaaggtaaacaagtggccactcaagattaattacccccgcggggtgatattgtggagctatgtggtgatttcctatcgttgtgtgacaaatgtttctatcacacttgggctggggaaaaatttggggggcgctcaaagaacatgattggcgtgcccgatttagagct

SEQ ID NO: 669574 - DNA, 585 bp, Homo sapiens
ggaccgaatgatccactggatcgggaggaaacttccaggatctaactaaaaagctggtgttaacccggtatgactgctaacccagatatgaagcaaagcaggaggtgactgcatggactgaggtaacggaggactgaaataattgttaatggcttctttttgaaacactgctgtttctttttgtttcattttttggagtctggaaagcttttctcttttaagctgtttatatccattaaaaattgagtagagtatatactcttgcaaacagaatttgaagcttttttctctgtctccctgacttctccagaatttggaaactatgcaaatatttttaattcatggcaatgtatttgtttgcatacatttattaggaatctgttttttataatgggacaaagttggaagaactggttattctcccagggctttgactggaatggcacattttcagaataagcagattgctttgagaaattgagattgactttatagagtcaatgagaacctcttagaataactggcctcataccttgtctatgcaattcctttgcacacttccgggcatgtggtaagtggaccgtg

SEQ ID NO: 669575 - DNA, 133 bp, Homo sapiens
gactctctacctgatggtggagctgtctgatgctctgtctgttcctgtcggatctctctcctctctgacctggatacgctttggtttctcaacttctctaccccaaagaaaagattattcaataaagtttcct

SEQ ID NO: 669576 - DNA, 127 bp, Homo sapiens
  misc_feature (64)..(64): n is a, c, g, or t
tccaacctgggacgcctttgtagagcttcttacttcctaacagcgtcactaaagatctgcaggnggccgggcatggtggctcacgcctgtaatccaatcccagcactttgggagggagttttggaac

SEQ ID NO: 669577 - DNA, 158 bp, Homo sapiens
attacattttgacataccaggtagatctactgtctctgttatattatgacagaccagctagatctactgtctctgttatattatgacagaccagcttgatctagtgtctcgattgtattatgacagaccagctagatgtcgacgcggccgcgaattta

SEQ ID NO: 669578 - DNA, 500 bp, Homo sapiens
aaacttttgtctagaattatcaaaccatcttttgctggaattaaattatccagttttagatcttttaccttccttttgctttaagttgtcatataatagctttgatttttctcaaatcatattagagtctacaggtctgcctttcttatagccatcctgtgcccacataaaagctgcattttcaatacaagacaaaaaaggtattttgcaggctaggcttggtggctcacacttgtaatcgcaatgactcagaaggccaactcaggaggaccacttgagcccaggagttggagaccagcctggacaacagagcaagaccccatctctacaaatcttttttttaaaattagccagcgtggtggcatgcacctgtagtcccagttacctgggaggttgaggcaggaggatcccttaagcccaggagtttaaggttaccatgagctatgatcacgccactgcactccagcctggacgacaaagcgagatcagatctcttaaaa

SEQ ID NO: 669579 - DNA, 1001 bp, Homo sapiens
gtctctgtgtttgtgttcttcctttctgccgcacttttcgcttctctttttctactgctttcttctcgtcttcgttctgctgctcctcgttgtttacctcctctctttctctttctcgcctttctctttttggctcccgtcgtcgttcttctggtttgtgtccctgggcgctctctggcctgccagtccctcttccctttacctctcgttctgtccttgtttggtcgccttgtccgcggctctccgtgtggtacccctttgctttctatccgctcctcctgcgtttgatctctcgcctatctgtatccacttttagctcgccctagtgtcgagcgcttttacatgctctattttgcttcctatgtcgtcttgttacctactctgcatgtcattggccttgtgttacctctggtgtccccctaagtttcacccggtggattccccatgttgtcgcctccatttgtattaccgtcctgcgtttgttgcttgtctgtgcttgctgcccccttgccccatctttgtttgccttgtcccagtctgtgtccccctttcctctgttatcatgtggtgctgcttggacgtattggcctcccgttcggcctttgtctggaatatgcctttatttgccaattacctcatagtcacctcagtaaccatgtcatgtgagggctgtggttattgtcctgcctctgccttgtctgtctcagtcggtgcagtgccctagagctccatacctcctcttaagtatgcccttcgatggacagcctcacccatctcccacctgggcccagcccaggagccccgcctggccatcagtatttattgcctccgtccgtgccgtcactgggccatctggcctggcgtcctgttcccaccaggctctcagtgccacaatccctctggcaggccttacctgacccaagccaggaacaaaaagggaccaagtgcacacattgctgagagccgtctcctgtgcctccccgccctatccccggtcttcg

SEQ ID NO: 669580 - DNA, 375 bp, Homo sapiens
acgctcttccttcggactactcacgaccaccgacctgtgactgactgggaccgagcgggctgactgcagtggcgtgtgcttccatttggcaaccactgtgacctcacgtcactactggccctgcacaaactggcccctgtcaaaactgagccccctttgtgtaccttcattgagacacattacctgaatgagcaggataaaagccatcaaagaattgggtgaccacgtaacctaacttgcgcaagatgggagcgcccgaaatctggacataggcggaatatctcttatgacaacgcacaccctgggagacagtgataataaaagctaagcctcgggcttaatttccccatagccgtgaggtgacttccctagaca

SEQ ID NO: 669581 - DNA, 212 bp, Homo sapiens
ccgaggtagccccccatgggtggtggccctcaccaacctgtcccagccaggactgtcctgccgtcaaatggatctctctgccggcccgcagtcctttgggcaagcttttatctttgtgttgcaagcttagcactcgttggtcgcggggtctccctcctgtgctttccaaccgcccccgggcgttaataaagtttagcagcgtcccccagtga

SEQ ID NO: 669582 - DNA, 165 bp, Homo sapiens
tggaggcaggaactggtgggaggcaggacactggtgggaggcaggacactgtgggaggcccaggtggatctgggctcacaggcaagggcctcagtgtcctgtgagctccaaggggctggggaggactgccttctggattcagggtacaggtcggtgtgtttctcg

SEQ ID NO: 669583 - DNA, 732 bp, Homo sapiens
tttctaataaactgttgagttgaaaaaaaaaaaccaaaaaaaaaaaaaaaaaaaaaaaaaaaaaaaaaaaaaaaaaaaaaaaaaaaaaaaaatttttgcgggcggccctggactccggcctcccttggcgcgttccgccttgtgggggggttggcttccatttcccgggccggtgttttcccacggcccttggcggtcccccctttggcgcctcccaattaatcccccttgcccccccccccctttcccccggggggccccccaccggggggcctccccccgttggccctcccaactgggtggcctggcctgtggggggaaggtttttggggggcatttttttgttggtttatggtggagttagttttttgttaacccacttgtttttccaccggacgggccgtgtttggcccttcctttttcctttaattgatttgcccggggttgcggtgggggccccggcccctctgaccaggccccttttttaaaggcggggtccccaacgcgggttgccgagctctggtcttcttggggggccctcccccagggacccttttttttaatcaggttttggggggctgtgggcccgtccctcttggggcccccccttgggggccccctgggttggcctgtcccggaccgcccccgacggcgcgaaagggggggaggccgtgtggggtgcccgtgggcgttcctgtggttatcaccatacggccccccacggcgcgtttt

SEQ ID NO: 669584 - DNA, 119 bp, Homo sapiens
  misc_feature (12)..(12): n is a, c, g, or t
aaagactacganctgtgtattgataatgtaccttatttgatctcaagttgtataaaaacaataaatttgtgttatgcagtagtaatcttatgcacaggtgatttcatgtgatatatgca

SEQ ID NO: 669585 - DNA, 260 bp, Homo sapiens
gcgcagttgtcgtgagacaaaggaaggacctcaggaaaggaatctgcagtctaggccacatagccttctctcctcacatcacctccatggagaatcactgactttgtttcacataccacaatccacagggaaatcctgtctgggaaaaaaatgactctttaaagcttctgaatggaccaagcctttctttttatatttggaggaaactgggcttcagagaggcccaaggtaaagttccacttcctcacgacaactgcagc

SEQ ID NO: 669586 - DNA, 308 bp, Homo sapiens
caacgatggtcctcagcgggggcgcaggagcgagaaggggacgcggcgcccggctaaaatggtctttctttggctcggacaaaagaagggtatctagctagggcaggtttagaattctgtggatctcagtccttctggtctcaatggattggtcagagttttcttactaacatgggcttctggttggtggcaatataaatctagtggccattggtgatccctttttcctgtgtaaatgacggtgtagggttctggccgtggaaggtgttgggaaagtgtcgagtatctggaggtcatcggattcagtc

SEQ ID NO: 669587 - DNA, 172 bp, Homo sapiens
aacaacaaatattcaaccaattcccacggattgaagatggatgggcctctttggcacacccacagaggatgttttccagtatgaagcggctgtgcctgttggagcatgaattggggtctcccccctttgcttctaatcttgaaatacatctggtacaatatccagtgggcag

SEQ ID NO: 669588 - DNA, 755 bp, Homo sapiens
  misc_feature (28)..(28): n is a, c, g, or t
  misc_feature (99)..(101): n is a, c, g, or t
  misc_feature (103)..(103): n is a, c, g, or t
  misc_feature (105)..(105): n is a, c, g, or t
  misc_feature (110)..(110): n is a, c, g, or t
  misc_feature (114)..(114): n is a, c, g, or t
  misc_feature (122)..(122): n is a, c, g, or t
  misc_feature (150)..(151): n is a, c, g, or t
  misc_feature (157)..(157): n is a, c, g, or t
  misc_feature (170)..(170): n is a, c, g, or t
  misc_feature (174)..(174): n is a, c, g, or t
  misc_feature (197)..(197): n is a, c, g, or t
  misc_feature (205)..(205): n is a, c, g, or t
  misc_feature (215)..(215): n is a, c, g, or t
  misc_feature (229)..(229): n is a, c, g, or t
  misc_feature (231)..(231): n is a, c, g, or t
  misc_feature (238)..(238): n is a, c, g, or t
  misc_feature (249)..(249): n is a, c, g, or t
  misc_feature (252)..(252): n is a, c, g, or t
  misc_feature (254)..(255): n is a, c, g, or t
  misc_feature (271)..(272): n is a, c, g, or t
  misc_feature (279)..(281): n is a, c, g, or t
  misc_feature (284)..(284): n is a, c, g, or t
  misc_feature (290)..(290): n is a, c, g, or t
  misc_feature (296)..(296): n is a, c, g, or t
  misc_feature (333)..(333): n is a, c, g, or t
  misc_feature (343)..(343): n is a, c, g, or t
  misc_feature (351)..(351): n is a, c, g, or t
  misc_feature (356)..(356): n is a, c, g, or t
  misc_feature (374)..(376): n is a, c, g, or t
  misc_feature (389)..(389): n is a, c, g, or t
  misc_feature (393)..(393): n is a, c, g, or t
  misc_feature (396)..(398): n is a, c, g, or t
  misc_feature (404)..(404): n is a, c, g, or t
  misc_feature (410)..(410): n is a, c, g, or t
  misc_feature (422)..(422): n is a, c, g, or t
  misc_feature (430)..(430): n is a, c, g, or t
  misc_feature (442)..(442): n is a, c, g, or t
  misc_feature (444)..(445): n is a, c, g, or t
  misc_feature (462)..(463): n is a, c, g, or t
  misc_feature (465)..(465): n is a, c, g, or t
  misc_feature (471)..(471): n is a, c, g, or t
  misc_feature (473)..(474): n is a, c, g, or t
  misc_feature (523)..(523): n is a, c, g, or t
  misc_feature (525)..(525): n is a, c, g, or t
  misc_feature (531)..(531): n is a, c, g, or t
  misc_feature (535)..(535): n is a, c, g, or t
  misc_feature (546)..(546): n is a, c, g, or t
  misc_feature (549)..(549): n is a, c, g, or t
  misc_feature (551)..(551): n is a, c, g, or t
  misc_feature (605)..(605): n is a, c, g, or t
  misc_feature (612)..(612): n is a, c, g, or t
  misc_feature (618)..(618): n is a, c, g, or t
  misc_feature (660)..(660): n is a, c, g, or t
  misc_feature (671)..(671): n is a, c, g, or t
  misc_feature (740)..(740): n is a, c, g, or t
gagggctaggggaggggcaggctgcgtncagtcctgggacgcagcagcccgcacaggttgagaggggcacttcctcttgcttaggattgagtgaggatnnngncntggtngggncggtgganaaccacaaagctctctggaggaaagaannggcctntgttctctactanctgncccatcagcagaaaactagactncttacatnatgggggggnactgcttgaaaggnangaaaaanttaagggaggnaananngggaggagaaggaagnnaaagtannnaantattanaagaanaaataagaatgaaagtaacggaaaggaaatattttanatcccgaacnatggaatnaaatntagaaataaaaaaaaggnnnaaggaaaaaaagnaaanaannnaaggtncctgtncggcggacacgnaagggggnagagggaggtgnannaggggcagaaggagaannancgggantnncaggaggtaggactgggggggaagcgtgaatagaggcaaaggaccccgntnggggcngggnacgggcactgnaangnaaatgacaccggaaaggtattgaaggaaaaaaaaaacggaaaaaaagaaaaacnaaaaaanaagganggaaaaaagaaaaaaaagacgacccaaacgacccacagacanacgcgccgacncgccggcacaccgcaccacgagaccccacggcgcgccccgcaccgcaacgcgcaacgagcccagcacgnagccccccccagagg

SEQ ID NO: 669589 - DNA, 1305 bp, Homo sapiens
gcggactccgcggacaaggccaggcctagccttgagctccgtcgggcagggccgccgggattggtgtccggcagagcgtgagcccagcgggctggagtcggcgagcgggagtgaaagaagaaaagctagagagcgaaggcaaagcccgaggagagagggccacggtcggcggaggaatctgactgcacggttgcgtgcgctcactgccggagggctccctcagccgggcggctccgctagtggctaaaggcaaagcattccggggcgcggcgcatgaagttgagcttcgtccctgctagccgccgctttctccccaaaaatacatcctagccttaatgtttatgcctccattgccccagttcttatctgttttgctcaatgtctcatagctacaagaaggcaatttctgacgaagccctccgtcccttccaaatggattattttggcgggcttccacccggacagtatgccacccgaatgactggacaagtgcacgggagcggctgtcatttgcggagtgcgccttgcgatctaggcgcctcacagcgcaaattatccagtaatttctctgaaatcgatgctggtttgttttcccaaggcaaatcagcagcttatacagacattggggccacaaagccggtggaacaacgggagacggcttcctgagtgtcaggtcctccaagatgagcttaaacttcgggtggtgggcaggctcggtaggcgggaaaggcccgtgtccagatgaatgcagtccatgtttatattgatgaaagacacgtataccatttggtccagctcaaccattcttaacaagtgctggctgtgagcactggtgtgtgtgtgcctgcgtgcaaccagcaatgtaagtgatgaccagctgcatgatgccttaatttgagtggacaaagtcggtcaagaaccactttcaggcttctgggtctccaagtctttgtctccctgtatccaaacgaggcattccaagtttgacagcatggaacattgcatgtccgaaataccaaccgtgaaactgggtaaaaagcttcaggaggtgatattgatgtgtatagtttaggaaataaaacccaatacttacttcaaagaacgtaatttgtggctttttagagagaaggatactttgacagttttcatttgtcgtctacatgtatatggtacgtttcattctgccttttaattaatttggtattttactatgaaaactactttgtattaataaaataatgtatttccaatgttataagttgtgttataacagtttcaaaagccaaataaacaagatgcattttg

SEQ ID NO: 669590 - DNA, 248 bp, Homo sapiens
taaatatattgtctcattattttgcccggggttgtcttgaactccctggctcaggagatcttcctgccttggcctcccgaagtgtcaggattacaggctctagccgccatgcccagccaatttattgtttttaattatgtaaaacttttaaattctttgacagtccaaactagactaataaggtacattaatagaagtctcactttcattcttatacttttcaacctattcccttctgtcgtcttctc

SEQ ID NO: 669591 - DNA, 450 bp, Homo sapiens
tgcactccaacctgcgagacagactgagattccgtcaaaaaaaaaaaaaaaaaaaagtttgtttgattaggcacgggggttcacacttgtattcccagcattctgaaaggccgaggtgcgtggatgggggagcccaggatttcaagagcagccgtgggcaacatagtgtgaccccgtctgttttttttacgatagatttaaaaaaaaattttttaaagggaccatacgtagacaatgctgttttctgaaacaagccccagtggttaggcgattcagaagggagagacccacttgatttctgaatacacagttattctcaaggggtttttttaaagaccccacctttttttttctcctttggttgggtttacaaccgagtttttttatagatcgtggtgtcccctttattaaattttctggagagtccctctaaaaatagatgtacctttc

SEQ ID NO: 669592 - DNA, 124 bp, Homo sapiens
gatgactggtggttgcataactgaaaaccaaaaccactgacttgtatactttcttttttattttattttttgagacagagtctcgctctgtcgcccaggctggagtgcactggcacaatctcgg

SEQ ID NO: 669593 - DNA, 548 bp, Homo sapiens
aacttgacactacaggtagctccactataatcagtaccaagggcgccactcgtaatcatcactctgaaacaaacgcacccttaaatatggcactgtgggctgaacgaactccaccttgtgatacaggaaaggattttacgtttcttctatacaatcgtccaccattgtgtattactatggaagaatggattctagatcattcatgttatattgtgtcaagctaccttgaaaacagaaaatacgtactctaagcctagacgtgcataaataacattacctggagattgacagacggggtgaaagcttttattgtggtttctcagaaatatataaagcagtagttttcctttaactcttctgtctttaatgccatctgcaaagatatatcatccatacctttaacctctttcctagggatttggacccatttggcaaatagcttcaagtactcatagttaattttctggctggttttcctaagttaacctgattttacaaatattccatttgtaggaccagtttacatctactttcccaagctagccaac

SEQ ID NO: 669594 - DNA, 2848 bp, Homo sapiens
ggcgaagaggcggggcgcccaagctgccgcgctggcattttctcctggacaaggagagagtgcggctgctgagagccgagcccagcaatcccgatcctctgagtcgtgaagaagggaggcagcgagggggttggggttggggcctgaggcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttccctgtgtgctgccagtttggttcgcaataactggattgccctggcacaaaaaagggggctaaatcccaggccttcgtaccgttggaaggcctaggggataaaggggggaagaggaaaggttaggccctgggggcccaccgaattgtgcgcgcgttttaaacaga

SEQ ID NO: 669595 - DNA, 3005 bp, Homo sapiens
ggcgaagaggcggggcgcccaagctgccgcgctggcattttctcctggacaaggagagagtgcggctgctgagagccgagcccagcaatcccgatcctctgagtcgtgaagaagggaggcagcgagggggttggggttggggcctgaggcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttgggtaggtacatcactttggattgggcagttagggtctctgggggatatagggtccatggggttgtatttatgtgcatgagctagaagtattaggaaactcattgtagggagatgaggaaagtatggggcagcactctttggtatgtatattccttattatttgatatatatcattgatttttttacttcttctttcttatgttcacagatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaaaaaaaaaacaaaaatgcgagggcatcattacgggggggaaaaaggggtacgaaag

SEQ ID NO: 669596 - DNA, 213 bp, Homo sapiens
gccttgaggatccttccgggggaaaaaacaaacctaagatacttttttaaaagttctacaagccacgttaaaaaaaattgaacaggactgctttatgtgtaatttatgacacaactgttacatgaattgcaaatgaaggcttaaaatatatagcagctacaaaaaaaatcagataactcatgcttcatgtcactcctccccgggatacaggga

SEQ ID NO: 669597 - DNA, 2184 bp, Homo sapiens
ggggagcaccacgacatatgtaatagctgcgatcaccggttgttatttcagtcacgaggactggtctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaaaaaaaaaacaaaaatgcgagggcatcattacgggggggaaaaaggggtacgaaag

SEQ ID NO: 669598 - DNA, 1317 bp, Homo sapiens
  misc_feature (1317)..(1317): n is a, c, g, or t
gctcaccgtctagcatcaccatgtattggaggcatccgtcgtacccagtgatacatgcaaagagctcctcgtccattcaatagcgagctaatattatcaatcgatccaataactttatccaactggaatcacggttaccctaggagactaaccacgcgcaacatcctattctagcattgtccacgtatttcaatcaatatgcgagtgggattcaccacgtgcaactgtgtggagtcaaggagaatgcgcctgatggttgcaagactgatcttcaagagtgttcgcattgtgcacacgatgtacaaggctcctacggcctgcatctgcatgtttatcaagattgccgagagtagtagactgcctagagctcgagtattcgtaatctagcgttgcaaaaattttgccttccccttgttatcgtacacacggagcacaggacgataaattagatggccctaccgtttctgcaatagacggcccttcccccctcggttccactgatattcatcgtcaaacctataggttagtctagtaacccgcagcagcacacaatgcctaacgtaacccatgtgtgtttgtcgcgtcaaggaaactggccattgacgtcccccggtctataatccgtcattatacacccatgtaagacatcctcttagcagtccacgaggtgcattgcgaatttgtgcccttcctatctttataaggccgaagcgaatatctgccaggtgggatgccaaatgcattccctaacttccattcgatttcgctagctccagtgtcggttagaattcgtacaacactgtggctaatttctctctgagattgccttctaacgctgctaatggaaagcagccattatcgtgcgtggcccttaattacctaccaaatggttatccgccagaaaggggtctcccctgaaaccgggtttggttcagtggccccccagtaaccgtgggggcatttccattaacaaaaccctcattcgtgcttgtaacagccccaattaaaacgacctcctttgtcagccatacagggtaggcccccactataaaagccccgggcagaggaatcttaaagcaatgcaacccccttctttacaatttcaaccagtaccccacagggaactactttcaagcattcttcaacaccaattcggaggtgtcatttccttaactttaatttacagaacactctgcgtgtttcagccaagtaacacacacatacgccacctctggtgtttgacaaaagctgtcagaatgcattaaggaacatccgtaaattataaatttcattatagaccacacaccatcatagatn

SEQ ID NO: 669599 - DNA, 1595 bp, Homo sapiens
  misc_feature (1514)..(1514): n is a, c, g, or t
  misc_feature (1521)..(1521): n is a, c, g, or t
  misc_feature (1523)..(1523): n is a, c, g, or t
  misc_feature (1531)..(1531): n is a, c, g, or t
  misc_feature (1535)..(1535): n is a, c, g, or t
ggcgaagaggcggggcgcccaagctgccgcgctggcattttctcctggacaaggagagagtgcggctgctgagagccgagcccagcaatcccgatcctctgagtcgtgaagaagggaggcagcgagggggttggggttggggcctgaggcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaactngcctcgntnactggccntttnccatcgttggccagaccgggtggcccccatggcccttgggggcaatgggcttgtggccag

SEQ ID NO: 669600 - DNA, 337 bp, Homo sapiens
ttggagccttaccctggctgggtgaagttctcacgcctgtaatccgagcactttgggaggcagaggcagatggatcacttgaggtcgggagttcgagaccagcctgaccaacatggtgaaaccctgtctctactaaaaataaaaaaattatccggacgtggtggtgcatgcctgtaatcccggctattccagaggctgaggcaggcaaattgtttgagcccaggagttcaagaccagatctggagacagagcaagagtcaaaactgatgctaaaaacagggttggtaactgggaatcacttatagtaatgggatgaggagaaagaagtggtttggag

SEQ ID NO: 669601 - DNA, 162 bp, Homo sapiens
agccatagtaaaattgccccgaaataagtttctcaagatggtttacgcttgagcacagtgcataaaacctggccatgtagaattgtcactttgggtatgatggggtctagtcaacgagcaggcctggtgagcagagtaacctccccacttgccctgggcatt

SEQ ID NO: 669602 - DNA, 1321 bp, Homo sapiens
  misc_feature (34)..(35): n is a, c, g, or t
aactatacgggctaggtacgaggctgggtggtgnnctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaaaaaaaaaacaaaaatgcgagggcatcattacgggggggaaaaaggggtacgaaag

SEQ ID NO: 669603 - DNA, 176 bp, Homo sapiens
taacgagtcagggtcttgctccggtcacccaggcgggagtacaggggtgcgatggtagctcactctaaacttcaaagttctgggtgctcaagcagtcttctgtccttggcttcgcaaatcacggggataacaggtgtgagccaccacaccgggctaattttaaaatttttttggta

SEQ ID NO: 669604 - DNA, 495 bp, Homo sapiens
gtagttcctgagctctaatgcgtgttccatggtcgtacgtgttcaggttttgagagtgaaaaacattagtccgtacctccagctgtgcacatgctattccttctacctagagaagttcttcacctccaccgtcgcgatctaaattgctcttccctgagaagacattttccagcctctaaacaagcccactcccctgtattttgtgacacgtaatataattttagattgcttgatttgtttagtttactttatttctctattgccagactttccctttaagctccataaaatcaatgacctgggaatgaatggatggatgaatggatggatggatggatggatggatggatggatggatggatggttggagttgagatctctttgtgaagctgaattcttcacaaagtccaccctctcattctttattcatgctggagctacactcagccagactcctgggaattgttgctcctccatgaaccaacaaagcttatc

SEQ ID NO: 669605 - DNA, 1445 bp, Homo sapiens
ggcgaagaggcggggcgcccaagctgccgcgctggcattttctcctggacaaggagagagtgcggctgctgagagccgagcccagcaatcccgatcctctgagtcgtgaagaagggaggcagcgagggggttggggttggggcctgaggcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccagacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttcaagttttggtatcagaaataaacattgaaattgcaaagtgaaaaaaaaaacaaaaatgcgagggcatcattacgggggggaaaaaggggtacgaaag

SEQ ID NO: 669606 - DNA, 1413 bp, Homo sapiens
ggcgaagaggcggggcgcccaagctgccgcgctggcattttctcctggacaaggagagagtgcggctgctgagagccgagcccagcaatcccgatcctctgagtcgtgaagaagggaggcagcgagggggttggggttggggcctgaggcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccacctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaaaaaaaaaacaaaaatgcgagggcatcattacgggggggaaaaaggggtacgaaag

SEQ ID NO: 669607 - DNA, 831 bp, Homo sapiens
gggaacttcagtttctgggcgttgtcagcgtggtatgcagtatacgacgttcgacagcgtggaggggatggagtcacgttgtgtagcacttacctgagatattctagatttggaggatgcgtagagcacagaaaatatggtgagctagcactggtgatcccaaagctgctcgagtggattagagcctgagcctgggtggtcacagcgatatgccctttctagtaccatgcatgctgtggctgttagtagtcattggccttgtcagcagaccttctaccctggtggcaatacaccgtgagagctgtggcccgtgggagtggccatcctaaaacaagccagttaggtcatctgccatcatacccttaacctctgtctctcgcctgaggggaatctgcaagctgtgcattgggcttacctcctgcttattgtagaaataagcatcctttggtatacatggaggatagttccagaacgcctgagtatacaaaaacccaatgcatactcaagtcccacagtgggccctacagaacccacgtatgtgataaatcagccctccatgtacgcaggtttcgacccctgccaatactgtattttcaacctgtatggttgaaaaaacatccatatataagtgcagacatgcagttcaaacccatattggtccagggtcaactgtatagtttattgaacagcgcacacgcattcctttacagcatgatctatggcagaagttgaataagttggcaacagacaactatgttggactgcgaaaatcgggaaatattcactgtctggccttctaccagaaaagttggcagcccctgatctaggcga

SEQ ID NO: 669608 - DNA, 428 bp, Homo sapiens
agaatgccgtccagattgcccgccgttagcccaaagagggaaaaacccccctttttttttttagggccccggggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaaaaaaaaaacaaaaatgcgagggcatcattacgggggggaaaaaggggtacgaaag

SEQ ID NO: 669609 - DNA, 339 bp, Homo sapiens
  misc_feature (16)..(16): n is a, c, g, or t
ctggccagcatcagcnttttattaaaagtaaatgcacagtaatatgtacagatggcacatggtgccaattttatttgtaaatatagactccactcaagtttcaagttacaccttggcacaagcctcttctaaaattttagacccgccggaaatcaccggggggggaggggggcctttaaagcctgaagggcgaacctttttttaaggaaaggcctttaaatccttatttaccacaaacccatttttattaaaggcccggaaaggggggaaaaaaaaaaattttctctcataataaacaccaacaagggggttttaaaaaatgtaggcccttctccaaac

SEQ ID NO: 669610 - DNA, 661 bp, Homo sapiens
  misc_feature (42)..(45): n is a, c, g, or t
  misc_feature (47)..(49): n is a, c, g, or t
  misc_feature (51)..(51): n is a, c, g, or t
  misc_feature (53)..(53): n is a, c, g, or t
  misc_feature (56)..(57): n is a, c, g, or t
  misc_feature (60)..(60): n is a, c, g, or t
  misc_feature (65)..(66): n is a, c, g, or t
  misc_feature (340)..(340): n is a, c, g, or t
  misc_feature (407)..(407): n is a, c, g, or t
  misc_feature (418)..(419): n is a, c, g, or t
  misc_feature (423)..(423): n is a, c, g, or t
  misc_feature (443)..(443): n is a, c, g, or t
  misc_feature (445)..(446): n is a, c, g, or t
  misc_feature (455)..(455): n is a, c, g, or t
  misc_feature (479)..(479): n is a, c, g, or t
  misc_feature (481)..(481): n is a, c, g, or t
  misc_feature (483)..(483): n is a, c, g, or t
  misc_feature (495)..(495): n is a, c, g, or t
  misc_feature (497)..(497): n is a, c, g, or t
  misc_feature (507)..(507): n is a, c, g, or t
  misc_feature (511)..(511): n is a, c, g, or t
  misc_feature (516)..(516): n is a, c, g, or t
  misc_feature (525)..(525): n is a, c, g, or t
  misc_feature (528)..(528): n is a, c, g, or t
  misc_feature (532)..(532): n is a, c, g, or t
  misc_feature (534)..(534): n is a, c, g, or t
  misc_feature (541)..(541): n is a, c, g, or t
  misc_feature (543)..(543): n is a, c, g, or t
  misc_feature (545)..(545): n is a, c, g, or t
  misc_feature (549)..(550): n is a, c, g, or t
cttcttaaaaaatttattaaatgccattgatttgactggaannnncnnnantnctnntgntattnntgaatccataagtagctgtatctagaattcatacttaagaaaaacacacaggcatgaataaaataggacacagtaatgagaatgggcagttctgcagtgtacactttctcaagcacctcagaggacacacacttttaaagtacaattcttcacagacacatgaagcagaacatttgaaaatcaaaacttaaatacaagattctaaaagtgaatggcaatttaatggttaaaatttgaccagtggtgaaacaagcagcaagctacaaaatccatnaccaccaacagtttcaatgttagcactaagtattaaaccaaagtaatgcatattctggttttgcttnttcaagaacannccgnttattctgtttcaatctctntnnacaatactngtaggtaatagttacactgcaatntntnacaaaaaacagngntggttcttgncatnactgnatttatagnatnaatntnccaaggntntnaatnnagtcaattagggcaggttagaataaaaaggcctaaaaacaaaggggattcctggtagtttatggaaaatacaactgcccgggccacataaaattaccttttttaaacaata

SEQ ID NO: 669611 - DNA, 473 bp, Homo sapiens
gcagaatcttgaaaagcccagaaatccaaagagccctccgagcaccacgcaagaagattcatcgcagagtcttgaagaagaatccactgaagaacctgagaatcatgttgaagctgaacccttacgccaagactatgcgcaggaataccattcttcgccaggccagaaatcacaaacttcgtgtgaaaaagctggaacagcagctactgcactggcaaccaaatccgagaaggttgttccagagaaggggactgcagacaagaagccagcggtaggcaagaaaggaaagaaggtggatgccaagaagcagaagcctgcagggaaaaaggtggttgccaagaaaccagcagagaagaagcctactacagaagaaaagaagccagctgcataaactattaaaaattgttaaattccagagagcaagtagagaccgcatatttcaataaatcaaacatgttggttgaccaaaaaaa

SEQ ID NO: 669612 - DNA, 651 bp, Homo sapiens
  misc_feature (387)..(387): n is a, c, g, or t
  misc_feature (401)..(401): n is a, c, g, or t
gattgggcagtgtcgaacatcatgttgacgcgctcaggcgtaatgtcatcccaggcggcgaacaccagtaaatgagagcagtcggtcacctgggactgataccagctgaccgccttgatcttttcgcgaatgtgcggattagtcaccaccggcaattcaaatggctggaggccgctcgaggtcgccgtcagtcgtaccgcttccagaattcgctccagcttttcagccggcacggtcttggaacgggtcataacttttcgtcgcataacgccaattcagtaactcggttattttgctcattcttcatattccacgtaggtcaacggtctttatccagcccaatccgaataccttcaggattgcgctccggcttatactgcggattanagtcaacttgaagntcaagcaaaaaatgaagatcggcgagatttcgcgacgcacaggccttgctgcttcagcaatacgctactacgaggagcaaggcctgctggacgctcccacgcgtgacgtgaacaatctatcgctattaccagcgaaaccaccattaaacgcttggaagtcgtgatccatgcgcaaaggttgggttttccctcgacaccattcgtgcttcttcattcatgacggtaggcgtggccataaagaggtgcgagg

SEQ ID NO: 669613 - DNA, 413 bp, Homo sapiens
ggaatctagcgagaaatggtagaattcagattttttttctactagagaggtgctgtgtgtgtaaaattcttgctctttgccaagacacatgagtgtacttacttatccttctaaaatagaagggagcccagctgctttgtgtaccttgaaaagcttaacagggatctctgaagaacttcaactcttggttaggggctagcttggggacattggtctgggtccagaacagcctaagaggccccacagcagtgggaatttgttctttaattgtctgggaggtagggcttagctttggcaggcaggcagatttaaagagcccttgaacttagaaagactttgaggacccagaagattgtaacccgtcaaacttacccccgtacggagggcgcaagggttaccgaggctcgaattcg

SEQ ID NO: 669614 - DNA, 201 bp, Homo sapiens
ctggaggagcagcttcttctgggactggacagctttgctccgctcccagcggcccggcccttccccaggcgcaacatcaccacgactctgtgcgcaccccatttccactgtgcctcaccacaactacacagcaaccagccgctgagggctcccatggctgagtggggagagtccctaggataagttcccagatcacgctga

SEQ ID NO: 669615 - DNA, 457 bp, Homo sapiens
aatgattatagtgtgttcataagataaaagtagaaggcacagagagaggtagcaaaggccagctatatctaaggtatagctacaaagataggtgaaaaaaacactgccatacacaagtcaaggaacccagggcacagctggaaatgaggagcacacatgctagtagagaacacacatactgtagaagataagcagagtgtctagaggtaagtgtagtagtgaaagatataaggtaatgtagagcaagtagaaaatggatagagactgcataggtaggcataaaataagaaataagcctagtagcatctagtctaacttaaaaggaagtggagacataaggagagaccaacacaggtttagtgccataaagtatataacacaacgacaccaagatagtggtaaatgaaaataattagttcacttcacctagctgacatgaaactatgacttaagaagg

SEQ ID NO: 669616 - DNA, 173 bp, Homo sapiens
ggcaggaggtgtagccactcctcatcctccctgagtgctgatgtctctctccctcttactcttcctcttctttctactctcttctcctctcttactctcctctgtctatcttcctctcctctcttcctctctatctctcttcctctcctctctctcttcctcttctctcttta

SEQ ID NO: 669617 - DNA, 177 bp, Homo sapiens
cgggtgctctgcaactgctggatctcaggcataccatctcatcctcagcctctcaaagtgctggaactacaggtgtgagccatcgtgcccagcctatccttcctttcatcttgaaagcatatagtacatccacactaatctaggcacacttttgtaccccctgattacacaaaatgg

SEQ ID NO: 669618 - DNA, 711 bp, Homo sapiens
  misc_feature (160)..(160): n is a, c, g, or t
  misc_feature (559)..(559): n is a, c, g, or t
  misc_feature (588)..(588): n is a, c, g, or t
  misc_feature (620)..(621): n is a, c, g, or t
  misc_feature (626)..(626): n is a, c, g, or t
  misc_feature (635)..(635): n is a, c, g, or t
  misc_feature (650)..(650): n is a, c, g, or t
  misc_feature (664)..(666): n is a, c, g, or t
  misc_feature (675)..(675): n is a, c, g, or t
ttgggtgaatgtgtaatgatattttctgtacttttggtatcaactcagaactttccagaagaggctcgtccctggcctgatacgatggtccaaaggattcaatcctccggggaaatgggaagacggtgaagcgccctggttagcttatgggctgcccaantccatccaacccttggcattgggatcaatgttgatgaggacaagaccttcaacagtgtccgggtggttaagagcatatctcgccaggatgtaggctccagctccaacaccaactccaattattgtagagaaatttaggtactgcaggacgcaagggatcatgtctgcaagctggtccagagatgggtactgatatcccaaagggaacacaggggcttccctcttccattccaggggcatccacatgaacccgcacaaagttctgaatgatttcctgcatgtcctcgaactgaaacagtggctggaagcaagatttatagttgagtcccacatcgtggtaggtaaggatcgctgggcgtttgggtttgggggtgccatagacagtgaaagtgacagagcngtatggtgtctccacagagtgagtcttgnccgcctcaggcgtctgtcctggcaacagtggnntctcntctgtgatntgcacctcctgcagntccgccatggtggnnntgctgccgncagcggccgcttccaccttcacttgcctgttccgct

SEQ ID NO: 669619 - DNA, 791 bp, Homo sapiens
  misc_feature (160)..(160): n is a, c, g, or t
  misc_feature (639)..(639): n is a, c, g, or t
  misc_feature (668)..(668): n is a, c, g, or t
  misc_feature (700)..(701): n is a, c, g, or t
  misc_feature (706)..(706): n is a, c, g, or t
  misc_feature (715)..(715): n is a, c, g, or t
  misc_feature (730)..(730): n is a, c, g, or t
  misc_feature (744)..(746): n is a, c, g, or t
  misc_feature (755)..(755): n is a, c, g, or t
ttgggtgaatgtgtaatgatattttctgtacttttggtatcaactcagaactttccagaagaggctcgtccctggcctgatacgatggtccaaaggattcaatcctccggggaaatgggaagacggtgaagcgccctggttagcttatgggctgcccaantccatccaacccttggcattgggatcaatgttgatgaggacaagaccttcaacagtgtccgggtggttaagagcatatctcgccaggatgtaggctccagctccaacaccaactccaattattgtagagaaatttaggtactgcaggacgcaagggatcatgtctgcaagctggtccagagatgggtactgatatcccaaagggaacacaggggctccctttgggatatcagtacccatcatgtctgcaagctggtccagagatgggtactgatatcccaaagggaacacaggggctccctcttccattccaggggcatccacatgaacccgcacaaagttctgaatgatttcctgcatgtcctcgaactgaaacagtggctggaagcaagatttatagttgagtcccacatcgtggtaggtaaggatcgctgggcgtttgggtttgggggtgccatagacagtgaaagtgacagagcngtatggtgtctccacagagtgagtcttgnccgcctcaggcgtctgtcctggcaacagtggnntctcntctgtgatntgcacctcctgcagntccgccatggtggnnntgctgccgncagcggccgcttccaccttcacttgcctgttccgct

SEQ ID NO: 669620 - DNA, 122 bp, Homo sapiens
gcccaaacccactccaccttaccaccagacaaccttaggccaaaccatttacccaaataaaggtataggcggatagaaattgaaaccttgcgggaataaatattgggacccgcaaggggaaa

SEQ ID NO: 669621 - DNA, 522 bp, Homo sapiens
  misc_feature (492)..(492): n is a, c, g, or t
  misc_feature (500)..(500): n is a, c, g, or t
  misc_feature (505)..(505): n is a, c, g, or t
ctcagtaattgtagacttttattattctctgttaattttagagagtcttatgagtttctgcaaaaaacaaatctggaatttgtattagaattgcgcattgagttttcaaggttgggagaagtgagagggattttggcatgaagattctagaagacagaagagaaagaagcccatgggtttgcttcagatttctttctccaacgtcatcccacccaatgaagttcattcactcaacaaatatgttcattcattcaacaaatacagagcatcagctgtatactaggtagttattcctaggtgggaagagacagatcataaacaaatacaaaaagttagaaaaagtcaggctggtattgaacccctgacctcaagtgatctgccctcctcggcctcccaaagtgcttggattataggtgtgagccaccgggcccgccctagcccaggaatttgaggcagcagggagctatgatcatgccactgcactccatcctnggagacanagtgngccctaactctaataaa

SEQ ID NO: 669622 - DNA, 123 bp, Homo sapiens
tgggcgtaacactctttatagatgaagttgaagcccagagaagaatttgcctttgccgaagatcacagagcgtagtaaagcagagctggggctaacaagcatgtatctccctgcactctctac

SEQ ID NO: 669623 - DNA, 537 bp, Homo sapiens
  misc_feature (507)..(507): n is a, c, g, or t
  misc_feature (515)..(515): n is a, c, g, or t
  misc_feature (520)..(520): n is a, c, g, or t
ctcagtaattgtagacttttattattctctgttaattttagagagtcttatgagtttctgcaaaaaacaaatctggaatttgtattagaattgcgcattgagttttcaaggttgggagaagtgagagggattttggcatgaagattctagaagacagaagagaaagaagcccatgggtttgcttcagatttctttctccaacgtcatcccacccaatgaagttcattcactcaacaaatatgttcattcattcaacaaatacagagcatcagctgtatactaggtagttattcctaggtgggaagagacagatcataaacaaatacaaaaagttagaaaaagtcagacactaactgctgtgtagaaaatgaactgataggcctggtgcagtggctcacgcctgtaatcccaaagtgcttggattataggtgtgagccaccgggcccgccctagcccaggaatttgaggcagcagggagctatgatcatgccactgcactccatcctnggagacanagtgngccctaactctaataaa

SEQ ID NO: 669624 - DNA, 547 bp, Homo sapiens
  misc_feature (465)..(465): n is a, c, g, or t
  misc_feature (547)..(547): n is a, c, g, or t
ttcggtgcccacccacagatatgaccttatttattcatatttaataagcacctgttatttgttaagctaatacttgcactgaaaggtataacgaataaaaaaatgaggtttgcttcgaaaggtataaaactagcctaccatgtgaccatggacacggtaattctgtctttgctaatttttcaattgaaaaataaagggaggaccgggcacggtggcccacaactataatcacagcactttgggaagccaaggcgggtggatcatttgaggtcaggagttcgagaccagcctggccaacatggtgaaaccctgtcactattaaaaatacaaaaatcagccaggcatggtggtgcatgtctgtaatcccagctactcaggaggctaaggcaggaaaattgcttgaacccggaaggcagaggtggaggctgcagtgagcccagattgcaccactgcactccagcctgngtgacagagactctgttctatgaaaaaaaaaagaggattccacttgtttgctaaatctgaccaaatctcacagtaaaattan

SEQ ID NO: 669625 - DNA, 260 bp, Homo sapiens
tttttttggggggggggtgcggggggggggggggtattgtgttagttttgtgtctcggtcttgtaaaacctttgtgattgtaccgaaatggtatctgcagtcgcctttggaaagaaaggggcagtaatttgtgtacttagcattctgaattttagtcccaggtgtttctttttttgaagatccttgaatgaaagggaacccccaccatggggcttcctgttataatgttcctccatttactgttattaaaagatttatga

SEQ ID NO: 669626 - DNA, 938 bp, Homo sapiens
ggaggccggagcaggaacaggttgaacagtctaccctcccttagcagggaactactcccagcctggagcctccgtagacctaaccatcttctccttacactagcaggtgtctccctctatcttaggggccgatccgaattttcatcgacgagacagattgatcgaatatagaaaccccgctgcctagtagccaataccgaaaggcccctcttccgtcttgatccggcctaatcacagcagtcgctacgttcgtccgtatctctccccaagtccatagctggcttggcatcagttatactactaacaggaccggaaactcaagaccgacctttctttgcgacccctgccgtgagggggagcacccattctatacgcaacacctatctgattaattcggtcaccctgaagattaatattctgatgctaccaggcttcggaataatctcccatatgtaacttactagtccgggaaaaaggaaccatttggatacagtaggtatggtctgagcgaatgatatcaagtgcgatcctagggtaatcgtggtgagcacaccattatattagcagtaggaatagacgtgagacacggagcatatttcagcttcgtagcataatcgatcgtatcccccacggcgtcaagtataggctgatcgccacgctccacggaacgcattttgaaatgttctgtggagtgtctgagcctagattcatgtttcttttccccggacaggtgggccgatcggcttgttaaggcaactccttgctggaattggcacacagcacggactagagggtagccttccctatggcccacaaaagaactgtgttggcccacaagggggcacaccgggtccattcgtgggacctacaaactccacaaatacaaagaaatacggagaaacttcccaaattgtacagaggcgtataaccgaaaaata

SEQ ID NO: 669627 - DNA, 736 bp, Homo sapiens
agtaccttcctgttatgacacagggattgagcgaatcccagacagctcggtactgttactgagtgaaggtgcagtgctgcgtatctgtgtacctggataatgatgagcaggcagccagtgccatctctgagctggtcagcacagctgcggtttccggctgcaccgcggatgaatgtgcccttcaagcgcctgtctgtggtctttggagaacacacagctgctggtgacagtgtcaggacagagtggtgtcacagtggtgaagatggcagaaacagaggtctgggagcccatatgatgtctgagcctgctcgtgatggggcgagggtcgggagtaacgcggattgggtccatgggccatcatgtgaatgagtgcaggcaacaagcatgatcgagacatatggcatatgcatgatagaaacatagtgggccttcctgtcatctgacccaatgccatcaccccacccccatacccctggcaccgggtgccccaagggcattggagcggaacttcatggaggcctggatggataaaagggaagacaagaagggtcgcaacaggaaggaaccgtgcccgtataggtggctacccactaaatatcgcacgtcaattaaagccatgaagatcctggagttggatacgtaacagggatagggacaaaaaaaagataaacgaaatgaagaatataataggaaagaaataattgaaaatggtatagagaaataggagaaaaatagg

SEQ ID NO: 669628 - DNA, 516 bp, Homo sapiens
cagacaagagatgtcagaggctctgaagtcacgggggggggtggtgaagggtcacagtccctgagggtgggtgcggcgggtttttagtgcttaggagtgggccatgttaaatttcccacaccacaagtaactcttttccagaagccagtggcattcctgtctctgtgggaagtccgggtctgaatgtggaccctctctccccgacctctatactcgggctgtcttcttccggtcgggggagatctggcagccaccacctggtggccggggtctgtgagagcaaagctgagttcgggtccggctggtagcagaagaaggaattggacaccatctataaggcccaggtgggctgtggcagggccggtgggttgagctgcgcctgcgggctgtgggcagctaatcctttcctggcggtgctctctcccctgttttgtggtgagaaccaggagaaggaaagtccgagatcctcaagggcccggcccagcagtgcatggcccagcagcacattgtgactgg

SEQ ID NO: 669629 - DNA, 223 bp, Homo sapiens
gggagggcagaggcttaagtggaacaggagagggaaggtttttggattttttttggttttttttgaggaaaagtttggccttggtggctataggtttgcattgcagtggttgactctcggtgctcacttggcacttggtcgactataggcgcaaaagagagcggacaagagatctcctcttacaaaaaaaaacaaaaaacaaatatcaaaaacaaatacaaca

SEQ ID NO: 669630 - DNA, 1042 bp, Homo sapiens
  misc_feature (968)..(968): n is a, c, g, or t
ggtcactgtcgccttcagagcaggtgaactcggaacacaaaggcgcttcggctaagactggtggaagctatcaggaccaatgtacaatgacggataggatgagatccggcgtgactggggtggcaatgtccgtgggtcctaggtctgtggatcgtatcgccgagctcgacatggctgaggctgagaggcaacttgtgcgagctagacacctggggttatcagtagtagcgacttgtgagcagcttctatgctgtacattaaacattccatcgaacatgaagtgacacaatagttctcttcagagaagcatgatgtactcacggaccgcaaggcagcattggaatgtcagggtcccgaaggacaatccgcgatgggcttaattggggcggctccgggtcggagtaggaaacgatgagccgcacagtgggtactcatgaggctgccagagggggccacaagcaacggttactggtgtgcccgccggattgaggggacggccactactactcagcagcagaatgcctgggaaaaacgcgagaagtaaagcaaagttacgagagaaatagacgagaggacaaggggcaggacaaagcatccacagcagacgagcatactgacacaattcagaaggaaggaacgaagtcacgaaagccacaacaatccaaaaaaaacaagaacttaacccccgtcgcggcatcagggacgggagccagggatacccggagggcaaaggaaaagggaaaagacacggagaaaacacacgccacagcctcgagggactattgaacaaaccaaagagcagcagcacgtaagagaaacaaagaacacaaccagacagcagaaacacgaacacaaggcgcataaggcaacaggaaccaaaactgaaccgaacccacagtcaggaacagaaaagaggccagacgacgagcggcagggcacagccgaaacacaggaaaaagaaaggccanctcgacaccaccacaaactaaacagaaacgaaccaccaataaaaagagagaaccataacaaccgcgagcagcag

SEQ ID NO: 669631 - DNA, 905 bp, Homo sapiens
  misc_feature (9)..(9): n is a, c, g, or t
  misc_feature (766)..(766): n is a, c, g, or t
  misc_feature (776)..(776): n is a, c, g, or t
agcgggcgngcgcccccgccgcccgcgccgcagtccgcatccacccggcgcggtcagccccggctgcggctccagctccgcgctccgctcttctctcccgagccggatcgcgggagcgagcaggggaggggaccgcagccggcgcccgagggcaggaggagtccgcaggcgggcccctggctgcggtagcagctgccggtggcagggaggtgccagcccgcgcggggtggcccagccgcgggagcggtggggcgggggccgcggccgccggccccagggagagatcgcgggcagcatggcggggctgcgggccaggggggcccggggccggggctgctggcgctctccgcgctcggcttctgcctcatgctgcaagtcagcgctaagaggccccccaagacgcccccctgcccgcccagctgctcttgcaccagggacaccgccttctgcgtggactcaaaggcggtgcccaggaacctgccctcggaggtcatctccctgaccctggtgaatgccgccttctcagagatccaggatggagcgttctcccacctcccgctgctgcagttcttgttactcaactccaacaagtttacactgattggagacaacgccttcacaggactgtcgcacctgcagtatctcttcattgagaacaatgacatctgggcactatccaagttcaccttccgaggactcaagtccttgactcacctctcgctggccaacaataacctgcagacactgcccagagacatcttccggnccctggacantcctgaatgacttggaccttgcggggcaactcactcaactgtgactgccaggtgaagtggtagggaggagtggatggacaaaacaccaacaaccacggtgggacccatttaactggcccagcccggccg

SEQ ID NO: 669632 - DNA, 951 bp, Homo sapiens
  misc_feature (9)..(9): n is a, c, g, or t
  misc_feature (812)..(812): n is a, c, g, or t
  misc_feature (822)..(822): n is a, c, g, or t
agcgggcgngcgcccccgccgcccgcgccgcagtccgcatccacccggcgcggtcagccccggctgcggctccagctccgcgctccgctcttctctcccgagccggatcgcgggagcgagcaggggaggggaccgcagccggcgcccgagggcaggaggagtccgcaggcgggcccctggctgcggtagcagctgccggtggcagggaggtgccagcccgcgcggggtggcccagccgcgggagcggtggggcgggggccgcggccgccggccccagggagagatcgcgggcagcatggcggggctgcgggccaggggggcccggggccggggctgctggcgctctccgcgctcggcttctgcctcatgctgcaagtcagcgctaagaggccccccaagacgcccccctgcccgcccagctgctcttgcaccagggacaccgccttctgcgtggactcaaaggcggtgcccaggaacctgccctcggaggtcatctccctcacagcccttgcagaccccacagtactgactcgggtgtccccgcaggaccctggtgaatgccgccttctcagagatccaggatggagcgttctcccacctcccgctgctgcagttcttgttactcaactccaacaagtttacactgattggagacaacgccttcacaggactgtcgcacctgcagtatctcttcattgagaacaatgacatctgggcactatccaagttcaccttccgaggactcaagtccttgactcacctctcgctggccaacaataacctgcagacactgcccagagacatcttccggnccctggacantcctgaatgacttggaccttgcggggcaactcactcaactgtgactgccaggtgaagtggtagggaggagtggatggacaaaacaccaacaaccacggtgggacccatttaactggcccagcccggccg

SEQ ID NO: 669633 - DNA, 441 bp, Homo sapiens
  misc_feature (58)..(58): n is a, c, g, or t
  misc_feature (408)..(408): n is a, c, g, or t
  misc_feature (413)..(413): n is a, c, g, or t
ccccaaataagttaccatatccatatgtaaattaccctacattcaaataattaattgnacataaacaagggtaatggtgcccgtccttgtttggggaagtttgaacattgaagcgaaagatgccttccctggatgggtgcggtggcctcacgtctgtaatccctatcatttcgggaagctgaggtaggtggatcacttgaggtcaggagtgcgagaccagccctggccaatatgacgaaacctcgtctctactaaaaatacaaaaccccatctccactaaaaatacaaaaatgagacgggaatggtggcacattcctatagttccagctatttgggtggctgaggcatgaaaattgcttgaacctgggaggcggagattacagtgagccaagatcacactgctgcacntccanctgtgctacaggctgagaccctgtctca

SEQ ID NO: 669634 - DNA, 111 bp, Homo sapiens
  misc_feature (50)..(50): n is a, c, g, or t
  misc_feature (104)..(104): n is a, c, g, or t
caatatattttgcattggaatctccagtaatgaatattaaaatatatgtncaatcatttgtagatgatatcaattatattaagacatttcagatgggctattgnagtattt

SEQ ID NO: 669635 - DNA, 414 bp, Homo sapiens
agtacataagatctctgggcatatctatacatatctgcaacttaataccctattgacctataatctccctataaatccccccaaacctgtaatcaccatttaattatgtatctatgtatttggcttaaaaaaaaaaaccccacatataagataatgccaggtgtctatctatgtccacctaatttccttggcataaatgtcttccagatacatccatgccaaaagtggtaggatctccctataaaaggcaggataacatccacttgtgtgaataaccctccatttcttaattaatacctctgtagatgggacaccttgggtagtcttctgaatctaagctatagtgaataaaagcagcaagagtaaaagcaacgtgccacataacaagggagtcatcattagacgaatcagctt

SEQ ID NO: 669636 - DNA, 966 bp, Homo sapiens
gggtgggtagtgcggcgctctgtcgatggtggtgtggttccttcactagttgggggggcggtagtgttttttattcgttgatggatcgatgttgttgtggttgtggtgtgtgcgcgtcgtgaggcgcgttggtgttgtgtgcggttcgtatgggcggccatggttttgtgtgtcggttggcgctcgtcaggtgtgatcgtcgagcttgtgtggtggcgcgaccggccccgtgttttgtttttctgctcaaacgacgccgcactcgtgtgagtgtatgttgcctcttgggggcgcctcttgttgtgttttgtggggttgtgtgcgtcacccgcgacgggggcggtggttttaagagctcgctcctgctggtgagtttatgtttgttggcgttggtgcagcgcatcgtcgctctccctttggtgtagtagggcaggcccgcagctcgcgctcgcggttggtcgctgcagctagagatacttgctctgtttacacagcgagagtgtactcagcctcggttgtctgtgtccgccctctgcttataggatgtctttctttgtgttggatgttgttttggtcgcgagcctcgcgctcggtagatactagtgactcttattacccacccacttgtttagaccactcctcggtgaggaagactatcttcttttgtgttatgatgagaccaccactttgttgctcgttgtactacagaaataccatccttgccgttgctctctgctacgcaggcggcttcactaattctgtttttctgcccactactctataattactcactcttactaatattagttctgcacccacaccatccgtggggcccccaccacccacccacgacccttccaaaacaccctcttttccccgggaacaaccccctttttttaacacccttttccccctttttttttttttccccccccccccccctttttcccgggttttcttttttta

SEQ ID NO: 669637 - DNA, 90 bp, Homo sapiens
tctagacggatccccggtcacatggtggcgggccctcggcgtcttccttattaacctgaatcctcattaaaggtttctttacccacccgg

SEQ ID NO: 669638 - DNA, 170 bp, Homo sapiens
ccagtgggtacactcacttaatcaggaggctgaggtagagtgagcatcgcaccactgcactccagcctgggtgacagagcaagactctgtctcaaaaaaaacaaacaccaacacaaaaaaatttgggcctcgggcattaacggccttccggaaacattaatttttctctt

SEQ ID NO: 669639 - DNA, 108 bp, Homo sapiens
tcttcgcttctgccctcaagatcatagacctttttaacttgttcagttgcactgttgcaactgggcctccaggttcttggtgaggcaggtcttggatgaaggggtacc

SEQ ID NO: 669640 - DNA, 157 bp, Homo sapiens
gctaccccgctgccccctccacagttccctgaatcctgctaaggatctgcagcacgttggcaacgcagctgcgggctgcggggcggcctccatgtccactgagatcataggacactccaatggggatgggacctttcccctcctctatcagaggtgc

SEQ ID NO: 669641 - DNA, 241 bp, Homo sapiens
ctgtgtgcgttaaattcataatagtataccgcccgccaaaatatatatattctcaatacctcctttggcggatacatataaccctgaagttttctgcagaggaacctctgtcataacccacaatttttccacaccaccccctccttcaattcggactcccccttaacccaatttgtccatgcctccaccccacatatagaagtcacataaatgccactctactcactctccgtccacatga

SEQ ID NO: 669642 - DNA, 198 bp, Homo sapiens
  misc_feature (35)..(35): n is a, c, g, or t
gatgtgagcacaatcaaatgtccctaccctggtgnaaccacattctagcagggaaacgtgaggataataaacactaactacagtaaggtagatggtacagtatatgggtaagtgataactcgatggaaaaagcagaggggacaggcagggaggatgggaggcgcaggtgagggtaactattgagaaggaaggtcaggg

SEQ ID NO: 669643 - DNA, 267 bp, Homo sapiens
ctcccgggttcacgccattctcccgcctcagcctcctgagtagctgggactacaggtgtccgccaccacgcccggctaattttttttttgtatttttagtagagacggggcttcaccgcgttagccaggatggtctcgatctcctaacctcgcgatccgcccgcctcggcctcccaaagtgctgggattacaggcgtgagccactgtgcctggcctatttctgtctttgttttttcttttcaaatgcttgggtactacgctttggca

SEQ ID NO: 669644 - DNA, 1179 bp, Homo sapiens
ggcgcgagcggacgcggagtgcctcatgtctcgcttgtttcttatattaatcgcccaccgctttcacctttcttatgttctatctattgcgttctcattgtctctctcaccataccctccaatgacaccgatgggacatgcgtgagaggagtctgcacgggggccaagggagagcgaggcagggtgctagagcggaggaaagagcagaccaaagcctccccgcagagctcccaagacgctcagcagctacttcaggccccggaagccagcagtcaaaagagaagtgaaggacgaggagccaggggctccaggaaaggagggagactgctgagggaccctggatccaatctggattacaatcctgcgcaagaacaacatatcatccccgatggaagatgcctgctggagaagcgggagccagcaaacggttcccattacacatggaccatgtgggcacggaaggataacgcacaaagcatagcaggaagcgtgacaagacaacgggactcccggacaagagcagggaagcaccgacctgaccgcacacccaagccaagacggccacacgggacgacgggacacacatgcacagacaacagcaagaaaaccattcaagaaaacacaaggagcagagcgtaaaccactgaaagcacaatcaaacaacacagaaccatatggaggaccaagaccacccaaaagaccagtggggacacacgcgaacgacatctagacaaagtgagagaggaaacggaagaagcacaacacccaaaggcggacaggaagggaccgcacacaggggaacaaaagaagaacacagaggaaaagcacaggggagagactacacgagaacccgagagaccaaaagacagagcgcaaacacacacggcaggaacacaacgggcacagccaccagacaagacgcaggcgacatcggaacaggagcaaccgaagaaaaacaacaacgagaacagaaacaaaacaaagacacaacacaaaaggacatcaaaagacactcgaccaagagaccagcatgaacggaaaacaccacatgaaacatacgcgagagaacaaaaaacaagcaaaagaatccagagcgcacaaagacagcacatcaggccaaccagaagacgaaagaggcaaaaagccacaaaagccacaacacaaacagacagaacaact

SEQ ID NO: 669645 - DNA, 376 bp, Homo sapiens
attcatttctactccataggcttcttaatgtttagtttgtgaagtacagaaaaaatttaatatgcctggaaaatcacaactaaatgacagatgtatgcccaaattatgattataatcttcaacattaagtacagttttggaagtcctgtaggaaaatgctattgcctattgagaattggtcaaattgtcaatttaactccactgtcctagtaatacacaagtaatttaccaaataaagaattttaaatcctttccagactcattatacaacattaaacactaccaataaaagttgttttcatatacatcttttctattctaaaatgtgaagtctaaatggtatctgtatttccaattattaaataattttaaagaa

SEQ ID NO: 669646 - DNA, 247 bp, Homo sapiens
taaaaaaaacggggtcagctgggtgcggtggctcacgcctatactcccaacttttggggaacccaaggtaggcagatcatttgaggtcaggatttctaaaccagcttggggatcaaacatttccttggggtagttggtgccaagctcgtcaatggcacaaaactggatcagcttctcgtagatgctagggtttccgaaattctttcttccttgggataatgtatttcatatccattcagcctcgtgt

SEQ ID NO: 669647 - DNA, 927 bp, Homo sapiens
  misc_feature (449)..(449): n is a, c, g, or t
gtagaaccctccaagcagacgcaatggtaagttgatggtgtctgtgtgctgctgtctctgcatgctgattcatgggtcctgttgtcccccaggtgaaccacgatgtgtgcgtaacttctctggaccttatattctagatctgtgagttgttcctatacgccatgttgtgaagacgtctcaccgaggtttatactagagcctctgtggatcgaactcaattgcacctcactacgattcttttagaattacaatgtgtactcacttgtgaatgtcctcatgccaccatgtgcaagtcctgggcgcacagagtaggaggcgagattgggaagagtagtgggatggcatgggaatacgtaccaacatttcaggaatgcctcggggggaagtgacatcgtgtcaatggaggaagggcgtggaatgatcatagtggacgttatctcacactgtantatgataaccggtgttcttcatcgttactttgcaagggtaattgggtttgagatcgagtagttgcactcggtagcaaataaagagattgctaggagaagcattctatggagaatttctcaactttttgaatgtaacggcccttaaatttgattccagtgtatatagacacaattactagacctggggttcgcctttacggtcactatggcatgcctacgattaattccaccgtttcactttgcggcgtcgtgctgacacaggggttattgtggccgggggtgccgaaggtattaccgtgggggagggggtgctcaaggaggaattcttggggtgattgcctcgtaatggaggaaagaattatcctggaccggatgggtacaccgctgggtaaatggttcccctggttttggactcgggtttggaaagcccagcttcgggtccaggtaaaggagctgttagtgaacggtcgagaggcgg

SEQ ID NO: 669648 - DNA, 287 bp, Homo sapiens
taacccaataagcatttaacaaagaagatatgttagagagtcatagtgcactgaagaaaagacatcaggtttgtgaaaaagagagacatggattcacctactttagattcatatgttaggagagctccacactgacgaaagtgacattcacgctgagacaacaacaataagtagacagtcgtgacagatctacagggcatgcaaagttcctagggcagcactgcacatcgggggcaaagcccatgcatcgtgttcaacattcatcgtggcagcggcagcagcaaagc

SEQ ID NO: 669649 - DNA, 128 bp, Homo sapiens
gagagcatacaactacttgagggcttgttaaaccagtgcgttaaagtcggatgcggtggctcacacctgtaatcccagcactttgggaggcccaggcaggcggatgcacttgaggttaggagttcaag

SEQ ID NO: 669650 - DNA, 1018 bp, Homo sapiens
tgtcatacgacaagtctctgatctaggctcgagccgggcaaagtatgtgctcatgcaatgatgggctcactcaggtggttctctctcatcgagcacttgatgcgtcgaatggatgtagtgggttgctgttctccactcaatcactagtacatcgcgcatgggtggcgaacgcggaagcggtatgttgcgagacgaaagtcatatccatagagcctctcgtggagcgtacgctttggcttgggccatctactgctagagctatggaggtacctactaggcgaggccgtgctggtttactcgagtagtctaaccgccactacggttggcgtgccgttcacgagggctgacacacactagctcatacaggagaaacaaagcaagccgtggatctttgcgcttggggtcgggcatcaagcccctggtatatcatctctgaagcgaacagcaaggcgcagggttattttccagggtttccagcccgaccaacgcctttccccagtaacactcagcttcgtaccgcactacgtgagacacttcactgaaagtaaaatcgaattatccctacaagagaccaagggatgactggatcttccaaagacacacggaaccatcacttgcctggcatcccggacctattgatacaagaggcccttagccccgaacagccttcaaccgggcacttgcctggctgacaaggggctcattgggaccccatggcacacaaagccccaagcaagcacgcaagataccatgcggggaaacccacaccttggcaatacccgccccttcagggccatggcaggcaaggtaatttgaaaaggtcctataaagcgaacggtatacttgaaagcacccaaaaagcacacctattccaagatggtagtgcgaaccctatcacaagtggataatatacccacactgcaccgtcgctgtttgcggcaaggatttaaccccttccacacaagcgctgaccacgggcaacaaagtgcttggagctagctatggcccgtagcaaaag

SEQ ID NO: 669651 - DNA, 871 bp, Homo sapiens
atcgcagtggcattcctaagtgcttaccgaacgaaaaattctaggctatatacaactacgcaaaggccccaacgtcgtaggcccctacggggctactagcaacccttcgctgacgccagtagaaactcttcaccaaggagccccgtaaaacccggcacgaagtctaccatcaccgctctatcatctactcgctccccgaccgttagctctcactcatcgctcgttcgtacgtatgaagccgcccctcgtccgcgcatacgggcaacaccactctgagtcgaagtcgtcaagacgtagggccgtcctgattgtagtgtctatgccgaggccatgctacgcctcaggccgctgactggcaatgccttctggatgcagggtggtacgtcatgcaaatctcaaatctatcgcctcctgtatacgcgacgacaacgtgaccgagccaggtcacggcccaatagcaaattctacatgatcgaacgctcaacgcctaaggccgaggcagtttgctgactaattcacatctactataacgtaaacttacacgttgggctccacctttagacccatctgccacctcgcttgagtcacaaacgacacagaaacatcgcgtctgacttaacgtgcgtagcgcagttccacttggatccccgtatgggccccattacatagtgacttgaatcctgccgaccgcgtaaggcaggaggcacccgagtcgcggacagaccccgctttccgtagcccttggccgaagaggcggggttcccgtagacgtaagtcctcagggcgtggtcacacagtgcgacagtaccggccgcaaggtccccttgcgcccttattgctttcaataggcgaagtataccagaccttattg

SEQ ID NO: 669652 - DNA, 957 bp, Homo sapiens
  misc_feature (106)..(106): n is a, c, g, or t
  misc_feature (129)..(129): n is a, c, g, or t
  misc_feature (243)..(243): n is a, c, g, or t
  misc_feature (505)..(505): n is a, c, g, or t
  misc_feature (661)..(661): n is a, c, g, or t
ggtccggccggcagagctccaccgctgaggccgacgaggccaggcgtttatttcaacttcattaaaagcaaatcaaatgtagactggggggtataaattaatctancaagatattacaatgactactanattaaaagtgtttgtcaaacagcctgggtatgaaataggacttctatattgaattaacatatttaggcgatgtagtagcttttttaggccatttagtgggggggggtacattanagccatatctgaataaatgtgtccaacagtgggctgaaagtactgatctaccactcagttatacattttaaactagggacttcctcccccttgtgaggggggctaaatttttattaggtgaattctaaggtattaaacatattttaattatattcatccccaagctgggttgattcagaaacacattttatggaataatacattttacacaataaaatttaatttattaaagaaactcattttatgagtataattaactcanaaagggtcttaaagcttttatctccaaaattaaaaaaaaatattgggtaaacagaggtcttctgggctggggctcatgggatagggggtccctctcatccattgagagacgttttgttttaattggagggggtctatgaagggggccactggctcngggagatgggtgtttgggtctttgggggaggtgcttattgcctgaggtgtgggcgaggataatgatggataaagggggggagagaacagattcccactttagctttctgtgttagaaaggagctgggtgaggcctggggaagtggaaggccgtggggcaggggtagaaggcggggggaagttggatggtgttagagacgattggggtggaccgtgctgctttggtgagaggaaggtgcggtgaggtggagggaggcttgggtgggttgggggggagttgaaatttcgaagggggcg

SEQ ID NO: 669653 - DNA, 1140 bp, Homo sapiens
  misc_feature (263)..(263): n is a, c, g, or t
ctcgcatcatggagtatcaatcagccgtgagtctgcaccaagtagtctaattagaaaactaccgaataccaaagtaattcaagcactgcttagtacaatgttcactgggtctctattgttaccctcctacaaggcctcagagtacttgcgagtctccctatcagcattttccgacgggctatgctacggctcaatcatttgcttgtaagccacaggctgtccacgggacttcacgtcaattatcagggcatcagacttatccntacacgtattctggcgtgtcagtgccgccgaagcgtaagtattgtcacatgttagcagtccaagacgatcgacgtttgggctgtgcgaagccggccgccttggatacgtgggcacttgttgtagactgtggtgttgacctactttctgtagtgtctccagtctacttgagtgatgggctcttaagagtaaatatcataataaataagagaataacaaaagtgagaaagataacaaaacgaagtggtggggcgggggacgcaatatgaaatattgccctcacggtaggagggccgccacgaagtgggccgccacgcaggaaccccacatacctatgctttgcgggcaggaacgagggagacgcgcgcactaataagcgtgagaggactcgatagataacaaggcagaaaggagaagggcggggccgggggcctcacaaacagcacgatggcgaagacgaatgtggtgaagaagaacgcttggagacctcggcgagaccacccctggggggagaacgaggacccttggaatagcccaaggacggggagaacgccagactgctttcgaggcgccatagtgactcccacagaaaggaaatacttataaacgtcccgataagggggtcgaagaaaaacaacacaagaaggcagcgaatcaaaaggtggggctaaccagacatacgctgatcgaaataaactccaggggcacatatgaacaaggtacaacgcgcacaagcgagaatagagagcaaaagaccaagggatattaccagaggagagccacgctatatagaaaacagcgaatcacaaacaagacaacccgacaaaaagatcaaacacacacacacggaaaaacgtggaagcaacaacaggagcacag

SEQ ID NO: 669654 - DNA, 591 bp, Homo sapiens
gatctgttttaagttctttgagaaatcttcaaactgctttccacagtggctcaactaatttacattaccagtgtctaagcattctttttctctgcagcttcaccagcatgttgtttttagactttaattacagccattctgactggtgtgaaatggcatcttattgtgagatggttttgatttaaattttcctgatgattagtaacgtggaactttatatatatttgttggccgcttatatatcaagacagggttttggaactgaaatgcatatttgaggattataagcatacagagaataattgacaccagggaagggaattaattctcccaaggaaaacgcattgagttacatgaaaaggggtctaggattgaacactgcactgagaaacaacaacatctagatgatggataggggaggaagaaagaattcagtaaggagaatgaagtttctcctgaaatgaaggaagaaaaccaggatagtgccatgcaaaggaggtgtttcaaagaggaggaagagattaacagtgccaaatgcgactgagatgtcaaagaagttgaaagaaataaggatatcctgggtagccttgg

SEQ ID NO: 669655 - DNA, 1172 bp, Homo sapiens
ggacgactgcagcctgagccgcgtccaagtcgtgagttccttccggatttctccggtcaaccggatgtctgccagtctgccgcaggtatcgcagggcggttgttagatcctagtgccccacgatggtgtccagtgacaacgccctttcagcgcgtgtccctgcttgctaccgtcacgaattgcggttcctcgcgtggtctgctggcagcatggagtggcggtcctaaaggccggtgcttgctgggctctgtgtagcgtcgtgccattgcgccacagaagtgtctcgtcaagagcctcgttccagaggccccagaaacgtcgaccttcgtcccaggcgcagtctcgcaggacgtgactcggaagtagccgtggaaccgaagggtaggacagtcacctcgccagcgcgtgctgcgctcctagccattctcgagtgactctcgcgacaatatcggcctcgaaccgcccggttctgggaagcgggcaaaggacggcttctaaggcgggggcttccgttccctttcgaggcttcgcagcaatggcttccaggatcgacgagtttacccgcagaggcccccaaggagccccgagggtttccaacgcgacctgccgttgagtcccaaaacgctccctagattgagtcgcgccggtcctgggcgcatctgcgaaacacgagaggaatcgggaacgcgcctgaaagggctcaatcgtggagagtgcgaagttggttctcttggatcccaagattggaaccggccgagacaagttgagacccgtatgggcacaacacaggaaattagattgcggggcttacaccccgagacgtttaagactttgcgccgacgggaagggaccagacagggcattggggccctctgcaaacatccacagatgtgagccccaaaaactggtggctgcgaggaccacctttcacccacaggtaaagcccccccggatgacggtcattattcacattgaccggatccccggccgatggccgaaagtgtccaaggacccatcgtccgttaatatagttcccatttatggagggcggcaacaggaaaaggcccccaaggtggtttcaacagggcggattgattagcggggatccaagaaagaccccgcgcgtgtgaccagacaagagtgaaggcaaggccttggggattggcacacaa

SEQ ID NO: 669656 - DNA, 646 bp, Homo sapiens
  misc_feature (607)..(607): n is a, c, g, or t
aaacattgcaccccgtgtaaatatgtacaagtgcatcactggtacaattttatgtgactcagatggacactctgttggcacagacctatggtaggtgtccttaacaaattaaggtgacaaagcacatggcactgtgtatagcctggttatcggacggactcctggcttggcaggcagtgctgtgcgctgttaatggagaagacctgggcttagcaagatccttagatcttgctacacaggatgggggctggcacttaagcttcacactgggttgcacttagacactgagggttgggtttagcaagcagggggaaggcgaactgctctccagctcttactgtcaggcgggtacatgggaacagggatacatatgtgcttgagaagcaccttacacgtttcatagggaagaggtacacattggccatttaggggaattgggcaagagaactaagggcaacaactcttggaggaagctgtctatctgaactttcaaatgatttcgatttgcttaagggcgaagagcattttcgttttcctcagcagggaagatggggagttacctatcccggggcgccattgtgtttccaccgcaattgggcctcttgtntaacgatggcttgcttagaaccggttttttattatccat

SEQ ID NO: 669657 - DNA, 919 bp, Homo sapiens
ggcggagtgtggaattcttctcgggaggcagtgtctgggtcctttccaccatggcacctaagaaagctagaaagaagagagccggtgggactgctcaactccaaacgtgttctccatgttcgaactaggagccctacacatccgagggaattctcaacggtagggcctttcacgttatcatggagccaagaaacagggatggcttgcagtatgtagcaagaaacgagtctgagagacatgcgttctgctgcccttggggcgagatgaacgtggaacatatatgacggaaattgatggagaaatgtatctagggcaggctccgggtccaattgaactttcactgtggttccgtcacagactgtgtggtgggatgcaaccccgttaacgcgaagcgggaagccttgaggaaagcattccctcaagcggcatttcacaaggtgtttggaccctgatagaggcgatacacggggttgttatgagaggggctgattgtaccgtgcgggaaaatgctgagcgcactgcaggcgggacaaaggttctcccagctggatggatggtttgaccatgagtgtgcgacgcccttccgctcccttggatcgtgactggcaatgcttggacttagcgaagaacctggtgcacatcattcatcccatggaggacggacgaaggactaggaggggggttcgctgcatggcccctgggtcgtctttgccgagtggtcccttgcccttcatcctctcatcccccgagtaccggtctgtccctaccctggtctgttaagcaatgtggctggccagtttttccacctgcattgtctgggagcgggggtatgggtactcggggcggcatctacaggtgggatgcgcccgaggcctgtcaggaagcagggggcggtaaaacaggggacaaccatcggtcg

SEQ ID NO: 669658 - DNA, 1359 bp, Homo sapiens
gatgaggccttcgatacgggataattctatttattagctcagaagttgtttttcttcgcaggattttactgagtcctttgtaccactccagcgctagtcccctacccgcccgattatcaaggaggggactggacccgccggagaggcgatcagcaccggtttaaatgccctagaaagtgcacgattcctaggggcacgatccgctcatgttactcggcgatgtaggcaggtgatcgaatcgagcatgagcgtctagcgattagctcgttaatgaggaatacacagaccgtacaatcaagcactcacattcaacatgccaactgcctcgattttacaattgtttctagcttgaggtcatcctaatgttttaccgactcacgtcaccgaaagccgatcaagaagtacgttgcggcagtctctcgcgttcaagccgaatgtttcccagcaccggaagtcgtaagcgagcgggtcgaaacaatttgatcataggtatgccgcatgcatgggcttgtcccacgcgggatccctatccaccagttcattctttaactgtggggcatgcaaagacctttgtgcccgtgcccaccgttatcttctggccggtttgcaagtcccgggccacaacaaccgtagaggtaattttgcaccttgtgtaggcattttcaccaaagagccaatcgaacctttgtgggggccattttcctgaatattggctctgggcaccagggcccttggggaattacccgtcgggacacgagtattctctatcggtgacagaactgggtaaggggtagtaagggaaacttcaactgatctggcctcggtgcatcgttgcccttctcagttgacttagatagtcggaattggaaccggagggttccttttaacccacaaaggacatacaggaccaaaagatagaaccttggggagatacaaaagaccacttcggaacacacaacaggggaacttggcggctccggaaaggcaaaagcgactttggcacaagggggaattcgcccccataaacattaaggcggattgcggtgacaccaacggaggacagcactggggcattgggaacccaaagcgggtggcacatacggagcgcgcaaaacgacacaagttgtagttgggactttggcacttcccgaaaatggacagagacaagaagtatgtagtgccgcagtggcacccaacgagacagttgggggaccccaaaattgtgtgtacaccgggacctgtggtgcaacagcgagtaccaggatatggaaggggggcaccccattgagttggacagaggaaggaggcagccataagacactgaaaagcagaaacctagggatgagcaatatccacgcg

SEQ ID NO: 669659 - DNA, 108 bp, Homo sapiens
tagctactgtctacattccctaatatctggttactatgcactgtctagactttaaatatctgtctcctgaaagtgggaaaagagaataatgacgaagaaaataacagc

SEQ ID NO: 669660 - DNA, 131 bp, Homo sapiens
ttctctgatatctcgtcagcctgctacaaggaaatccatgtgtacacaatgcatgcatcgacagattagctccataccaaatggtagatataaaccaaatatctgagcagcaactagagctgatccttctg

SEQ ID NO: 669661 - DNA, 853 bp, Homo sapiens
  misc_feature (174)..(175): n is a, c, g, or t
  misc_feature (181)..(181): n is a, c, g, or t
  misc_feature (204)..(204): n is a, c, g, or t
  misc_feature (246)..(246): n is a, c, g, or t
  misc_feature (250)..(250): n is a, c, g, or t
  misc_feature (481)..(481): n is a, c, g, or t
  misc_feature (504)..(504): n is a, c, g, or t
  misc_feature (509)..(509): n is a, c, g, or t
  misc_feature (534)..(534): n is a, c, g, or t
  misc_feature (615)..(615): n is a, c, g, or t
  misc_feature (723)..(723): n is a, c, g, or t
  misc_feature (750)..(750): n is a, c, g, or t
ggagggctctatgacccaggtgtacgagaggctaggagaagctgcaggcagtggtggcgggggtgcccgggcatttggaggccgcagtgcatccccccttccccgcaggagaactcctacgtgtccagcactggcagagcccacagtgtgggctgctccatggtcagccctggnngcgccntcaggagccagtgcccaggcagnagagcagtgcatagaggccccaaccagcccgtgagagtgacntgangcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagtccgtggaaggactggcccttggcagctctgcatcatcgtcgtcagagcccaccgcaggattatcatcaaccctgcccgantagaagatggtccagaagctggncctgntacgacggatggggccctggacagnctgcagctgctgtcgtccagctccctcccaggcttgggcctggaacaggacaggcatggggcccgaagaaagtgatgaatntcagagctgatgtgttcacctgggcagatcccccaaatccggaagtcacagttctcatggtcagaagttctcatggtgcacgagtcctcagcactctgccggcagtgngggtgggggcccatgcccgcggggganagactggagtttggccctgctgttctaggctctgtgggcataggcaggccgagtggaaccttgctccatgccagcatctgggggcaacgaaggtggcatcatc

SEQ ID NO: 669662 - DNA, 1061 bp, Homo sapiens
gtggcttccggcgctcgtttgcttgtgtgacccctgtcctgcttgccggtgtgtcccgtcctatttctgccgtctgccgtgtggccgccgtggtgcgcctctgtccagctgtctgtgtggcgggccctcgaggaaagttctctcctgccggtctcggggagtgtcccggttgggcgtgatactccggatctgtcggccgtctgcgtcgcactaggttcggtctccgtctactgatttcattgggctgcctaggctctaccgtctggcccctccatgtagtttgcagtaggatggtgcgtaggctcggggggcataggtcgacctcccgtaccatgatgcggtcccttcccccaccggcctgcgggtattgtggctgactcgccaccactgcccgggaagccagatgtggtgattctcctgcagtgctctgagccgtgggagttcatgctgttctttgtcgccgtaggtggcctgggtggcattgtatgggcggagctcgtcacttgacactcgtactacgacgagcatcgtacgttacgtgtgtagctcacttccacgtatgtcctatcgtataggagctgtattcgccatcataggaggcttcattcacctgatttcccctattctcaggcttacaccgctagaccaaacgtacgccgcaaatccatttcacttatgcatattcagtcggcgtaaatgcgaactttcgttcccacaacactttgctcggcctatccggaatgccccgacgttactcggagtaccccgatgcatacaccacatgaaacatcctatcatctgtaggctcattcatttctctaacagcagtaatattaataattttcatgatttgagaagccttcgcttcgaagcgataagtcctaatagtagaagaaccctccataaacctggagtgactaatatggatgccccccaccctactacacattcgaagaacccgtatacatgtatgtagacatcaacggaagaatcgaccccccaattaacctcagccacccctgctccgctgcgctggggggggagtggggggagagtggggg

SEQ ID NO: 669663 - DNA, 580 bp, Homo sapiens
ccaatgactcagggactagtgtccaacttaccttatttctcatgctttgattggaccaaaagctagcttagagtagttgaattttcggggcagtcatctgtatgtctagagtaatttgggagcttgctaccttgcttaccttgggaggtttcagttgatcattgttttaacccatgaagctgttcccaggaatcattacagtgttccatgtatgttaaattcatggctgatcaatacctttatatttaccccatatttaatgaatgctttaacatggtgacatgtggaaatgcagaaatttcatgccaaggaaactagatgccctaaaataagatatttattcgaactgttaaaatactagaagaaataatagctaatgtcttttgagcgcttactaggtgctaggcactgttccaagcactttctagatactgctatattattacttcatcctcacaacaatcctatgaagtaggtgtgtagtatccattttacagaggaattgactgatagagcagagaggttaagtaacttgcccatgtgggtaggaattgttgcttgacttgctttaaattttggg

SEQ ID NO: 669664 - DNA, 142 bp, Homo sapiens
gttacgcccacaaggactgtgtttggagtggtgatgaaggactgatgtttggagtggtgagaaggactgtgtttggatgctggtgagaacggtactgtgtttagtgagtggtgatgaacggatctgctgcgaggtggatgtg

SEQ ID NO: 669665 - DNA, 344 bp, Homo sapiens
cacaaaaaataggcagatctcgccactgtgaattgttcattgtttctcacagactgtcgtcgccgctgttcttctaccataacattgcagtgcggcttcacaggccgtccacgtgacgcattaggtctggcctccgctgaacggatgctaggtcttagagaaggttccaggaaagaagaagtggattttacagttttggcggcgcggagccccaagtagtctgagcaactcgacagttttggcgtttcagcctggggaacgcttcgtctcagagtggccacagaaagaaaactatgggcaggcttctgttgataatggttccccagcatttttcggcagctgtg

SEQ ID NO: 669666 - DNA, 417 bp, Homo sapiens
cttttggggtctttgctactggagaatcacggacaccactgttaaatatgaccacttgagttcttcagagaataaaaatgtaggttctgtaaacattatttgcatctcatagttcacaagagatccacgtccaagtgaaggtttgtatttctagtaggttgccgcgagactaaagattccgcatctgtctgagggggcacctacctgcttagtaaatagatccctctcaacatgctgagacatactttctcttcccacttgtaattcactgtcccttaaaatgtttccccattaaaatgatgctggcagcctttgatgtgaactacagggtttataaaagtacagcctttcctcctctcaggaggtctgaaaacagccctgccatccatgcctcagcaaagaccccaaaaggggtac

SEQ ID NO: 669667 - DNA, 201 bp, Homo sapiens
cgcggactagttgtggagcgggcagaaatgtgggttgttggaattgagctcgggctgccgtgggaggttgtagatggctcaacaaaggctgatgtggtagataggaggtgcaggcctagtgtcctttgagcttggccagctatggaaatgtgcgtagattctccctgtacgggattgtagcagccggcaggggaacagatg

SEQ ID NO: 669668 - DNA, 688 bp, Homo sapiens
  misc_feature (38)..(38): n is a, c, g, or t
  misc_feature (59)..(59): n is a, c, g, or t
  misc_feature (82)..(82): n is a, c, g, or t
  misc_feature (91)..(91): n is a, c, g, or t
  misc_feature (124)..(124): n is a, c, g, or t
ttaccaaaatatatggcaaccccttcaccttctctccntatggggaataattataactngctcaattcctgtacgccaaacngatttaaantcactaatcgcctactcctcagttagccacatngcactggttattgcatcaatcataatccaaactccatgaggcttcatgggagcaacaatactaataatcgcacatggcctcacatcatcactcctattctgcctagcaaactccaactacgaacggatccacagccgtactataatcatggcccgaggacttcaaatggtcttcccacttatagccacatgatgactgatagcaagtctagctaatctagctctacccccttcaatcaatctaataggagaattattcattaccatatcattattttcttgatcaaactttaccattattcttataggaattaacattattattacaggtatatactcaatatacataattattaccacccaacgcggcaaactaaccaaccatataattaacctccaaccctcacacacacgagaactaacactaatagcccttcacataattccacttattcttctaactaccagtccaaaactaattacaggcctgacaatataaaaaacagcacagaagactggacaacattaaaaacatggtacttgtatggtaggacaactcagttcg

SEQ ID NO: 669669 - DNA, 222 bp, Homo sapiens
tagtcggtacctcaatatcagcgacgaagagatggcggctcgtcgccaggcctgggtccacccaagcgcgttatacacgcggtgtgcttgccaagttcggcaagctcgccagcaccgcgagccgtggggcggtaaccgatgcatttgatacgtagtctgttggcggtcgccgccggcctgttggtcgccggcgcggcccaggggcaaaccaccggcctggat

SEQ ID NO: 669670 - DNA, 315 bp, Homo sapiens
gacctgttcgcatggctgtaagcagcagctttaacgaaaggcgggaatgtctagcaggcgtacgaagccgcttaaagagaaaggcaatttgctcatttcttcagaactacgacggcagttgcaccaataatagccttgttagatctatagtcttttggggggacgtacgtctaggtgcgggacgacctgtgtaaacaggcataaaaacaagaaaactataggacgactaccatacttccatgaggtggcactgcctgccacataaccacttacgactcgatcctgtacatccttgtcttacgccgctgttgctct

SEQ ID NO: 669671 - DNA, 867 bp, Homo sapiens
  misc_feature (867)..(867): n is a, c, g, or t
ctggagcctgcccgctgagtgtcatgaatggatgtgctgttgcgctgatctgggtctgccgctgcgccagagccatgagtctgcagcctgaggtggatgcctgtgtggcctggatgccctgatgccctgatgcctgatgcctgtgatgccctgatgctgatgctggctgtgatgacctgttgccccctgccttctgtgcccctgctgcctgcctgctgtgccatgtgcctctggcatttgtgatgtgatgtgatgttgcctgtgtgattgcatacatcgcgagttacattgaatgcctacgtgtcaattcccatgactgtgacgattacatggtttgtgtggcaaagcccttgcgttgactggtggacacgagcctggttttccccgcttggccattgcgagggtggatattaatgttgctggtgagctcttttgcaggagttattggaacctcggccgtggttggattggagcagcacgtgttccgttattgaggtccgctaaatgtgagttattattatacgtagataaggtccaccaagatcgaagtgcctgatgtgcgtggccagatcaacagttttgcgcgcccgccgtaacccatgttttgtgtgcgcacatattcggtggtgagcccacccatgagaactatgagttttggcccgattattggcagacagattctttcgaaagccagggaaggttttctggtaaggtgaggccgattcctccctaattctgatgggataagaggagattctgtgggattaaagacctgtgggaatgagaggactgcgattgggaccccatatttatgtgaaagatgcgcgggcaccgttttaggaatcaagcgcgtacagaagccacgan

SEQ ID NO: 669672 - DNA, 264 bp, Homo sapiens
gacgaaccgcctcggttctccgtaaggttgagatagcacctggggatcctgaactcactaaaagtcagaggttcctcgagatatccggatgttgtacaacaagaaaaggtgcgttgggtatggcggcgacaccagtgtgctatcacctagtcataactctttcctgtgataaacacttgaacccgggacgcggaggttgtggtgagctgacattgcaccagtgcgctctagcctgggcaacaagagtgaaattccatctcaaaa

SEQ ID NO: 669673 - DNA, 292 bp, Homo sapiens
atgttcttgatcagtttaggcgatcattgctatcggaagtaccaatctaagcgtgggcaccgcaccaatcgagatcttaatccccacccaacgcggcaaactaaccaaccatataattaacctccaaccctcacacacacgagaactaacactaatagcccttcacataattccacttattcttctaactaccagtccaaaactaattacaggcctgacaatataaaaaacagcacagaagactggacaacattaaaaacatggtacttgtatggtaggacaactcagttcg

SEQ ID NO: 669674 - DNA, 330 bp, Homo sapiens
agggaaaaatgttagtaaagttcttgggttaaatatgtaggtgaggccaggcatggtggctcatgcgtgtggtccctgcactttgggaggccgaggcgggtggatcacctgaggtcaggagttcgagatcagcctggccaacatggtgaaacccggtctctactaaaaatacaaaaactagccgggtgaggtggtggttgcctgtaatcccggctactcgagaggctgaggcaggaaaatcatttgaacctgggaggtggacgttgcattgagctgagattgctccactgcactccagcctgggcgacagagtgagactctatctcaaaa

SEQ ID NO: 669675 - DNA, 681 bp, Homo sapiens
ggtgatgcctgagtgtggcagcgagacgcagcgctccagcagcaagcgctcgtagttctgtcctgcatgctcgacatcaggctggaatgttgatgacgtcgatctttgcctcgtagaccaagctgaccacgtggcaaccgtctcgtcgtagtgacgcacggccggcatggccgatagcagcaccgagtcgccccagccgaagccagtgcctacggcaagctcagaatctggatgcggcacgccgacgaagatgacaagacgcgacgggtgaatctctaccgttgaaccaggcaaccgataagccttgggcttgccgaagcgcgggctttgcgggtcctgctcgatctccgtcgcgctgagttggcggcgagtcattaccgtcaggtacttgatgccacccttcccgactcgatccggcttcagctctgaggctgtgtcacgctcaccggtgccaatgaacaccgcagccccaccgaacagccgggccttcaatagggcctccagaatcttgcccttgatgttcaggcgatcctcttcggcttcgatcagctcgatctgagccttgtcggcctgccagttgcgccagttgcggcacgcatcaacggccgggatgctcacgcccttctgcgccgtccacgatccacggaaggcgtcagcagttgctggtcgtccatcacggaa

SEQ ID NO: 669676 - DNA, 497 bp, Homo sapiens
  misc_feature (65)..(65): n is a, c, g, or t
  misc_feature (73)..(73): n is a, c, g, or t
  misc_feature (81)..(81): n is a, c, g, or t
gctgtaatataactaaaccattttttagccagagtaatatttatttgcatagtctatttattgtnttcgtatnacactgtnattaaatactgggatgaaatcagtgacctgaagcaagaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttggtgagttaccaaaattgccattaacagtgttttctttcccatattccatgctttctgcctttggggatatatataatataattggatttgactgcgctggggtatttatcgaaacttaggaagccaattaattaatttggttaaaaatgggccaagccaattatagggtttaaaaaccttatattaagtaaaccctttaccttaatctttgg

SEQ ID NO: 669677 - DNA, 283 bp, Homo sapiens
  misc_feature (12)..(12): n is a, c, g, or t
  misc_feature (282)..(282): n is a, c, g, or t
agattcggcacnaggccatagaaacactgtactcagggccagaagcgcaggctgcagcgtctgttacagacgaattctgaaagaagatgccaggtagggcacctcagggcctggaggctcacaggaagggctcaggcctgtctgcctttaccaagtacatgttcactctcttaggtgtttgtaggggagtggccaagacagccacgtggctcaggtgtggaatgaagctagaccaggtggaagccgaaggtccggcctctccaggcaggagagaaaggatgnt

SEQ ID NO: 669678 - DNA, 363 bp, Homo sapiens
gcatactcagtaggagtgcgcattatctaggcagagatatgtacttggacagatatggtgtgagatgttgagagtagcagatacccttatatttcagaaggttagccaatagcctatcttgatggattggatgtagatgtagaggaaaaagcagttaaggatgaatccaaggtttttgttctgatcaactgaaccagaatgatggttttgtcatttacagagatggcaaagcacataaggaggagtggttattggaggaagaagaccaagagtgcagtgtagaatataataaaaatgagatgcctattggacgtgcaagtgggaaatttgagtaggaggttattggcatgggtaccgagctcg

SEQ ID NO: 669679 - DNA, 908 bp, Homo sapiens
cactataaacgtattacctctcacggcgggagctttatcatttccgtggacggtgctccgaggatatgtcaaaaagaatttcgtttggaacccccccttctctgaaaaactctccgtgcaatgggttaatataggcaacgcgctgtgtgtccaaaaaaaggttgttttccccacacctgtcctcttaggggcaccaagccgccgcttacccatatattgggatcttaattgagaattctttggtcttctgtaacttggccaagtattacactccgcccttcatcctgccattaaaacgaactctccccgtgtaacaatacccccgtggtcaaccaacatacaccgcccggttattccacccccgggtcgcgcccaatggcacagttcctgaaacggtcccgaagtttccaaaggccaccacccgcaggagaagtgaaacccacgggagaatagggggaaacatacagggacaagatacatctagaaggggtttcccctgtcaaaagcgtccatgcgaccccatagggccagcatgtgggcaaaacccacgtcgcaaaagtctttctttgtaaatccgccccccccttcaatatctttcgacacataacattacaaggggccctggtgcttctttttggaaataaccccactccgtgtcccaccacaccaataattttttgtctctttgtattcgctcagaaaaaatgtcatctatttatatcccccctatttaaaaagcttttggttaccccaacgctcaacacccccagacgtgatgatgtcgcacaatcaaatagaaaagttgctgttaatctttttgcggttatccatcctcgaggaactgatccctctatcaatatcatgggttcccactctacatatctactgtaatcacaagagtcttggga

SEQ ID NO: 669680 - DNA, 905 bp, Homo sapiens
  misc_feature (700)..(700): n is a, c, g, or t
ggatagcccagcagcagtagcggtggtggggctgcggagcgggtgtgaggcggtggaccgcgctgcaggcatccgaaggacggcgggaagatggaggtgacgggggtgtcggcacccatcggtgaccggtttacatcgaggcagctccctcaaacaccttaccacgtccgagaagcgatacagccagatcctcaccatcggtgagttcaaggtgtaacactgaagtaggctggttgggcagacctgtttcctgcggttggaaactcggagctgtatgcagcctggacgacaagttctacagcaagctggctcaagaggatgcgctcctgggctcgtaccctgtagaatgacgggtgcggcatcgagtcattgaccaaatgtggcgcccgccttggtgagtatgaggacgtgtccggggtggagaatgtacacgatctcacaagatgctacgatgcagaggcaagacacggtccgtctttcctgaagccgcagaagctcggcggtgacaacggaggaggagcgggctcagcagagaggacgagtgctaccagcgtcatggcgaggaaaatggcccaggccagtccatcccggtgggcagcgctgtgaggtgcgggcggcgggacaattcccctcgcggggcccgcttgtttgtagttcccacaaattcacgctgggactggatggttgtcgtatgatgagncatgcgaaaatggtggcgtgtcatggaacgctattgaattcggccagtttggccttgtacaagtctgagggggaccccgggaggaacgttgcggaattaccaggatccgttactttcagaggcctgttgcagcatccgcccatattttcggacgtggcgttaacacaaaaaaaaggccgctatggggaggtgttatacgacacta

SEQ ID NO: 669681 - DNA, 127 bp, Homo sapiens
ttcgagagcagctaggtcaacacgggaaaaccctgcgtctactacaaatatgataattcgctggatgtggtggcgcatgcttgtaatccaagctacttaggaggctgaggcacaagaatcgctgtaa

SEQ ID NO: 669682 - DNA, 340 bp, Homo sapiens
  misc_feature (144)..(145): n is a, c, g, or t
gaattcggcacgagctgaccaccatcaccaagcagatcacggcctacgtgcgctccattgccaaggtgaaggagcggctggagcccaggtgaggccaaggggggtgttccaggggcactgagactcttcagaatgtgcatgggnnctgggtgcggtggctcacggctgtaatcctagcacctcggcctccaaaatgctgggattacaggggtaagccactgtcccggcccggttatttctttaacggtaatcatttgtcaggagtaaacccagagctctgacaggcatatttcagatcctttggcttgggcagttttgatttccccgtgtttccatggat

SEQ ID NO: 669683 - DNA, 638 bp, Homo sapiens
cgcagtggctcatgcctgtaatcccagcacactgggaggccgcggcaggtggatcacaaggtcaggagtttgagaccagcctggcaacatggtaaaaccccgtttctactaaaaaaatacaaaaattagctgggcatggtggcatgtgcctgtaatcccagccacttaggaagctgaggcaggagaattgcttgaacccgggaggcggaggctgcagtgagccaagatcgctccactgtactccagcctgggcgacagagcaagactccgtctcaaacaacaacaaaaaaacaaagtaccacagactgaagggcttaaccaatagaaatttctttcctaacagttttggaggctagaaatccaagataccaggttgttggcaatggttgtatcttctgagggctcaattcgtggcttgtagatggccatcttctccctgtatcctcacatgatctttcctttgtgtgtgtctgtgtacaaatttcctcttcttacaaggacactaatcatattggattagaaacttccccaatgacctccttttaccttaattaccactttaaagaccctagctctaaatataagtcatattctgagatgctgactatactccaaatatagtccatattcaacatatg

SEQ ID NO: 669684 - DNA, 258 bp, Homo sapiens
  misc_feature (234)..(235): n is a, c, g, or t
atctacaggacttatcattcagttccaggctataattgcacctatgcactcaagtctgggcaatcaaagagagatcctgtctctaatggaaaagaaggcagcatgtagctcatgctgtaatcccagcacgtttgggagggcaagacacgcggatcacgtgaggccagaagtttgagaccagcctggccaacatggtgaaacactggtctctactgagaaatacaagacttagcnncagatgtggttggtgcgttgtct

SEQ ID NO: 669685 - DNA, 810 bp, Homo sapiens
ggctaaccgcctgtgatcctaagtactttgtgtagggcaaggctgggcggatcacgaggtcaggagatcgagaccatcctggctaacatggtgaaatcctgtctctactaaaaaaaaaaaaaaaatttagcctggcgtggtggcaggcgcctgtagtcccagctactggggaagctgaggcaggagaattgatgtgaacccgggaggcggaactttgcagtgagccgagatcatgccactgcactctagcctgggcgacagagcgagactccgtctcaaaaaaatgaaatgtgaatattttctcacatgtctgtctctcaggtgtactggtgaacggtttgaagagcagagatatcttggtacagctagtaacctaaggtgtcaccaaggggcttaactatatgtggatggtacgcaatgtgtatgaataaaaagtattagctctgaacaacacatgacttattaaactaactgcaaatgggcctgatgcggtggcttacaccctgtaatcccagcacttggggaggccaaggtgggtggatcacgaggtcagatcgagaccatcctggctaaacatgatgaaacctcgtctctactaaaaaatacaaaaaattagccaagcatggtgggcgtgttgcctgtagtcccacctactttgggaggctgaggccgggaacatttgctttgaaccctgtgaggtgggggttgcagtgacccgagaaccgcaccactggcactcaagctgtggtgacagaggcgaagactccggttcggacacacacaaaaaacgaaaacacttttggccaggtg

SEQ ID NO: 669686 - DNA, 507 bp, Homo sapiens
  misc_feature (67)..(67): n is a, c, g, or t
  misc_feature (165)..(165): n is a, c, g, or t
  misc_feature (229)..(229): n is a, c, g, or t
ctggtcgtctgagttcctcacacgcacttggaggacactgacatgatagtagagacagtatctgtgngcatgacataaactcagaatctggcctaagttccttatcaaatttcactaactagggaggttggagagcagacatggagttgtctccaaaccagtatntggtcttcagtaaacagtgataaacataaaacactgctccacaagcagacttcagaactactgngcacagcaggtgaaagatccccaagtcccactgaccacctcccacaggaggaggaggaggaggaagaggagggctggtagggggaggtgtcatgagtgcgagagggtagacggacatgttccctactgaggtcactgctgccaactgtcctgctctgctgatctgtacaattccccccaccttctggacctaccctctcatgggccagagctcacttatctgagcctaaacctcccggtctcaagcatagagagcagaaatgccagatgcagaggttc

SEQ ID NO: 669687 - DNA, 413 bp, Homo sapiens
  misc_feature (378)..(379): n is a, c, g, or t
agcgtgatgtgacttcacaaagaaacgcagcttcttttgaattttctaaatacgataggggtgtataatcttgcgtatctagttaattttagaagttctctcttcaacttaaatacacacgtgtatcacagttcatttttctacaagccacaagaatgaaaatagagtttctcgcatattcttataaaagtatatcacacgtttccccgtgtataatacaagataatgtgtttcctcacctacccacactaaatagtgtagagacacatgtgtttttctccctctagccctgtagatagtgcaatacacccatatcctagtgtttcattctgaacatccccttgtgtttgttcttatataatctcactcgtggtagtnntactctataaaataaaaaacaaaatatgcggtta

SEQ ID NO: 669688 - DNA, 109 bp, Homo sapiens
aggatccgatactcttctcccagtagcaaaatcaagaggtgtgtaagctctaaggctctatctagcccaaaaacgaatgctataatgttttactgggtggtgtttctaa

SEQ ID NO: 669689 - DNA, 228 bp, Homo sapiens
  misc_feature (73)..(73): n is a, c, g, or t
  misc_feature (190)..(190): n is a, c, g, or t
caaagtcacccggctctaacgcggggacgtgaggtcggaccactgcctcgctctgagaaagagtttttttttnttaataagtaaatttttattgaagaccgacctgtaccacagagcgcggacattaggatcgtgaaaccctccggttctgtccacctagtgggctcgggtcctcaaactctggtcgganccttgttccgttttgagatagatatttttaatggtttt

SEQ ID NO: 669690 - DNA, 516 bp, Homo sapiens
ctgcggagggaagtccactctcggggagagatgctgatgccggtccacttcctgctgctcctgctgctgctcctggggggccccaggacaggcctcccccacaagttctacaaagccaagcccatcttcagctgcctcaacaccgccctgtctgaggctgagaagggccagtgggaggatgcatccctgctgagcaagaggagcttccactacctgcgcagcagagacgcctcttcgggagaggaggaggagggcaaagagaaaaagactttccccatctctggggccaggggtggagccggaggcacccgttacagatacgtgtcccaagcacagcccaggggaaagccacgccaggacacagccaagagtccccaccgcaccaagttcaccctgtccctcgacgtccccaccaacatcatgaacctcctcttcaacatcgccaaggccaagaacctgcgtgcccaggcggccgccaatgcccacctgatggcgcaaattgggaggaagaagtag

SEQ ID NO: 669691 - DNA, 89 bp, Homo sapiens
gttccggggaaccaggggggggccgggaaaaaggacttgcgcgcggcccgcccataaaaggatttgtgggttctaaccaccgacaacaa

SEQ ID NO: 669692 - DNA, 340 bp, Homo sapiens
tctagagatcccgcgtgttgccacgacatacccatacttaatggatagagagttatgaagaactgaaagatgatgtcttgaataattgcatgggtaatgattccatttactaagatgggattgatataggagggagtgctggggggaagggggacatgtaggtctgagagttcagtgaacttggagatatgtggtggtcaaacatgctgtttcacgaccacatacagcccctcatgcaggcaagttcccccgtgtacagcctgatcactccccagacgtggtcagcaacgcacaagctatcttgacccaacccttgagtattgtccgtgggtgaaacatg

SEQ ID NO: 669693 - DNA, 444 bp, Homo sapiens
  misc_feature (82)..(82): n is a, c, g, or t
  misc_feature (85)..(85): n is a, c, g, or t
  misc_feature (94)..(94): n is a, c, g, or t
  misc_feature (100)..(100): n is a, c, g, or t
  misc_feature (102)..(102): n is a, c, g, or t
  misc_feature (109)..(109): n is a, c, g, or t
  misc_feature (113)..(114): n is a, c, g, or t
  misc_feature (117)..(118): n is a, c, g, or t
  misc_feature (121)..(121): n is a, c, g, or t
  misc_feature (126)..(126): n is a, c, g, or t
  misc_feature (128)..(129): n is a, c, g, or t
  misc_feature (137)..(137): n is a, c, g, or t
  misc_feature (149)..(149): n is a, c, g, or t
  misc_feature (198)..(198): n is a, c, g, or t
  misc_feature (206)..(206): n is a, c, g, or t
  misc_feature (233)..(233): n is a, c, g, or t
  misc_feature (308)..(308): n is a, c, g, or t
  misc_feature (314)..(314): n is a, c, g, or t
  misc_feature (317)..(317): n is a, c, g, or t
  misc_feature (334)..(334): n is a, c, g, or t
  misc_feature (422)..(422): n is a, c, g, or t
ctgcaaattgcaaagcccaggcagaaagatcggatctcttaagccccggaggtaccgaaccgcccgggcaaaaaggtgaaanccngtctctacnaaaaananaaaaatnagcnnggnntgntggcncnngcctgtantcccagctactngggaggctaaggcacaagaatctcgctgctgcactccagagtgcagacnacagagcnagactctgtctcaagacaacaacaacnaaaaactgaccagttagtattgtattagttacttgtagaggaaaatagtatcaaatagtaaggattttcttatanaaaacnaanaaagggtgtggattgtntatacttgctgagtcaagtatacttgtctttctgagtcaagtaagtatacacagtccacacccatttttttttttgaagaaaacaccngtttgtttttatgtgccctcag

SEQ ID NO: 669694 - DNA, 658 bp, Homo sapiens
gatcgagtggcctcgcctcatcgcctagcgcccccctcagtcgccgccgcctccgcccgctggccatgtcccccggccgccgccgccgcgcccgagcgcggcgctcccgcggccccgcgcgcagtgagcgcgggcccgtcttgccgttcgcccgccccagggcccccttgtatctccgacgccgccgcgacgccatgtgggtttggagctccagcggagccgccgccgccgccagcgggtgagggaggccgagagcggagcccagacaccgccccggggcccagggatgcggggcacagccatacggagaccacggcactcatccaccagaacagaccagcacttaccacggaaccagaacgtagcaagacacaagcgatgcgcagacgagacgaagcagagcaaagcaaggcacccgaacccgcggccagcgccttacagcatacggcccgagcgagcccgccgccgacgggcccggacacagcctgcagcggagcccacgagaggcagcgccatggcggagcagacctactcgtgggcctattccctggtggattccagtcaagtgtctacatttctgatttccattcttcttatagtctatggtagtaacaggtcccttaatatggactttgaaaatcaagataaggagaaagag

SEQ ID NO: 669695 - DNA, 341 bp, Homo sapiens
  misc_feature (248)..(248): n is a, c, g, or t
  misc_feature (305)..(305): n is a, c, g, or t
  misc_feature (311)..(311): n is a, c, g, or t
caagcaattctcctgcctcagcctcctgagtagctgggattacaggcatgcaccaccacacccagcaagttttgtatttttagtagagacagggtttctccatgttggtcaggatggtctcgatctcttgacctcatgatccaccctccttggcctcccaaagtgctgggattacaggcgtgagccaccatgcccagccgctgatgaaggtttttgaaaagtgaagtgtgacgtgagcagagtcttgngtggaatgcggtgggggaggagtctcctgttggatcttttatgtcctcttgagcttntcaggnacacccagtcaaagaagggatgagaggatg

SEQ ID NO: 669696 - DNA, 751 bp, Homo sapiens
catgtgcccggtctccaggatcttaaccggggtgcaccttcgaagtagagaggcccgcccggccccccggtgggccagtggcccacccgccagatgacacagcgcgtcttccagcccacccctaccccaacccgatggggaatttgccaaccagggggagggaataaagaacccccaaccttcccaggcgccctggctctttttttcgttaagagaggtaggcttttaagagagggggaaatgttgtttgtgaatttttcttaatcttaccactgtgttaataaatgttttggtaacaataattgttatgggtcacgcccacactgtgttaaatgagtctcggagtgagccccaaccacgcctttcggaggtcgtttcttctggtgcctaactttctgagctttaactctgtggtggtgagccactggttgcacttataatctcccaaaggaggagaaaaaaacctctgttaaaaaagccgaaaatgagccaccacggaaaaccattcttatttccgaggcacttccacgtgaaacttttttgtggtatgtaacttaagctgtaactataaagtaagttggtgtttgtaatgaagattggttataaaaggcccaagattaaaggtgttctttttttttccttttttgtctatgaagttgctgtttattttttttggcctgtttgatgtatgtgtgaaaccatgttgtcccaccattaaccgggattttattttgctgagttgttctaacca

SEQ ID NO: 669697 - DNA, 430 bp, Homo sapiens
  misc_feature (325)..(325): n is a, c, g, or t
ccagaacattacaacatatacctcctatctagctgcttttctgtgcccttgagcaactctcctagtccgcgagtgtctcctaatttttccagctcctagtttcctttgtttgactttttaattctatgtgatcaattttgttttcagcctccacatatgagtgagaacatgcagtgtacaactttctgtttctggcttatttcacttaacataatgtccttcagttccatctatatcgccacaaacaacagaattccattttcatgactgaataatattctattttgtatatataccacattttctatatccattcatctgtttntgaatccatatcaacacccaggttgattccatatcttggctattgtgaatagtactgcaatagacactgggagacagatgtctcttcaatatactgatttccttt

SEQ ID NO: 669698 - DNA, 375 bp, Homo sapiens
ccccctccccgggtaaccaagctaaccacctcccatttcatcggggttctcactgccaggaagaagaggaatgtaactggactccaagttggctctggcaacccgaaacataaaattccccaacacctggggccacatggaaacaactaatcaatggatccaataaagccttgctcctaagggttttttctttccctttttttttttttttttttgggaaaggaaatttggttttgcccccagggtgggggggcggggcccaaatttggtttatttgagcccccccttccagggtaagggaatttttggcccttaacctcccaaaagggtgggattaaagccgggctaatttttttggatttttaagaaaaaaag

SEQ ID NO: 669699 - DNA, 488 bp, Homo sapiens
ttgagcggggtgcagtgtgaaggagcgctggtggcgcgggagcggccccggggaccccgcgctgctgacggctggcgaccgcggccggaggcgtggcgcgggtctctggacggcggtcgcctcagacacgcgacacacgacgggcaggtccacacaaggcgccgtcaggcaaggcgccacgggtttttttcgcccgccatgaacggccgagaacaaaccacacggagaaacaggacgaaacaagaaaacgacgaagccaaaatctaaagaacgaaccaagagagaaaaaaagggcgagtcaccgcgaccaagagcaagcgggtgacgaggtcacaagcaacgtgtagacacagtgagagagcagcagccaagaggacaaatacaccgaagcattgcggcaggcggaaagccaacccacagcgccggccggccgagccccaacacggcaccaccgcgaagacgcccccacgccgcgacagcagtccgtc

SEQ ID NO: 669700 - DNA, 227 bp, Homo sapiens
atgagaaggtcagacgaaccgaaactcatggttctagtcggatcgttaaccactgtgccacgacgggaactccttagtatttattttttaaacgttgattttacttttatagaagtatggttgctttacaatgtttcatgtgtactgcaaaggtgattcagttacacatatatctatatttattcaggttcttttctaagttaccataaaatattcaatatagttcc

SEQ ID NO: 669701 - DNA, 232 bp, Homo sapiens
aggctcatcttaacgatatttggaggtcagcacggtactcacgtatcgacggaacttgtacagggaggcatgcaccgcagtgataaatacacgtcgaccaggctccaggtaaacgatattgggaggtcagcacggttctcacagtatcgaaggaacttgtacagggaggcatgcaccgcagtggtaaatacacgtcgagcaggaagcatgcatgcatgaacaagatattgaa

SEQ ID NO: 669702 - DNA, 136 bp, Homo sapiens
gtcaggtactgttacggagggggctgttacggagggcgtcgttagggagggtcgttaggacggcgctgttacggacgtgttaggagggtgttacggagggcgctcgttacggacgttacggagggcttgttacgga

SEQ ID NO: 669703 - DNA, 304 bp, Homo sapiens
agaggttatgggcaaagtcaaagaggtgctgggcattggcgtaaaccttgaagcgatccaagccacagcgaatggacagatcaaagaactgtccgggaccaaatgggttgtgggtgatattttttttcttggattcccacgagccatttataatggtgttttggaacacggtaccgttgcccatgcggggattaatgtgcagagctatgtcccctgaggagcccaccttgaagttgatagcaaagctcttgcctgtgggaggcacatagcccttgatgatgcagagctatgtcccctgaggagc

SEQ ID NO: 669704 - DNA, 991 bp, Homo sapiens
gaccgacgcgtcgacagagctctcggcgcgggtgagtccctattcccagaggcaggtggtgctgaccctgtaacccaaaggaggaaacaggctggctaagctcatcattgttagctggtgggcaccatgtcccttttaaagcttcaggcaagcaatgtaaccaacaagaatgaccccaagtctcatcaactctcgagtcttcataggaaagcgctcaacgacagcgtctggtgataggaatactcagatgtggagaccatcttctctaagtatggcgcgtgtggccggctgtatctgtgcacaaggggctatgcctttgttcatgtactccaagtgagcgccatgcccgggcagctgtgctgggatggagaatgggcgggtgctggccgggcagaccgctggatcagtcaacgatggactggatggagcctaagtcgctgatcggaccaaggggctaaagagagcagcatctgccatatacagtggatacggtctttgactatgattacctaccgggactgagttctacggagaggtctcgttcggaaggtagcggggccgtctgtcgcccgtgccatatgcccaggcggtcccgtgtgaagcgacccgggtcagagtcccttggtccggcgtgtaggactagcgtatctgtcaagcttcttgccgctcccacagcgtgtcaccaccagctcagcaagatcaggttaaagagcgggagctgaggccatcagacgggcctggccaggacaagtcccatatcgatgcccttgtagcccgttgggcgaatcgggggaagaaaaggccattcagatggcaaaacagcgttggaggtgccgaaaagtagaggggtatgacggggggaaaagggggggggtgataggagaagcccagaacattgagcaccccgtgacagccacagatgaggcaacgggagcacgaccgggtagtaggagaaaggagccgcgcgagagcacacggtctcggccccaac

SEQ ID NO: 669705 - DNA, 1027 bp, Homo sapiens
  misc_feature (1027)..(1027): n is a, c, g, or t
tcctggccctctgcagagtggggatttagaggaatctggtcatactaatatctaccataggcacatcttccagccagagttaccaagcggatagcactgtacagcattcttactcctaaacagcagtcagccacaaactgacccagagtttaattagcagtgactaatgtcatgttcgcaatgtacctgatttttcatgagccttacagacacacagagacacagtacacgatgatcttaaaatttgtctcagttcactgatatgcaaaaggaccacactgtctctgcttccaggagtatgttaggaaatgtgccacaatttgacctgaagacatagagatgatgctgctgcatttaggtgcctttagcagagctatgcaaagcaatcctgataagacaagatacatagagagtcgaatctggctttctgagaattgcacccacgtgaacgagagtacctagtctcatcagccgtcagtaaagcaagccaggaaactgaccatgggtctctttgcctaccagtattaaggattaacacattgcatgttctgtatactgtactaatactgcaccagcaagatttccacaagtcatagatccaaagatacatgcacagtcctgagcaccagctaatggtgcgcattaacttctttaacgatttgaaccctttcaatctgcgtgatgcaatcacatgcgccatgggctgactaagaatagacactggatgtgccgtgcacaatgaaacgagtgtgtggtgtgcacttccaattgtgaatagtcttcacacacagacctatagggacgagcgagggatcaaacgcagtaagccacgacctttgcaagccgagcgcgaggaacaggggaaagggacaggagagcaaccaactagaaacgggtgaaaccaaaacaacagcgaaggagctcaacaatgaggaccgaaacacacaaatacagacacaagaaacagagaaggcacagaagcaactagaacaaagagaaaaacagactcgcccccctattccacttn

SEQ ID NO: 669706 - DNA, 310 bp, Homo sapiens
  misc_feature (6)..(6): n is a, c, g, or t
  misc_feature (33)..(33): n is a, c, g, or t
  misc_feature (187)..(189): n is a, c, g, or t
  misc_feature (307)..(307): n is a, c, g, or t
taattntggatgttattcccaaatttttttatngatgttatttccccacttcttttttttttgagacagagtctcactctgtcacccaggaaattttcttacatgtttgtttgtttgtttgtttgttttaaaaagacagggtctctcactgtcgtccaggctggaatgcagtggtacaatcatagcnnnctgtagcctcaacctcctgggctcaggcaattactcccacttcaatctcccgagtagctaggactacaagcacatgccaccacacctggctactcgggagattgaagtgggagcgcgncgc

SEQ ID NO: 669707 - DNA, 521 bp, Homo sapiens
tggacacaaagttcttgctctgttgcccaggctggagtgcaatggcttgatctcggttcaccgaacctctgcctcccgggttacaagcgatcctccgtgcctcagtctcccaagtagctgggattacgggtgtgcaccaccacgccgtgactaatttggtattttatagtagagacggggttttcaccagtgttagtcaggcgtggtctcgaactccgtgacctcaggtgatccacccgcgtgggcctcccaacgtgcgttgggatatataggcgtgagccaccacgccccgcctaaaatccatattcaaagaagcaattacagtctcctttctaagcttggtcagtcagggggcctccactgacttcctaggcccgtgtaattaaaccagtcttaaaggtttgtgcaggaaagctcccttcttccaaggtgggttttcccaaatcgcacaagggcaaagccaaacagaggaagaacacatttaaaccaaaaaaagacacctttaaaacaaaaaaaaaaag

SEQ ID NO: 669708 - DNA, 491 bp, Homo sapiens
  misc_feature (334)..(334): n is a, c, g, or t
ccagggagaggtgctggtgtacgtgtagggggcctcccatctgctaagcgttttaccgttgagccgctccaaaaacactaagctggggacgccaggtgttcccccaccccggctccctggccctatccacacctcctcccccaccccaggatcgccatctttagtcgtcggacacggttggagcgtatacgtgttttagaaccaccgagatcaaacacaaggtcccctccccggcccacccagcccagccccaactgacctccatgcctagggaaaaattttccccaccacttttccctcccccgacccaggccaaagcaggtgcaggtgccgngacatgcctgctcctagcctcatccccctgcccccgaaaaccagactctcctcccaaactagcctcaggagcttggcatacccgctcgctcctaaagagaaagacccaggaccctcccccatcacccccaagagaggttcgccatcctctggcctcg

SEQ ID NO: 669709 - DNA, 101 bp, Homo sapiens
atttttcacaggggaaacctgtataacctcgtgagtgggaaacccctggggatttttcccagagaaaacctttataacctcgagagggggaaccccttggg

SEQ ID NO: 669710 - DNA, 657 bp, Homo sapiens
  misc_feature (44)..(44): n is a, c, g, or t
  misc_feature (294)..(294): n is a, c, g, or t
  misc_feature (314)..(314): n is a, c, g, or t
aaaccttgtgcggggcgaaaaaagaaagcgaccagttttgagancgagtgaagagcacctgagaattttgttcttgcagtgccgaaaccaccctgcaaacagatagccacatcgcccaacagcttgggctcgagaaggatgtggtccgagtgtggtcttgtaacggcgcaaaaagggcaagcgataaacagcgactatgcacaacaaaaggatttttaggctggtgggtctcctttttcagggggaccagtgtcctttcctttggccccagggccccattttggtaccccaggntatgggagccctcatttcantgcattgtactcctcggtccctttccctaagggggaaacctttccccctgtttttgtcaccaatttggggtttcccaagcattcaaaataaggggcctgcccttttaggaatgggggacagggggaggggaggaattaggaaaaaaaaaacctggagtttgtgccagggtttttgggattaagtttttttttccctaagaaaggaattgggaacacaaagggtgggggcaggggagtttggggcaactggttggagggaaggtaaagttcaataatgtttttttttttaatcccccatcatgtatccctttttttttaaataaaaaagcttggggcccagtta

SEQ ID NO: 669711 - DNA, 559 bp, Homo sapiens
tgaatgctggctcaggttaaggaggagacaatgctgacggttaagcaagaatggccaagctggcaagaaaaagcacacgtgatacattaggatacagcaagggcagaagcttcgtgccgtgcggatctgcaacatttacatttgtttggcctgcaaactatcaagaaggattctgtgggccagggagtctccactgaacaaacaaaatggcagtcaaaagtcttgagtgtcctattccagcagcccagagtcctcatccgtcatccacgggagagtctttgagggaaacatgaagtccagctcatgcctctgcctatgggtcaatttcttcgggaatcactgtgatcatgatatcttcattacccctgcggaccaccatgttcagggtgctttcccttttaatgacgtcgctgacatcattggcggagaccacggactgtccattgatgctgattatgacgtcgttttccttgagaccaccagcttctgctggggtatcaggaattacttcaattatatatgctcctgagatcacgtctgggaagtcccggtgccggtc

SEQ ID NO: 669712 - DNA, 626 bp, Homo sapiens
tctagaggatccctgcatgatgtactgcatgtgctccgttctgacttcttgtggtttcaaagtcttaacaaacctttaaatggcacacatttatcttcagttcataacgtaaaaaagacttcattgacctgattaaattctcagaaccctcagttccttagggatgaaccaaatggctggtatcattgcttacaaagtatcttgaactcgatggagcttatgttaagaagtttatattttttacttttaccttttagttcaatttttccataaatttttgaagtcccctcatacatcatcagggaattgcaaattaaaacaacaataagatgccactatgcacctgaaagaatagccaaaatctataacactgaccacaccaaatactgtagagggtgtttagcataaggaactcccagtcactgttagtggaaatgcaaaatgatacagccactttggaagacagtttgcagtttcctacaaaactaaacagaattgctatactatctagcaattatattcctaggtatttaacccaatgagtgggaattcatgataacacaaaaaactgcgaatgaatgtttataacagctttattaatattgggccaaaactggaagcaacca

SEQ ID NO: 669713 - DNA, 346 bp, Homo sapiens
cagatggctcacctgaggtcaggagttcaagaccagcctgggcagcatggtgaggccccgtctctactgaatatacaaaaattagctgggtgtggtggtgtacgcctgtagtcccagctacttgggaggctgaggcaggaaaatcacttgaacctgggagggggaggttgcagtgagccgaaattgtgccactgcactcccgcctgggcgacagagcaaaactctgtctcaaaataaaataaataaaataaaataaattggggagtatgggagccagtgcaccacaggccaacttaatattatgaggattcctcctcgtagggagaaaacctgggcaggatgcagg

SEQ ID NO: 669714 - DNA, 213 bp, Homo sapiens
atcaagcttgcagggcaggggatgcaggccaggcagcagcaagtgggggcagcatgggacccacctcagtccccagcttcattttcttctaatgttcccccagctgtggcattctctgcagtcttggaggccttcttttttttctttttctgggttttacgacttgcagaactctggaggagggcctttagttctgcaattcctggacctcca

SEQ ID NO: 669715 - DNA, 896 bp, Homo sapiens
gttcctgaagggccgggcttcccgaaagccccttgtgctgtgtggagacctcaaggtgtgcagcatgaagaaatgaccttcgcaaccccaaggggaacaaaaagaatgctggcttcaccgccacaagagcgccaaggtcttcggggaattactgcaggctgtgccactggctgacatgctttagggcacctctacccaacgaccctatgcgctacacctttggacttatatgatgaatgctcgatccagagaatgtccggtgggcgccttgattacttcttgtatgtcccactctctggttacctgcattgtgtgacaggcaagatccgttccaaggcccgtcggcagtgatcacttgtcctatcaccctatacctagcactgtgacagcatccctaaatcactttgagcctgggaaataagccccctcaagctaccattccttctttaaacactcttcagagaaatctgcagttctatttctcatgtatgaagaactaggaatcctccaaccaggctcctgtgatagagttcttttaagcccaagatttttcattgagggtatgggttttaaaagaaaattgagagaaagactaactaatgactttgtttgagttatccacatgataattaagagcatagtttcaaataatatttcactttaaatccaaaggggggggcggctaaaaagtttgcggggggccgagattagagaacccggtttgttttaaagggtggccctataggggtgattgttagaacgcatggcgggtttcaaggtgggtggaaacggtctgggtttgggaggacctctctggggggcacaatggcccctcagattaggctggaaataatagggttgggacacgattgtcggaatgttgttataacgaagcg

SEQ ID NO: 669716 - DNA, 127 bp, Homo sapiens
gacgctctctctgtgggtgctgtggtcggtttcatcgaacagcccacgccgtttgtgtccctgttcttccagcggctcctgcggctccactaccccacagagagagcgtcccccacagagagagcgt

SEQ ID NO: 669717 - DNA, 178 bp, Homo sapiens
gtgagcgatctagaggatccctcacgccatgtcacaaacccttgagtcatccttctactccctttctcttataaccgacacccaatccataaagaatccagctggttctttttttttttttttttttggaaacggcttctccctctgttggcccaggttgggagtccatggggcacaa

SEQ ID NO: 669718 - DNA, 157 bp, Homo sapiens
gcacctacggatgtgctgcaggtcacagcaggcagacatggggacgaccatgcgcaacaccaacgcaggagattgctcgagatcaaccgcgatgatccagacggctgagcatctgagtatcgaccacgatcaagacagcagctgcgccaaccatgca

SEQ ID NO: 669719 - DNA, 323 bp, Homo sapiens
ggcacgagctcttacagtgagaaagccatgtgaagacgaatgacagggatctacatgccgatggaatgccaaagattcccagcaagtcatcagaagccatggagaaaagcatgtgggttttttttttttttttttccttttaaaagtcttctcaataggagggtgtggggcgggattcccagaaaaagagggggtccatgattccataacgggccctgtgataaggggcactgctagcagcgagttagtaccagagattctcgttatctcagggtggaggcagccccaggatagattagagattaaagggattgcttatggga

SEQ ID NO: 669720 - DNA, 181 bp, Homo sapiens
tgtagaggacggattcaaaaaaccaatgagacctggtaggtcactgatggttttcagaaagcatcagttcgtgctcgtcgctgcaatttggctcaaaacgtcatcaaccatagcatcgtgttttaccatccaggcgaggtgctgctgaggtgacattgatgcgttagggtgatcttgatgg

SEQ ID NO: 669721 - DNA, 297 bp, Homo sapiens
ttagaatgtaacagatgtagtaatcttgaatgagatgtcaatcgtactatgttcagtacacggatagctgtaaagtgtattggctatggatacaacaacagtgccagtttagttgaagcgatagtacagccataatgtgcagaggacattgaaaaatggtctagtgacacgctggtgtcagagtgcagaactggtacattatgggttacagacatctatggtgctataaaagcagcttaggtacaataaattatcaaaaagagaaagtgaattttggtaaaattcacagcataattg

SEQ ID NO: 669722 - DNA, 310 bp, Homo sapiens
cccttttccctttcctttcccccttattcattttttggacttaccccagatttttgcccttgataaaaaatccttcactttttttttttcatcccctccccccctaaataggtcaggtgagggaggctgggaaaaggtgggaggaggggccaaagttaaggaaaaataggaaggattttccctcttttgttttttttttaaaaacccttgtttgggggcaccaatctccctgtccctttccctgttaaaggcctatttttttttctttaaattttttaaaaacccagcccaacttggatgtttcaaggta

SEQ ID NO: 669723 - DNA, 838 bp, Homo sapiens
gagcctgcagttgccctgtaggcatgccattgcgcccagcctggaatggcattgtcttgaatgccccacttccacaatggactggcatgctggctgctgtggccacgtgtgttcaaccatgcctggccctgtaatgatcctgcagactgtaatgtgccctgtgcaatgccaatggctgcgcctgcatctgcccctgcgcccctgctgtctgtggtccctatcctgtgcccatctgtgctgctgccccactggttctggtaccacactgaatgtgtgctgctgcctgtgcctgctgtgcgttctatgcctggatgtgatgctcatgtggtgtgcctggctattcacgaagaaagtgtgtgccgcgggacacagtctgtgcattatcgttgttgtgattcctgaggatgtgcgtgacagcaatgtccactgggaggtccctgcatgtgccaactgttgcatgctgtgccttgaacggatgtacctgttccaaactcatcctcattccccatggaagccctctggcccccaaatgaagtggagacatgttcttgctgaagaactgaaacttggccacccagctgaccggaccggtcattgccctgtcctggaacgtctataagaaaggagaactgctcgagtcatcactgatggacgcagacagactttcgcagccttcgctagtctccgtattgcccgttccacgcccggctcttcgggcttacgggcaaaaagagccactggatgccgggaacaggttgtttgcacggaaactaaatccctcctgggacttgaatcggccggcagctctgggtctcccgtggtgttttcctgggaccag

SEQ ID NO: 669724 - DNA, 1884 bp, Homo sapiens
atacatctgcgtactggcgatctagaatctatgtcccaaacccatctccagcttatctactcagtacaaacttaggccaaagccgtttacccaatatagtgtgtgataaggctgatacgaaatttgagagagcttggctgcacactatgagtactagtaccgcacatgggaacagcatggaccacagagttcactaactctaatgggtagacataagcgagatggacataaaccaccgtattaccaaacatgcaataattgcaaattagcgtgaacaccgcgtagacttaggcgcaccggaagatgtcgcgaaaagcttaatgacccctctctgacaagcctaggagcgacgctagcggtaaagtaatctacagcatagaaaagagcaccacccgcagatctattgtactgtcagagagacctacggtgaggaaggacatctctacataaggcgttcatgcaaggcccgcaccacaactacttaacgcgagaaacgcgcctagggctcgcactcaaggccatgcgctctcggtctcaagagacactcacggagatccctctaaggtatctgtagagcgcttttaacacactgtggggcgctcccaccacgcagacggtgggtcccttacataaatcccccccctgtggtgtggaccactttttgtagagtctctcgctctcatgggttcctcaaataacgcaatgggcaacacccaggccatcccatattatgggggaacccacccaatagggggtataatagaaaaaacgcccgttttggctttacgcaatggacatgcatgggtgataaccacgaggaattatcagaaaacttattctcccaatgtcaccggctaaagggggcccataaagagagagtggccccggccccaaccccagcaattgaaccgcaaacacgggcgggtatcaaagaggccgtctaaaaggagtggcgccacactaaccccttaagcggtggaaaatctcccgtgagacccacatagtttagagctaggaagaggttcccttttcaaccaaacacctctaccgttggggaacgccaagaggttctttagttcaactcgcgtaaataagggccatcggaggcggttacagtggggttaggatacattaaaagctaaagcggggtgtggtacaccacataagtatcatctcaatgcggggtcacttacacggaccgtgtgcggactacagtagttgttaaccaacagtcctgtcgatcaattgaaaccagagattataaacacaaggctcgccaccccctgatgtgtgtgggtcggaggccccagggcgcaaaacacccctgcacagtggaagagatatatcaacccacgcatggttgttatcccccccacacaacccttgggccagtgggtccaatcaaccggcgagaggggtcgttgtggcaagcgagtgatgatatagacacgcaccatggtgtggacacctaagacacccgccccctgggggtacccaagaagacggttccccgcagtggagggagacaaacatttagaaggcgacggggcagcgagcgagcaggacaaatgttggagaggagagcggcaggacaccgaatacacggtggacagggagagcaacagagagaggacgactgcaactcagagcgagagagaggagagcgcgactgaggcgaccggcaacatatgtacgacacacacaagcctacgaacaggagcagaaaggacagcagcacaatagagaaagaggggcagcacacccagcagacagcaaacaatacacgatcggtgatacgcaagaagctaagcacgaacaaggcaacacagatgacaccaagatacgaagcgagaccactactcacacagcaacgacgagaagaga

SEQ ID NO: 669725 - DNA, 178 bp, Homo sapiens
  misc_feature (8)..(8): n is a, c, g, or t
  misc_feature (10)..(10): n is a, c, g, or t
ccactagngnaggccactccttatttgtgatttccacaattgaagaacacggcgctgtatgtgataatcagtaaaggttcattgactcaaactgtttactgctttatgacaaatactaggttcttcttcttctttttttagttttctttgaggggagggccaaattttgtgtcccagg

SEQ ID NO: 669726 - DNA, 150 bp, Homo sapiens
ggacatcaagtacttaacagggtaatagaatatcacagggcaagtggaggcagggcgagaatctcagggaccgggtcattatttttattgctaatgtagtttttgggccccatgttcattgaataccatcttatcggaagccgggatttt

SEQ ID NO: 669727 - DNA, 123 bp, Homo sapiens
ttggggctccattcaggaacacgggtcgcagagctcgccctcatctgagccgtcgccacagtcgtcgtggccatcacacagctggtcagggggcaggcagacggaggtgtggtggggcacaag

SEQ ID NO: 669728 - DNA, 352 bp, Homo sapiens
ttgctgtacttctatattctagtttaatagaaaacaaaaaaaatacagggatttaaggacccaggcagaactaggaaagttccatctacttgggtataccgctggaagataaagttgttcttggcattgaacttcaggttatcctcttaagtttatttggtaagcatcatattctcttgccctaatgagctcatggttatttcaacacatggccctgtattgggaaatgggggaaggaaacagaaaaggactccatccagcagttgggtaggggttggccaagattgttttttcctgcttgtaggtgggaagggattgggttattgggaggggtaggggaggtgttgataga

SEQ ID NO: 669729 - DNA, 190 bp, Homo sapiens
tccttgttatacgaagtgggctaaagcatttttaatacatagagcgaaagcctataatcactgtgcccgctcataaggggatgtgcattgctaggtttatagatagttgggtggttggtgtaaatgagtaagtgtaggagtccgcaagaggttagtattgttggcacatcaaaattgattaaatgatccc

SEQ ID NO: 669730 - DNA, 371 bp, Homo sapiens
cactgcatgtgacgaagatctaatgtccaacactgatcagagaacttaaacaacttacaacgaaacaaaaactctcataagaaacgggggcacaggacataaacagacactacaaaagaagacacacatgcggccaacaagcatatgagaaaaagctcaatatcactgatcataagagaaatgcaaatcaaaaccacaagggcataccatctcacaccagtcagtatggttattattaagaagtcaacgccgggcatggtggctcacgcctataatcccagcacttcaggaggccaagatttgggtctgagctacaggaggacggagttgccactgacagaaatgggcagagtctgtgggtaaagcaggca

SEQ ID NO: 669731 - DNA, 337 bp, Homo sapiens
  misc_feature (71)..(71): n is a, c, g, or t
  misc_feature (206)..(206): n is a, c, g, or t
  misc_feature (324)..(324): n is a, c, g, or t
  misc_feature (327)..(327): n is a, c, g, or t
aaagaattgggttatttgtaaaagggtccacacaaaattcctttaaaaaaacagttcctggctgggcgcanttgtcacgcctgtaatcccagaactttgggaggccgaggcaggcggatcacgaagtcaggagttccagatcagcctgaccaacatggtgaaaccccgtctctactaaaaatacaaaaatcagccaggtgtagtgncgtgtgcctgtaatcccagctactcaggaggctgaggcgggagaattgcttgaacccgataggcaggggttgcagtgagccaagatcatgccactgcactccagcctgggcgacaganatngctccgtctc

SEQ ID NO: 669732 - DNA, 350 bp, Homo sapiens
  misc_feature (12)..(12): n is a, c, g, or t
ctcattgcctgnttggtcccgaagacaaagggtccaacagtggcttcccagttccagtgtcttggggagctgggggggcccagccaaaccctccttttttttaaagcccagccagcaggcgggggtttttggaccctcaggccagtgaatttccagccctcagggcgggtttttgggcccctccaggagattagacccgccttttgtgttcccccaacgatttatactgggtttttgtttttgatggaattttgtacctttttttttttttttttgcaaaagccgctttttaccagatggccttttttttgcctttgggcctcccaaaagagcccgggttttgggcccca

SEQ ID NO: 669733 - DNA, 100 bp, Homo sapiens
ggttaaaaattaaataatttcggtaagacaagaatcccattggtaaccctctttgcctaaagggttaagaattgaaataactattactctgtattttcca

SEQ ID NO: 669734 - DNA, 226 bp, Homo sapiens
cacgaggcctggggcaacttccactcactggctgaaggcataaattgggctggagtgtgcatcaatgacacagatcaagtgaaagccggtacgtgccaaggtcgttaacaaccagctctggggggactaatataactcaatcactgtccccacctcgggggatactctcataaatatattggggatatcatgatgacttacatgcactgccctgatatatttatcc

SEQ ID NO: 669735 - DNA, 117 bp, Homo sapiens
ggaccggcgtttgcgttgtccttacgacgagctcaagaaggtgatctaaggccgcggcctcctccacacacacacacacaccaggtgaaccaagagaaccactgtagaatcctcaac

SEQ ID NO: 669736 - DNA, 588 bp, Homo sapiens
  misc_feature (270)..(270): n is a, c, g, or t
  misc_feature (388)..(388): n is a, c, g, or t
  misc_feature (391)..(391): n is a, c, g, or t
  misc_feature (398)..(398): n is a, c, g, or t
  misc_feature (417)..(417): n is a, c, g, or t
  misc_feature (449)..(450): n is a, c, g, or t
  misc_feature (476)..(476): n is a, c, g, or t
  misc_feature (586)..(586): n is a, c, g, or t
aagccagcaaaacacaactgaatagttataaacatgacacttctaaatcctcaaatggaattccaagaccagagtgtgcttctccactttaatagcatttgttaaaactgaaatccacaacttctggcaagtacttcaatattctcaagcagaatcaatacttaaagaggttaaaagaaaaaactattatcaaacgtattgtctgtgggatgatctaatttaaaagcctttcatgcttgatcctggcagtgctattactgcacattttangtgaccatcatgggcacttttaagaacctaacttcacaaaaagagctgtcacaagaaaattgttctaaaatcccaatgcacagtaactcatgcctcatttcaactgctttcctcctgntgnaaaaacngctgcgtgcgaccttgganctgtgtgtcggtaaaataagtcggggaaaggnnttgccaaattggcccctttgtacaanacagagaagcccaaaattgtttgatcaggcaagaaaaaggtgacactttttagatacttcatattattctggaaagcactttcctttcagtgggtgcaaaataaactaangg

SEQ ID NO: 669737 - DNA, 673 bp, Homo sapiens
  misc_feature (19)..(19): n is a, c, g, or t
  misc_feature (157)..(157): n is a, c, g, or t
  misc_feature (252)..(252): n is a, c, g, or t
  misc_feature (362)..(362): n is a, c, g, or t
  misc_feature (512)..(512): n is a, c, g, or t
ggttggtaatcatgtattngttctggtctgtgttattgagtctgaagaggagtgggtaggagatggtgaaggataggatatagatgatggagattatgatggtgattggtgcttggagctgtagtgtgtattgtatagtatgggtatggttaatagntgtgtatttgtcgatgctgatggtatataagtttaggatgcttgtggtgtatattatgatgtttagagtgatgaagatgttatagtgaatcttgntgaatttttacttacttactacttctaggtagacaactcagggtatgatcagtgtggtgatgaggaggttggtcactgtgaggctgatgattaggtagttggtggtggtntgtagtgccttcttgtgggatacagccatgcacaccagcatgttgctgaagatgatgatagtgatgagcagggtgagcagtgtggtatagtagttgtagtggggtttgtctgccttcctgtctgacccgttgaagggccggctccagttntgcctctccagatcatcatcataccaggacagattcagtggatccatcagggcggtggagccactgggtggccaggctcttcaagccatagggcgccccggggcagagacggcgccggctgcttgaggcttccagctcccgccgcatccacgcgcggccgc

SEQ ID NO: 669738 - DNA, 283 bp, Homo sapiens
  misc_feature (77)..(77): n is a, c, g, or t
  misc_feature (128)..(128): n is a, c, g, or t
gggattctccccagacgccgagatgcgggtcatggcgccccgaaccctcatcctgctgctctcgggagccctggacnttaagagacctgtgcctgctcccactccatgaggtatttctacaccgccgngtcccggcccggccgcggagagccccgcttcatcgcagcgggctacgtggacgacacgcagttcgtgcagaacgacagcgacgccgcgagtccaagaggggagccgcgggcgccgtgggtggagcaggaggggccggagtattgggaccgggaga

SEQ ID NO: 669739 - DNA, 939 bp, Homo sapiens
ctgttttcggacgagaagacatggagagttgaagaagagcaacagaagaatatatcaatgtctctcgattatatgtctgttcattacgccttaccccgcgttgtttgacaccgttcgtccctcgtgtgttgcgccgtggtcgttaacgacccatttgtttgagaaacccgtttatcccttggtgctaccactcccaaatgggttctcccacacctatgacgcgtttctggggtcccaaaaaaacgtggtgccgttgcacttgcaaacacctctggggtagcatcaaatagttgccaccgatctttggggcatatgttgttccaacaatcgggaccggggttcctgtgaacaattgcttccgtgttccaacattcgctcttaaccacaacccctgttcgcctgttgtcctggcaattctggacggcgccatcttgatcgcggtgctccccatcattgggcaattcccacggatggccgccagacgcgccatcagaatctcgcgttgtggaccaccccggctaatgtccccccgaagaagggttgcgccacccactatcttattgtgtccccccgctgtctcgccgtttgcagaagcttttctgctaccccgcgggcctatacgctcaatgccttcgcagggcgaattagcacgccgtcctgccttttccccattttccaagaggcgtctcccgtacatatggagagttatctggccaaagaatcaccctctcatttagacgatcgagacaacctccacttcgtatggtgctactccatcgcggactctcaaagatggtgtaatcccctcccgccccccccttgttgttatgaagagatactggctgaagcaaaaatctgccggcgcccgccaccaccaaggagccactcttttcgccttgggaccaaccccaacgtggtccccaaacccccaacatgaca

SEQ ID NO: 669740 - DNA, 243 bp, Homo sapiens
gcgactacaggcatagcaccgtgctgggcagcttttgggtttatcaatataattgagggagacagggaacgaggagaaatgcttttatataatagtgtggaaatttttaattttatatcccacacatgcctggccccgtccattggttttcacatagcctattgcttacctgcgatggcctacaactagcttgtaccttagttccctaggttgtttgttcctttcttcatgcagcgtctcctg

SEQ ID NO: 669741 - DNA, 945 bp, Homo sapiens
  misc_feature (23)..(23): n is a, c, g, or t
  misc_feature (180)..(180): n is a, c, g, or t
  misc_feature (238)..(238): n is a, c, g, or t
  misc_feature (290)..(290): n is a, c, g, or t
  misc_feature (309)..(309): n is a, c, g, or t
  misc_feature (338)..(338): n is a, c, g, or t
  misc_feature (368)..(368): n is a, c, g, or t
  misc_feature (391)..(391): n is a, c, g, or t
  misc_feature (394)..(394): n is a, c, g, or t
  misc_feature (396)..(396): n is a, c, g, or t
  misc_feature (427)..(427): n is a, c, g, or t
  misc_feature (448)..(448): n is a, c, g, or t
  misc_feature (456)..(456): n is a, c, g, or t
  misc_feature (815)..(815): n is a, c, g, or t
  misc_feature (818)..(818): n is a, c, g, or t
  misc_feature (875)..(875): n is a, c, g, or t
  misc_feature (881)..(881): n is a, c, g, or t
  misc_feature (943)..(943): n is a, c, g, or t
gaaatcctttttaaaagggtcgnatattccttatgtctccaaaccaagtccatggatgcaaagacatgctgagttcttgttactctttcatgtcttaatacccaaaggagacagcacgggctcgagtcgtttcagctgccgcttaggtcaagtcacatcgcagctcatttgcggatagcnaggcacagaccacagcgcgtgagtgttttctggctttacctcctgccctggcaatgancctcagttccacatatttttgttttcttttttgtggtcctgttaaatttttncgccacacatcctgctgcncttcaatgatacaatttctcacaattccngaattctcttggcagtgcagtttacttggncaacgtggctaatcttataaatnttngnattacatcacaatagaacactattgcacatnttgccagtcagacaacatganccccaggnactgccatttccaaaacataactgggcacacatttacaatgcacctgctaggttttgaattcatttgtcatttctgatctacccttaagactatgcttgaatctctgaaaacaaatgctagattcatgatttctatacccacatactccataaatccatcacaaaccctacagtctgatttagcctacggcaaatgattcatccaataggccatggtatgttcacaattcttcaatcttattcaggttgtaaagacgtttttctacgactggagtcactaagaatttctctgtgagagaaagcatcattttcacctttggcacactgccaagatgatactttactacagaatttatganacnacaatttagtaacttgcaggctttattaaaagaaaaagaaaaacaaagaataatttnatatanccccatgtcccaaaactttctagtttttttttttttttttttttagtgcaagaaatgctgcntc

SEQ ID NO: 669742 - DNA, 364 bp, Homo sapiens
gtcgacccacgatcacatcaaagaagttgtgcgaatccagcgccgcacgccagccgaggtcgaggtcgccctggccttccttgagtttgttgtcatcattctttccgtacttcacttcaacaccagcctggtagatcaggccggattcggggatcatcttgttgccgaagttatagaacaggccaccagtgggcatatgacttttctcggactgactgccgccctccagcttgaagtggctgtagctgcccaggacgccgaattgggaaatagggtcggtggagggggccgccatcgcgatcatcggggtggcgatcactgccagggccgaggatttgatgaacaggtgagtcagacgattgaa

SEQ ID NO: 669743 - DNA, 373 bp, Homo sapiens
  misc_feature (65)..(65): n is a, c, g, or t
ggtcgctagattccgtagcaggcagcactcatctatgagagatggaacaacattgattgggagtntgtgagatcccagcatgtcactgtcatgagctgagttgaaatcatcatgttcacatctgatgcgatataaagtctctagatattgagaataggctgtgagagaagtaggagagatgcttccggaagcatatcgtaacgcgcggacatcttggagagaggatgatccttaattcttttgcagtatgcatcggttgggtcctataccccttggtaccttgggctggaagacagtaaaacaaccagtatatgtcgtagatgactccacaggaattgttactgcagttatggatcctgatgcgaatgcgaaa

SEQ ID NO: 669744 - DNA, 615 bp, Homo sapiens
gggctgaataaattctaggaacctgaggtccatatatagttgtattaaatatattgactgttttcttccttatgatgacaaaatgttttaagaaaagaaaaagaccctaaagaatagtcaccaaaattttgtagaaatgttcctttgtaggggatggtgggtatctgtctggttttttttttttttaaaaccttctttaaagaggcgtgtttgggtgttggccaacattttttacaaggaatataagggtgttttatcaccttgggtaacatgtgacttaaattgggtaatctggggaaaaaaagtgtttatcaattaaagcaaaggtgttcctataaattttagaaacagctaattcagtatgagaggcgtgatactaatcgggcccccaccttcagggcagccggtcctaaaggtgccaccatgtgaccattttcaaaacagggatttacttaaggcatttaattttcattagagctgaattgccatgggaaaaagaaagtatgggattctctcttaaatttgtaagtcattccggtaaacgtgtactcggaaaggttcagatgattctgataaatacatatacctgctacaggggatgtgtctccattgtgc

SEQ ID NO: 669745 - DNA, 375 bp, Homo sapiens
  misc_feature (1)..(1): n is a, c, g, or t
  misc_feature (217)..(217): n is a, c, g, or t
  misc_feature (280)..(280): n is a, c, g, or t
  misc_feature (304)..(304): n is a, c, g, or t
  misc_feature (332)..(332): n is a, c, g, or t
  misc_feature (351)..(351): n is a, c, g, or t
  misc_feature (361)..(361): n is a, c, g, or t
ncagtgagctctattgatgccactgcagccatcagccttctgggctcaagggatccttctgcctaagcttcctaagtagctgggactacagacgtaggccaccatgcctaattttttttttttttaattttctgtagacacagggtctcactatgttgcccaggctggtcttgaacttgtgggctcaaatgatcaattttcccacctcagcctcccnaagtgttggaattataggtttgagccactatacccagcctttaaaatattttttgtagagatnggggtcttgctatgttgcccaggntgttcttcaagctcctgggcctcaagtnattttctaccttgggcctnccaaaacttnctgggatttaaagg

SEQ ID NO: 669746 - DNA, 184 bp, Homo sapiens
aagatttgcactctcatggatgtggattaagaaagcagaacatgttatggcaagacaatggaattggtgaagaagatgagcgacactcaggggcattatcactcttgaaaaaccatattgacaatggctagatgtggcaagtgcacggaatgatcctgtttctaacagcacgttacatgatatc

SEQ ID NO: 669747 - DNA, 415 bp, Homo sapiens
tgccttgctggtcgtctctgcaggttccccgctcagccactggttgatgcccgtcattggttactacttgatgtcccaccgattcttcttactttacagactgcagcgagtgcctctcaggagttactgtttgtataatcgccggggggagcctcaccggttggcaccccgactctgctgctgctgttatggcgcatggtcttggtcgatcctcggagatctgaattacatccagtcaccctagatccatgccatagttttctgctatctctataaactctggtacaaactagcaaagatactggataactctatgcaataagcctggataaccagtcttctccatctcctccatttttgatcccaccactccgaatgtttgcatcattgctgttttatgctgctatactgccat

SEQ ID NO: 669748 - DNA, 596 bp, Homo sapiens
  misc_feature (36)..(36): n is a, c, g, or t
  misc_feature (77)..(79): n is a, c, g, or t
  misc_feature (82)..(83): n is a, c, g, or t
  misc_feature (86)..(87): n is a, c, g, or t
  misc_feature (89)..(89): n is a, c, g, or t
  misc_feature (91)..(91): n is a, c, g, or t
  misc_feature (149)..(149): n is a, c, g, or t
  misc_feature (167)..(167): n is a, c, g, or t
  misc_feature (196)..(196): n is a, c, g, or t
  misc_feature (213)..(213): n is a, c, g, or t
  misc_feature (224)..(224): n is a, c, g, or t
  misc_feature (252)..(255): n is a, c, g, or t
  misc_feature (281)..(281): n is a, c, g, or t
  misc_feature (294)..(294): n is a, c, g, or t
  misc_feature (310)..(310): n is a, c, g, or t
  misc_feature (316)..(316): n is a, c, g, or t
  misc_feature (360)..(360): n is a, c, g, or t
  misc_feature (367)..(367): n is a, c, g, or t
  misc_feature (370)..(370): n is a, c, g, or t
  misc_feature (380)..(384): n is a, c, g, or t
  misc_feature (403)..(403): n is a, c, g, or t
  misc_feature (456)..(456): n is a, c, g, or t
  misc_feature (475)..(476): n is a, c, g, or t
  misc_feature (500)..(500): n is a, c, g, or t
  misc_feature (516)..(516): n is a, c, g, or t
  misc_feature (518)..(518): n is a, c, g, or t
  misc_feature (528)..(528): n is a, c, g, or t
  misc_feature (570)..(570): n is a, c, g, or t
ctttctccaagggccacaaattgaactgaaggtcanaaggaagctgggtgcgggcttcctgcaagctcttgctccannnccnnccnntnangagagggcgctccggagctctggggaaggttggtgcacacaggggttccgttggaaanggagaagagccgccagcncacacacggtcactggattggtgtgagtnggttccaagcaactgcnatgtgctagtncactgacatgattaaaattaacattcannnngggcattaaattaaggaatgacacanggagccaagaaantggcttattcggttgnattctnaatcacaatcaggaaataatctttatctggtgcaaccataattncattttnatnggagcgaatnnnnnggaaggtgagatcgttctnggggtcgatgtcacgcacggtgctccgtgccttcaggatgaagctgtgcatcncgctggcatactgggtggnngtggggttgtccatggtgctcttnatgggaatcccttctntnttcacgacgntgattccctgcactcccttctggctctgcagtcgcttcactntctcctccacctctgccatttcccac

SEQ ID NO: 669749 - DNA, 142 bp, Homo sapiens
actgtctaggaatgcacgcatggctgcttcctgctggggtgacttaattccctcgagagtcgctactcttctgactttttgtatgcactccgttgcatctggtacactgcctagctatgttagctgcgaaattcttttcttg

SEQ ID NO: 669750 - DNA, 116 bp, Homo sapiens
tatcttctctcactatctcatcttatacatcgtagctggcttgggaattccacctcaatgcctgctatgatggataagatagagagagtgaggagaaggcttacgtttagtgaggg

SEQ ID NO: 669751 - DNA, 571 bp, Homo sapiens
gatgccccaagcttagcacctgcactcggagagctgtgtcaccatgtgggtcccggttgtcttcctcaccctgtccgtgacagtggattggtgctgcacccctacatcctgtcatcggattgtgggagggctgggagtgcgagaagccattcccaaccctggcaggtgcttgtggcctctcgtgggccgtgcagtctgcggcgggtgttctggtgcacccccgagtgggtccctcacatgttgcccactgcatcatggaaccaaagccgtgatcttgctgggttcggcccagccttgtgtcatcctgaagacacatggccaggtatttcaggtcagccacagcttcccacacctcgaatctacgatatgagcctcctgaagaatcgatacctcaggccaggtgatgactccaggcacgagctcatgctgctccgcctgtcagagcctgccgagctcacggatgctgtgaaggtcatggacctgcccaccccctggtgctgctcagtgtggtggatcatttcaaccgaatcggcaaggttggaaaccagaagcgtgttgcagtgtgcttccg

SEQ ID NO: 669752 - DNA, 576 bp, Homo sapiens
tattttttttgagacagagtctcattctgtcgcccagactggttggagtgcgatgatgcgatcgcggctaactgcaaccgctgcctcccgggtacaggtgattctcgtgccttgggctcccgagtagctgggatttttagtggagaacgggtttcaccgtgttggccaggctggtcttgaactcgcagcctcaggtgatccacccacctcagcctccccaaagtgttgggattgcagtgcattgagccaccatggcctgggccccctatttggtttggttttgagagggcgcggcgcgtgatagagagacgcgaggggtatctctctcaatagtgcttgtaagcacaaagagagggagaagtttgtgtaagtaacgaacagggccgggcatggtggcgtgagaggccgaggtgggcagatcacgaggtcaggagttcgagaccagcctgaccaacatggtgaaacccccgtctccactggaaatgcaaaaattggccgggcatggtggtgcacgcctgtagtccagctagtcgggaggctgaggcaggagagtcgcttgagcctgggaggtggagg

SEQ ID NO: 669753 - DNA, 319 bp, Homo sapiens
cgcttttcactttttgcatcagacttcagctgcagacccggataggagccaccgatcccagatcgaatggggcatgaactctaacctgccaattgcccattcttgaggtggcccaagggcacgtgctcaagatattcctttctatcaatggcacagagtgtctgcatcaacccgttgcaggcgcccatgagggcgtcggggccggagatgccattcctccccggccagcggctgatgcatgcggaatgcgcttcttccgggcatgctgtctccgcccaccccatgctcaaacctgcatcagcgctggcttgatgcggac

SEQ ID NO: 669754 - DNA, 444 bp, Homo sapiens
  misc_feature (34)..(34): n is a, c, g, or t
  misc_feature (179)..(179): n is a, c, g, or t
  misc_feature (242)..(242): n is a, c, g, or t
  misc_feature (274)..(274): n is a, c, g, or t
  misc_feature (307)..(307): n is a, c, g, or t
  misc_feature (340)..(340): n is a, c, g, or t
  misc_feature (352)..(352): n is a, c, g, or t
  misc_feature (361)..(361): n is a, c, g, or t
  misc_feature (367)..(367): n is a, c, g, or t
  misc_feature (372)..(372): n is a, c, g, or t
  misc_feature (394)..(394): n is a, c, g, or t
  misc_feature (423)..(423): n is a, c, g, or t
ggcgagacgggggtctcacacggtcacccaggcnggagtacaggggataacctcggctcacggcagcctccaccggccaggctcaagcaattctccggcctcagcctcccgagtagctgggattacaggctaccacatacggtggatggtgatgaaatgccagtggaagcaccggtccngcgagcttaggggtgctacaagtggaccacggcagcagtaaagatgactctgaagaagggcangggatggatcctttcgaatgcactggagcagnggtctccaaccacagggccacagagcgggagcnggatctaccatgaaagacctctgaatccaggangagagacggacngagcaacangttatncaggntctccatctgtggtccaaggcnggagtgtagtagtgctatcacagcggacngcagcctcaaccttccaggcg

SEQ ID NO: 669755 - DNA, 407 bp, Homo sapiens
  misc_feature (34)..(34): n is a, c, g, or t
  misc_feature (142)..(142): n is a, c, g, or t
  misc_feature (205)..(205): n is a, c, g, or t
  misc_feature (237)..(237): n is a, c, g, or t
  misc_feature (270)..(270): n is a, c, g, or t
  misc_feature (303)..(303): n is a, c, g, or t
  misc_feature (315)..(315): n is a, c, g, or t
  misc_feature (324)..(324): n is a, c, g, or t
  misc_feature (330)..(330): n is a, c, g, or t
  misc_feature (335)..(335): n is a, c, g, or t
  misc_feature (357)..(357): n is a, c, g, or t
  misc_feature (386)..(386): n is a, c, g, or t
ggcgagacgggggtctcacacggtcacccaggcnggagtacaggggataacctcggctcacggcagcctccaccggccaggctcaagcaattctccggcctcagcctcccgagtagctgggattacaggaagcaccggtccngcgagcttaggggtgctacaagtggaccacggcagcagtaaagatgactctgaagaagggcangggatggatcctttcgaatgcactggagcagnggtctccaaccacagggccacagagcgggagcnggatctaccatgaaagacctctgaatccaggangagagacggacngagcaacangttatncaggntctccatctgtggtccaaggcnggagtgtagtagtgctatcacagcggacngcagcctcaaccttccaggcg

SEQ ID NO: 669756 - DNA, 303 bp, Homo sapiens
  misc_feature (46)..(46): n is a, c, g, or t
  misc_feature (92)..(92): n is a, c, g, or t
  misc_feature (121)..(121): n is a, c, g, or t
  misc_feature (125)..(125): n is a, c, g, or t
  misc_feature (140)..(140): n is a, c, g, or t
  misc_feature (144)..(144): n is a, c, g, or t
  misc_feature (185)..(185): n is a, c, g, or t
  misc_feature (195)..(195): n is a, c, g, or t
  misc_feature (207)..(207): n is a, c, g, or t
  misc_feature (251)..(251): n is a, c, g, or t
  misc_feature (268)..(268): n is a, c, g, or t
ctggtaaaaaaattaatggcttcccttgaatttaaaccagctctanataggaaaaaaatcagtctcctcatttgctttttaaatggagtagnacatcccatattttagaacaagtaggggngccntgcttaaataaaaanagcntttaatgtataattgtgtgaagggtttatggataaaactgnacttctgtcncaatgtggcagnactttttgctttaaaattaaacagcttgttatttaaaaattggncaaaaaggctggcttcnaaaaaaagtcattaataaactaactttatgtgcca

SEQ ID NO: 669757 - DNA, 186 bp, Homo sapiens
gaaattatgcttttttgggttgtcgagggggcaaggggggacagaaaagtagcctcttcttaagtggactattctaataagctaccttttgtaggtgccaggtgtctcatctaatcataccaagtatggcatagatgtctgacggccaggggtttctttcaaggacagggtggcgggtagtaaaat

SEQ ID NO: 669758 - DNA, 197 bp, Homo sapiens
agataatgcgagcaaacaagacttgctgattacaaaggcacagcagacatgggaggcggtgcggcaagaaagggtgtgctagaaagccctttggttccctgggacagggaggcggaagagactcatgagcagtagcagcagaggaaacactttccacaaggaagagggacaacgtctgtcataatgagtcttcttca

SEQ ID NO: 669759 - DNA, 994 bp, Homo sapiens
gctctcgtccaggcgtactagtggaagtgacatcgtctttaaaccctgcgtggcaatccctgatgcaccgtggtgatgcccagggaatagagggcgaactggaatccaactacttccttaattatcatccaactattggatgattatccgaatgtgtcctcattggtgcgagagcagataatgtaggcgctctcgaaatgcatgtaatgtctatgccgagactaccgcaatgtcgcttcggaggtgaagtgcatgtggtgcttggatgccagtcaaagagagcaccgatgattgcgcagggccatccgagggcggccgtggaaaacgatccagctctgtataaattgctgtgtcatatacgcgggaatgtggccattgggtccgaccacacggagtgaccttcatatgtgaatcaggctgtactgtgtttgctggcactgattaagagtggcatctttgggtgcactcgggcttggctgcctgttgtcctgatgtggaggggatacgacttggtgcccatcggacaatgctaggtggatctggggcctgcagaatagcatcccgtttacacaggacttgaggtgtctccagtaagaagtctccagcggcactcctatggaattcctgaatgtatatgctcttggttcgagacgggtgatagaaaagtggcgtagacaattatagccatccactgaattcatttgcttactatgtaaccgcttatcctgtgtgtgtcatcacagatgtgaagcaatggctgatctaggacctgagtggtgatttcgggctggacatggctaactgctgaggcgcccagaatggaggcctgtgcagaactggtcacactctggggatcccatctgttagcgaaaaggaaagcggcgggaaaataactcagaaaggacttgtaaagtagacgacagagtaagggggggtacgatgaagaaaaaaagtgtgcaaaaaagggaccgtgactcacacggccttcgaaata

SEQ ID NO: 669760 - DNA, 124 bp, Homo sapiens
ggtgactggacttccaagggggtcacattacatcgtgggatattagatactggatagagggtgcttccagtaagatgacgtaggcgatgaacagcagggtctcacactccggcatctgaagttg

SEQ ID NO: 669761 - DNA, 106 bp, Homo sapiens
aaaacaaacaaaaacaacaacaaaaaaaaaacttatgtccgattcctttgggtttacaggcagaaatttacagggtagacacatttctttctggtactatcgcatg

SEQ ID NO: 669762 - DNA, 394 bp, Homo sapiens
  misc_feature (14)..(14): n is a, c, g, or t
  misc_feature (20)..(20): n is a, c, g, or t
  misc_feature (93)..(93): n is a, c, g, or t
  misc_feature (95)..(95): n is a, c, g, or t
  misc_feature (156)..(156): n is a, c, g, or t
  misc_feature (186)..(186): n is a, c, g, or t
  misc_feature (204)..(204): n is a, c, g, or t
  misc_feature (219)..(219): n is a, c, g, or t
  misc_feature (224)..(224): n is a, c, g, or t
  misc_feature (321)..(321): n is a, c, g, or t
  misc_feature (374)..(374): n is a, c, g, or t
  misc_feature (377)..(377): n is a, c, g, or t
tgggactcgcgatncggccngcggaagacgtgaagctctcgaggctcctccgctgcgggtcggcgctcgcctcgctctcctcgccctccgccncngccccggcccggcccgcgcccgccatggagaagactgagctgatcagaaggcaagctggcnagcagcgagcgctacgacgacatggccacntgcatgaaggcagtgacngagcagggcgccganctgtncaacgaggagcgcaacctgctctccgtggcctacaagaacgtggtcgggggccgcagtccgccctggaagggtcatctctagcatcgagcagaagancgacaccttcgacaagaagttgcaactgattaaaggactatcgggaagaagtnganttcgaactgagattcat

SEQ ID NO: 669763 - DNA, 1061 bp, Homo sapiens
gctgtcgaagggaggtggttgtgttatcgacatctgagggaacagatgtgctcgctaacggtggggcaactggagcgggggaaacgttttgaatacgccacatactgaagctggtgcacgatggtctcggggaacctgcgccagcagaatcctcccagggcccactggtgctgagcggcgaggtccctcgcaatctgggagtgcagtcgcagtgcggtgtcaggtaggtaacagatgatgcaaatgtggattcgcgtgaaatgatatgatgcactgatggtaggctgtcgggtgagaggtctcaagaatgtggtcatggaccaagaggagcgttgctgtgggtgtcgacgctgtggagtttgaagttgaagatagtcgtagtgcaccggtggagctacactagagagtgacacacgggcatatttgtaaactggaatttatcaagtaaaaacatttagagagaaggatgggaagtgcgagggagggagctagagggggaaatggttgctgcaggagcttggcactggtatggtgctaatactcttagatgcaaggggaaacgatcatggacatggttattgggggtgtaaaacgtagaatgatcattttgagcgtgtactatgtttataagggcaggatcatggccatatgcgaaggaagggaaaggaaattaatatataaatcacacagttgagtgcgtacaacaagttccaatcttcataattctcgggccatgggaccttcttggcccaagaatgacatcgaaaactctgcttgggagccattgcaacaatccgtagccatttggaattccattaatggcagattcttggggcgtaaagtggattctggaagatttgcaaaattgcacaagacgtcggtggatgtattgagagcgaatgggaacgtccaagagtgggaaatggcgggaataccagcaaaagatggttaaataaagcggaacagaataaggagacttaggaaacagcccattattataggcaaaggggaggacattggagattacaatgtttcatgagagaatgaaaagacacaggaaa

SEQ ID NO: 669764 - DNA, 180 bp, Homo sapiens
gaatgggttaattcctatattatacacattatatgtttagaacacaaatgggtcaggttacttagcaaaaaaaaagtataggaaaacaacactaattctatatattttattttttaaattatataaatacgagggggactcctcataaagtcaacctgaaggcttgcatgctgggcacgg

SEQ ID NO: 669765 - DNA, 120 bp, Homo sapiens
  misc_feature (7)..(7): n is a, c, g, or t
ggatccncccgcttccatcatccctatcatcagcaggtggcggccatgctcgacggcatgacgtcacccttcatcctttccgtacatagcttcacgccgcgcctggcgagcgatccggcg

SEQ ID NO: 669766 - DNA, 797 bp, Homo sapiens
ctggattggacagcatcagcttgcctcatcgagatgcacaagaagcggtactatgtcagcggaccaaagccacctatgaaagccattttcgaacagagtttattcgtccaccgactccactccacattcgtgaggatgaacttgcttggctaaaccccacggagcctgaccacgcgatccagtgggataaatcgatgtgtgttgaagaatagcactggtgtggagatcaaacgactacatggccaagagccttcaaaagccccttatcctctccccaagaagaaccacagctacttggcgcgttggcacaagaccccaaaatatgtctaccatattggcctcaccccagccaaacttcctgacttgtggaaaacaaccctttagtcgctatagcaaatgtgctgcacattaagtgcgccaagccagatcactgagtctgctctgtcctggtcactcatggagcatgtcttcacattcactggcagtcgtcctccgaccacatacagctcgttgatctacctccgtgaatttactacaccttctcatctcatccacatcgcatctgctgacagctgaacagaatccacggatcatgtatctgcagaaatcgacctgctgcgatcatgagtgttgtgtcacctcaacacgtggaacccggaagaacattgttcgccgccacggagcggttctcagaacaccagcctccggcattgagccgccgaaacaaaactgcggactccggcgccccactgcactggccgctccccccgatcggaacaacccatagagcataaaag

SEQ ID NO: 669767 - DNA, 156 bp, Homo sapiens
  misc_feature (85)..(85): n is a, c, g, or t
tcttctctaaaatcaaactcaaaaccatttcataaatcatagaaaaattttactatctaaaaaaaatacacaaatatatatcttnccacattttaacacacttttctctgaatatctcaactctcttcagccctcttcaagttaacatatccttta

SEQ ID NO: 669768 - DNA, 331 bp, Homo sapiens
  misc_feature (6)..(6): n is a, c, g, or t
  misc_feature (36)..(36): n is a, c, g, or t
  misc_feature (139)..(139): n is a, c, g, or t
attacnttgcagacagagttcagtgtgtcaaatcanagggcatgctgtccggtcctctggcagtctctatgggggtgccacagggttcaattctcgggccgactcttttctctgtatatatcaatgatgttgctcttgntgcgggcgattccctgatccacctctacgcagacgacaccattctatatactttcggcccgtcattggacactgtgctatcaaacctccaaacgagcttcaatgccatacagcactccttccgtggcctccaactgctcttaaacgcgagtaaaaccaaatgcatgcttttcaaccgatcgctggtcgacgc

SEQ ID NO: 669769 - DNA, 457 bp, Homo sapiens
  misc_feature (191)..(191): n is a, c, g, or t
  misc_feature (335)..(335): n is a, c, g, or t
  misc_feature (352)..(352): n is a, c, g, or t
  misc_feature (424)..(424): n is a, c, g, or t
cacggtcggtggactggggagccccctgggcgggcccagcgggcagtgagtgaacggctaccgagtgctccagcttaacggtatttggaggtcagcacggtgctcacagaagccaggaacttgtccagtggaggcgtgcaccgcaggtggtgaactcgtgcggtgagtgtgggcggccagggtcaccagcnaggcagtggcttagtgagcttgaagttgaccagggtccaccctgaagcttgtgctgcgtgcagtgtcgctcagaggcggacagcgctgttgggcatgttcgtccacagtgcgccacgtgcgttggtcatgcgcagtcggccacncttcttgcctgtggccncttaaccctgggcatgagcctgtggctcagtgtcgaacgttgcgggacagtaggtcttaggtggtagggtcnagaacagtaagggggatccctctagaagtcgaa

SEQ ID NO: 669770 - DNA, 188 bp, Homo sapiens
caatgattacaacctacaatttcaatgcccttccctcccacacaactcaaatggaatggaaactgattaacacatagaaaggaactggctggctcaccaggtttaagcatttgtttttacaaaaatggagtgggatatagggggtggtcaagttttactgggtaataacaatcatatctctctatgat

SEQ ID NO: 669771 - DNA, 358 bp, Homo sapiens
  misc_feature (358)..(358): n is a, c, g, or t
agccttaattagggacctgtgtgaatggctctacgagaggtcagatgtctcttacttttaaccagtgagattgagctgcccgcgaagagagcgggcatgacacacaaagacgagaagaccctatagggctttaatttattaatgcaaacagtacctaacaaacccacagggcctaaactatccaaacctggattactaagacattaccaggcgcgaactactatactcaattgagccaataacttgaccaacggaacacagttaccctatggataacagcgcaatcctattctagagaccatattaacaatagggtttacgaactctatgttggatcaagacattcctggtgcagcgn

SEQ ID NO: 669772 - DNA, 350 bp, Homo sapiens
agttacatgatacactcgagtcagtacctgtgggtagcagcaccctagggatcagttttgcaggtggtaaagccatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 669773 - DNA, 1171 bp, Homo sapiens
ggctccctgtctgccgcggagtgggcgggggcaggacgcgcatactccgtgccggagctgtccggggtcgtgatgccggccccgccttggtggcggctgccccctcgcggtccagaggcagacgcatcgcggtgggctcgtggtctccagccctggcctggtgaggagtggacctgtggtcttgctgtgacgctggtggactccgtgtgtgcctctgtgctgtgtggctgcggcacactgcatgtggcgtgtggctgtgccctggtgggtgcgtggggcctctgctgctgggcttgaccaggtgctccccatgagctgtcagccgcctgccacatgtgccagagcctggctcacagccacgaccgccgtgtcggctggccagacgggactcgcaggacggccacaaggcctagtggcaggacgcccggggcttggaacgtgcccccaggatgggacggccgggccaccccaagccgcggaaacgttaatcgagaatcgcgaacagctaatgcgacgcacgcacaaagctgggctcacagccacgttcccgctgcgcacggtctaatgggacttggggacttcacgccgatccagtgacgcggcgtttaccgcaacagcttcaaacaagcttagcatttcaagggccacacacctacgaggaaccgcacgcatagcacacactcagacgactgcacacgcctccaggttgacaaagcttacggtgggagcccatggcttcaagggtcacttaccagctgaggctctacccatttaagccattttccccgtgtatacttcccctctgcaacagccaaattctgactcacacacccaaggaccttttagcaggtcacgattgtctttcaattcgaccgaataggaaggccggaaaagtgacttgtgctctcgtaccgggtaccttctgcggacttgggaatttccttcctttaagctttgcccccaaaccaatcgcaaaatttccacccaaacccgaaccctttttgcaccattcaacgctcaacgcccttctctaaacagcggcgcacaccgattgcccaacaccgctatctaccgacaataaacaaaaccgttttaaccataacacacttgccaacggtctaacccaccaccctccttgtccaacaattgtcccttcacctcacccaccctc

SEQ ID NO: 669774 - DNA, 250 bp, Homo sapiens
tcctcaaaaagtccgggaagctgaaagtccccgaattggttgataccgtcaagctggccaagcacaaagagcttgctcccttcgatgagaactggttctacacgcgagctgcttccacagcgccgcacctgtaccccggggtggcgctgtgttggctccatgaccaagatctatggtggacgtcagagaaacgtcttcatgcccagccacttcagccgatgctccaagagtgtggccgccgggtcctcca

SEQ ID NO: 669775 - DNA, 1005 bp, Homo sapiens
cggcacgaggattaaagccatagattaactacttacaactaaaaaacactgaggttttccaaccagcagtatcacagatcacaggtattcttgtacagattaagtgactctagtattcttttttattaggcaaaagagatttcactagcagacctccaggagaattatattgaggcattaaataaattagtgtctgaaaatcaacaactacagaaagatttgatgaataccaaatctcagctggagatttctactagatgtgcaaaaaacaaaatgacaggatctttaaaccaacacacagcagaacaactgagttcaagaatacagagttcaagccaacccatggccagcacagacatgatggaataaagactgagcactacaaaacagatcttcattctccaagaggacaagcgtcggatagtataaaccccatgtctagggtgctaagccccctgagtcctcaaatcagccctgtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctagaaaattttctcatacgaatatttattatcataaagtgatacttaccttgctgacttaaatgtgaatagctatgtactaattgaaataaggattttatgatacatgttgaaaataaagtaactgcaggaactttcttta

SEQ ID NO: 669776 - DNA, 258 bp, Homo sapiens
  misc_feature (147)..(147): n is a, c, g, or t
taccgactcactctgtgctccggagtacctgggaccacggcgttacaccacacccggctaatttgtatttttattagagacggggttttgccatgttggccaggcaggtctcgaactcctgacctcaggtgatccacccaccttggnctcccaaagtgctgggaatacaggcttgagccactgtgcccagaccaccctacctgccccccaccaccaattttttttttttttttaaacagatgaggcacagattgcagt

SEQ ID NO: 669777 - DNA, 992 bp, Homo sapiens
  misc_feature (389)..(389): n is a, c, g, or t
  misc_feature (400)..(400): n is a, c, g, or t
  misc_feature (443)..(444): n is a, c, g, or t
  misc_feature (499)..(499): n is a, c, g, or t
  misc_feature (519)..(519): n is a, c, g, or t
  misc_feature (541)..(541): n is a, c, g, or t
  misc_feature (546)..(546): n is a, c, g, or t
  misc_feature (564)..(564): n is a, c, g, or t
  misc_feature (588)..(588): n is a, c, g, or t
gctccactgccagacccaggcctgcccacctctctcctggcctcagcgacatggacatccttctgggtacagccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggaccaccttcagctttggggtggtagtgctagagaccttggctggtcagagggctgtgaagacgcacggngccaggaccangtatctgaaagacctggtggaagaggaggctgaggaggctggnngtggctttgagaagcacccagagcacactgcaagcaggtctggctgcagatgccntgggctgctcccatcgccantgcagatctacaagaagcaccntgganccccaggcccggggcccntgccaccatgagctgggcctgggncctgggcagctcgcctgctgcttgccttgcacctgccgggcgcaaaagggaggccctcctatgaccccagtgtgtaccgagacggctagaagaagctgcatggcagtgggtggcgtggggttgccctgggcatttggacggccgccatgctgcatcccccctttccccggcaggagaccctcctacaggtgtccagcactggtcagagccccacagtggggcttgctccatgtgcagccccttggcagcgccaatcaggagccaagtgcccaaggcagccagagcagcttgcagagaggccccaagcagcccgtggacgagttgacgagagcctaagcggcctctctgctgccctgtgctcctggcacttgaactccaagcttgcctctggaaccaggaaccca

SEQ ID NO: 669778 - DNA, 702 bp, Homo sapiens
ggcaggtgaacctgatgtcctcaccaatggcgggcacaggtttgggtggctggagatgttgtggtggatgcgactgccgtagttatgtgattcaacggttagtgaatgcccctggtgtgcgggatagcggcgtgcagtccgtctggctggacgggaggaaggcatcgcagagtaaccgagccatagctagagaactaccatgagtctaccgtgatgagtcccggagttattctgcgctttgaaagctgtcagtactgagacggtgaatttgacgagagctggctgactacgacaaaccagagtttgacattgcttcgagttattgacaatcggatgatgatggcttcctagaccctcactgccttctggttccaagtgagtgactttgactgaactggttcgagaatgtgctatataattcctatgtgtcccagtttagagcatcatatgcatgttgtaggaattggagtaatctggggaactatgtgtctacatgccattgtgattgctaaatgacgctgggaaattgatactaccagtcgtaagaaatctagcattccatagtggacttgtacaactcgggcacacgacaggaagactgtcacgcaacggtttacagcaacatgaccttgtgtttcctgcgaattctaaagccttgcaccacgatgaagcagaaagcaatgccaaggttcaacgagctgg

SEQ ID NO: 669779 - DNA, 922 bp, Homo sapiens
  misc_feature (373)..(374): n is a, c, g, or t
  misc_feature (429)..(429): n is a, c, g, or t
  misc_feature (449)..(449): n is a, c, g, or t
  misc_feature (471)..(471): n is a, c, g, or t
  misc_feature (476)..(476): n is a, c, g, or t
  misc_feature (494)..(494): n is a, c, g, or t
  misc_feature (518)..(518): n is a, c, g, or t
gctccactgccagacccaggcctgcccacctctctcctggcctcagcgacatggacatccttctgggtacagccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggaccaccttcagctttggggtgacctggtggaagaggaggctgaggaggctggnngtggctttgagaagcacccagagcacactgcaagcaggtctggctgcagatgccntgggctgctcccatcgccantgcagatctacaagaagcaccntgganccccaggcccggggcccntgccaccatgagctgggcctgggncctgggcagctcgcctgctgcttgccttgcacctgccgggcgcaaaagggaggccctcctatgaccccagtgtgtaccgagacggctagaagaagctgcatggcagtgggtggcgtggggttgccctgggcatttggacggccgccatgctgcatcccccctttccccggcaggagaccctcctacaggtgtccagcactggtcagagccccacagtggggcttgctccatgtgcagccccttggcagcgccaatcaggagccaagtgcccaaggcagccagagcagcttgcagagaggccccaagcagcccgtggacgagttgacgagagcctaagcggcctctctgctgccctgtgctcctggcacttgaactccaagcttgcctctggaaccaggaaccca

SEQ ID NO: 669780 - DNA, 634 bp, Homo sapiens
  misc_feature (588)..(588): n is a, c, g, or t
tacgctctatgacgggactagacggcacactataatcccagcactttgggaggcgaggagggtggatcaagaggtcaggagttcaagaccagcctggccaatgtggtgaaaccctgtctctactggaaatacaaaaattggcttggcatggtggtgtgcgcctgtggtcccagcttctcgggaggctgaggcaggagaatcgcctggacccgggaggtggaggttccattgagccaagatcatgccactgactccagcctgggcaacagactgaggctctgtctcaaaaaaaagaaaaaaaaaggcattcagtttgataagggaagcagagcataaaagttggggaaattggcagcctgacaatgtgatagtaaagaaaatcccattttctgagaggaaattcaagcgggctgcaaaaatgggcataagtaccaaggagccgaatgttaatatccaagacaagggggaaaatatctcccagacatgtcagaggtcttcatggcagcccctcccatcaacaggtccagagggctaggaggaaaaagtggttttgtgggcagcacccagggtccccatgctatgtgcagnctagggacttggtggcgtgcgtctcagctcctccagtggtgactga

SEQ ID NO: 669781 - DNA, 880 bp, Homo sapiens
  misc_feature (191)..(191): n is a, c, g, or t
  misc_feature (335)..(335): n is a, c, g, or t
  misc_feature (342)..(342): n is a, c, g, or t
  misc_feature (368)..(368): n is a, c, g, or t
  misc_feature (393)..(393): n is a, c, g, or t
  misc_feature (396)..(397): n is a, c, g, or t
  misc_feature (433)..(434): n is a, c, g, or t
  misc_feature (450)..(450): n is a, c, g, or t
  misc_feature (473)..(473): n is a, c, g, or t
  misc_feature (495)..(495): n is a, c, g, or t
  misc_feature (497)..(497): n is a, c, g, or t
  misc_feature (510)..(510): n is a, c, g, or t
  misc_feature (517)..(517): n is a, c, g, or t
  misc_feature (545)..(545): n is a, c, g, or t
  misc_feature (547)..(548): n is a, c, g, or t
  misc_feature (557)..(558): n is a, c, g, or t
  misc_feature (565)..(565): n is a, c, g, or t
  misc_feature (638)..(638): n is a, c, g, or t
  misc_feature (650)..(651): n is a, c, g, or t
  misc_feature (669)..(669): n is a, c, g, or t
  misc_feature (683)..(685): n is a, c, g, or t
  misc_feature (692)..(692): n is a, c, g, or t
agcgggctgcgccggggcctcagatcgaggctgcctccccctctcagccggcagcacattccgtcgccttgccgcgcccggcccacagtgtctttgccggagctgcagtcgcgctggggttagggcgggggggcgggcggggagaggagaaggccgcggcggaggcaggtgagaggaggaaggaagcggcnggcgcggcgggcacagcagctcaggcggctggcccggttcctgggagtgtcggtgcggcgcgttggttggggcggatcccgcggggcccgggcgggggaaggagtcaccggcccggcatggcggacaacgagaaactggacaancaacggntcaagaatttcaagaacaaaggccgngacttggagactatgagaagacaangcnntgaagttgtagttgaacttcaggacgaactaagagnngatgaacatctcttanagagaaggaatgtaccacatgangatatctgtgaagactctgatntngatggtgattatngagtgcnaaatacctctctagaagctattgttcananntgcttcacnntgataanccaaggaattcaattaccgtgcatgttcaagctgctaggaaggcttttgtccagtgatcgacaatccaccaanttgatgactttnntaacctctggaatattgnccattttagtccannngtcttgncaccggagcatgaccaaatcctgttcttttacacgtcttgacagcttgccattgggcctttcggacaaaacatttggccattcttgggacacttcctgagacaaaacttcaacgccaggtagttcacgctcccgatggctgtggcccatttttcctgaaggcttctaccatttgacccattccgaatg

SEQ ID NO: 669782 - DNA, 1079 bp, Homo sapiens
  misc_feature (24)..(24): n is a, c, g, or t
  misc_feature (69)..(69): n is a, c, g, or t
  misc_feature (83)..(83): n is a, c, g, or t
  misc_feature (375)..(375): n is a, c, g, or t
ggtctgggctcggggcgcggggcngtcagctctatgttcgcggtcttaacctctcctctggccgagtcnttgcaagaagtganttacccgaccctgcaaaacacttactattttggagtttaaagtatgtcatcatggcaaagtttcggagaaggacttgcatcattttggcactttttattctatttattttctctctgatgatgggtttaaaaatgctgagaccaaatacagctacttttggagctccttttggacttgaccttcttccagaacttcatcaacgaactattcatttggggaaaaattttgatttccaaaagagtgacagaatcaacagtgaaacaaataccaagaatttaaaaagtgttgaantcactatgaaaccttccaaagcctctgaacttaacttggatgaactaccacctctgaacaattatctacatgtattttattacagttggtatggaaatccacaatttgatggtaaatatatacattggaatcatccagtgttagagcattgggaccctagaatagccaagaattatccacaagggagacacaaccctccagatgacattggctccagcttttatcctgaattgggaagttacagttctcgggatccttctgtcatagaaactcacatgagacaaatgcgctcagcttcaattggtaattattgtatatatatatatatgtgtgtgtttgtgtctgtatatatgcatataaatgattttttgtgtaactttactagttaattttctcattattattaattatattgttaagctcatacctccaaattaaactgtatgtatgatcttaaacatccaggcaaccacattttaacactgcccttagtgtatattgtttaatttttacattttggagcatttctggatatattgttgatttctaatttaattcactttctcaattttattaaattatgatttacataaaatacaatgaatttcccactttaagtttacagctcattgatgttactcaaaagtatatacctgtttgaataccaccccaatcaagaagtaaaatatttctatagcccaaaa

SEQ ID NO: 669783 - DNA, 382 bp, Homo sapiens
  misc_feature (19)..(19): n is a, c, g, or t
cctagttttagaagtttcnatagcaagtaaataagagcaaagaatttatttcttaattcaaaactatacgtttgaattcaatatggtataacttaaagtggtataatacatacaatgcatgaatcataatggattcttttataagttattaatttttatggtttaatcagtctaattgttttgactgttatagaaaccaaatattttactgtttcttttaaggactaatattgtcaaaaactgctgttattaacttcacttgagttgtttaacttccttctgttttaagattgtaattaaaaattactattttgttatatggaatggttaatttttacctaataaaaacatagatgaaatacattgtattttaaaaaaaaaa

SEQ ID NO: 669784 - DNA, 4584 bp, Homo sapiens
  misc_feature (24)..(24): n is a, c, g, or t
  misc_feature (69)..(69): n is a, c, g, or t
  misc_feature (83)..(83): n is a, c, g, or t
  misc_feature (375)..(375): n is a, c, g, or t
  misc_feature (3397)..(3397): n is a, c, g, or t
ggtctgggctcggggcgcggggcngtcagctctatgttcgcggtcttaacctctcctctggccgagtcnttgcaagaagtganttacccgaccctgcaaaacacttactattttggagtttaaagtatgtcatcatggcaaagtttcggagaaggacttgcatcattttggcactttttattctatttattttctctctgatgatgggtttaaaaatgctgagaccaaatacagctacttttggagctccttttggacttgaccttcttccagaacttcatcaacgaactattcatttggggaaaaattttgatttccaaaagagtgacagaatcaacagtgaaacaaataccaagaatttaaaaagtgttgaantcactatgaaaccttccaaagcctctgaacttaacttggatgaactaccacctctgaacaattatctacatgtattttattacagttggtatggaaatccacaatttgatggtaaatatatacattggaatcatccagtgttagagcattgggaccctagaatagccaagaattatccacaagggagacacaaccctccagatgacattggctccagcttttatcctgaattgggaagttacagttctcgggatccttctgtcatagaaactcacatgagacaaatgcgctcagcttcaattggtgtactagccctctcttggtacccacctgatgtaaatgatgaaaatggagaacctactgataacttggtacccactattttggataaagctcataaatataacctaaaggttacttttcacatagaaccatatagcaatcgagatgatcaaaacatgtacaaaaatgtcaagtatattatagacaaatatggaaatcatccggccttttacaggtacaagacgaagactggcaatgctcttcctatgttttatgtctatgattcctatattaccaagcctgaaaaatgggccaatctgttaaccacctcagggtctcggagtattcgcaattctccttatgatggactgtttattgcccttctggtagaagaaaaacataagtatgatattcttcaaagtggttttgatggaatttacacatattttgccacaaatggctttacttatggctcatcacatcagaattgggctagcctaaaattaatttgtgataaatacaacttaatatttatcccaagtgtgggcccaggatacatagataccagcatccgtccatggaacacgcaaaacactcggaaccgaatcaatgggaagtattatgaaattggtctgagtgccgcacttcagacacgccccagcttaatttctatcacctcttttaatgagtggcatgaaggaactcagattgaaaaagctgttcccaaaagaaccagtaatacagtgtacctagattaccgtcctcataaaccaggtctttacctagaactgactcgcaagtggtctgaaaaatacagtaaggaaagagcaacttatgcattagatcgccagctgcctgtttcttaatgcattgattaaagtttaatagttatcaaaatcacctaatttttaaaaatagctttcgttttgagttctggaaagaaaactgtcaaaatcagtatatactattagttatatttaaaaatatttttttaaattctttacagataatattatacttgttacccttcacaataccacatgagaaaatatctgagacaaaatgtatacaaatatattccttatggcataatttattgcatttctgactgaaatcaaaattctgatttgatggcaattgaattttcattttacaatagataaatgcttgtgttacctaaagcacttagcacacagttaaattatatttacatcctagacccaaataaataggattgtgtgtatatttgggatatctattgaagaaaaaaagaaaaccccttaaagataatgtacatgcttcatgtcatgtctttaaaataatttaatcaactttattgtcttagtatttagactctggataactctacaataatgaggaaattcttaagaataacaaaatcactgtaccttcctctcaattttgctgtgaacctgaaatggctttaaattaatactcttattttttatttaatttaattacataaattaaaccttaccatgaccaaattgtgttaggaaggcctgctatctacagcacagtgtgtcatttgcagatttgtggttacctataccacgctaggtgttttgacatgtttagtgtttctgctttacagtgctgaattccatattttagaagctatgaaagtccttttatgaaaaagttactgattgcttctcagttattaggaaaacagttgtttcacaattattatgtagatatgatgcccaaatatcatttttagtatatcttgtcgatctttaagttgttactattgtgttattcatgtctttaaatcagataccaaatattttttaggaaagaaaaatgttattactgtcattaggttgtcttttaatactttaagttattttgacgaaaagtaatagagaaaatttacttagcattttagattctagagacatggaaatgaaaattattttatgtctagagtaggtcctgaagtttggctttacattaagtttagcactgtatcagaatgaagaaactaatattttacataaaaactaatactttcaattttttatatagtaatatccccattttgtaaatgttagacttttatcatacctgtaagttaaaatacttgttatcaataacttgtcatattgtgacaaattgatcacttgtgtacgaaaaataaatctccttaaaaactaaataaaatgcactgtattcttacagttaatgtttataactatagtaaaaaattaatatatatcctattacataaatgttatttcttaggtgttccattaagaagagcaatagaataatgctaaaaaataatgcctataaatcttcagagtataaagacatccattcagaaacaaaaattagcactaaattttttataaaatagaccagatgacaaaatttattttatttttaaacagtggttttgacacaaattatgttattgaaaagcattattaatgtttaatttatttaaaattttggaatttgccatttctcagacaatgatcaggccttaggaaattaatacagtagtagtaatcattttctaggggaaaataaaagaataaatcactatactgatattttgatataagcaagcacttacatggtaatcactatatagatccaacctgtggattttcttcttatgtccatttaactagaatatattattttaggtataatttacaaatgtcacacctaataatcttttataatataccatatttcattaaagttntgttagagaagtatctaccacagaggagtttttgtcattgtgtacgttgtgtatttgaacccaccatgacagaaagtaaattttaggaaatagttatgagattaagggaaaatctataaaaacaaggttagcatattctcaacacagataccaccactttctttttcccattatagacatggtgaatccacacagcatacttcatctctgagctttgttgtgattcctcaacacattaccctaaccagccagcagtaacagatttcagagtaagataaagcagattctgtcttcattgcaaaaagttattctcaatggaagaatggcatctgatctcataattactagtttatattaatatagtttttttctccctttttaataaaataattacagtcatccctcagtgtctgtgggggattggttccagttacccctatagataccaaaatctgcagatgctcaagtccctgatataaactggcatagtagttgcatataatctatgcacatcctcctgtatacattaagtcatctctagattatttataacacttaatacaatgtaaatgctatgtagttgttataccatactggttagtgaataattacatgaaaaaaaagagtctgtacatcttcagagtttcagtcggcaatttcttggccatggatgtagaacctacagataaggtgagccaactgcattaggaaataactctaataattctgttaattcttagagaggaaaactttcaaaatcttcctcaggtatttattacaactgcctttaccattttagttgtaacacagtttaaattgttatgataacaagtaaataagagcaaagaatttatttcttaattcaaaactatacgtttgaattcaatatggtataacttaaagtggtataatacatacaatgcatgaatcataatggattcttttataagttattaatttttatggtttaatcagtctaattgttttgactgttatagaaaccaaatattttactgtttcttttaaggactaatattgtcaaaaactgctgttattaacttcacttgagttgtttaacttccttctgttttaagattgtaattaaaaattactattttgttatatggaatggttaatttttacctaataaaaacatagatgaaatacattgtattttaaaaaaaaaa

SEQ ID NO: 669785 - DNA, 283 bp, Homo sapiens
ccccctttaaacccattttttttcccctttttttatttttaacctttggggggcttccggcccctttgggccctgggggggcctttcccctgggttcccccctttcccaattttctggttttaaaaacctgggccatggttttttgggccctttttcccgggggcccctttttttttggccccttttaaaggggttttttgggtcccggcccttttttttggcttttcccccttttggggggtttcccggttgcccctttggttttgggggggttttggggga

SEQ ID NO: 669786 - DNA, 129 bp, Homo sapiens
aggctgcgctcaaagacaagcgagatcatgctatggaccgtgctgaaaagagagacctgctcctgccttgaagaaatgcgaaatttcttcatttctgggcttgaataggccctgcttcttctttgagat

SEQ ID NO: 669787 - DNA, 165 bp, Homo sapiens
gagcctggtccccctctagaggagctgttctgtaatcgataaaccccatcaacctcaccacctcttgctcagcctatatacctgccatcttcagcaaaccctgatgaatggctacaaatgtaatgctgcaagtacccacgtaaatgacgttagtgtctacctgtg

SEQ ID NO: 669788 - DNA, 306 bp, Homo sapiens
tttaatgccaacaaagacgcaccaggttgtgggggcaattttgctgaacccagtgggggcaagatgcttgtcaaagcaaaagcatcctctttacttcctccatccaatatgcagaggaagtggtaaggatggcatccgcatgcgcagcgtaaaagtgcacggcagtttaatgagagctcacgattatgggccaggcaccatacccactagccatgaactaactctgtggattctcacgcagctcttcagagccagaactactagtgcctgtctatcatagaggaagaaagggagacacatacagcc

SEQ ID NO: 669789 - DNA, 291 bp, Homo sapiens
acgggcagtatgaaatcttaaaagagcacaggacttggaagcaaccaagatacccttgaataggtgaatggataaaccatggtatacccagatgatggaaatatgatttagcactaaaaagaaatgaactatcaagtcaagaaaaggcatggaggaaactaaagtgcatattactaagtgaaagaagccaatctgaacaggctacatactgcatgacttcaactatatgacattccagaaaaggaaaaactatggaggcaatagaaggatcaggggctgatgggagcaaga

SEQ ID NO: 669790 - DNA, 406 bp, Homo sapiens
  misc_feature (134)..(135): n is a, c, g, or t
  misc_feature (247)..(247): n is a, c, g, or t
  misc_feature (347)..(347): n is a, c, g, or t
gctttcctgtcaccttcttctaactcttcttaatggtattttgttcgccaaatttttggggtaaaagacttttttttaatgaggtacttctttctttgaaggttttcaggcggtcaacttgtcgcctttttcanntgcaacactgtgaaggttatcacgtgtggctaatcgcacacaggctcttcaccctaccgcgatgtcttacttttgaggttaggtcgccatacacagaaccacgtgtatgttntacttcttcaccatttagagtgtgccctatctgtgtttccacacatagtccacattctttgtgtttaagtcgccttatagttttacacaggttcactttnttacaggtgctatttactgaagttatttattaaatatgcctaaaatacttaaaaaccaa

SEQ ID NO: 669791 - DNA, 139 bp, Homo sapiens
gcgaggaaagacaaagtccgcaccatgctggttaggcagatccaggaagagtcactgaggacctagctcttcacctacagcagtgtctataactccatcagcatggagccgctgtcagacatgtctgagctggtatact

SEQ ID NO: 669792 - DNA, 152 bp, Homo sapiens
ttgtgtagacgttcagtgaggagagtgccgtcatatgttcgttgcctgaggaagattggtagtgggtgagggtggttctaattaataaataaatgtatccgtgctattacggctatgaaagaatagtgtcgaggccccctgcgccgtattcg

SEQ ID NO: 669793 - DNA, 374 bp, Homo sapiens
ggaccgctgatcgcttagggaacagcgaggagaagaacagccttatgtcaggcagtcactgtgggagagccctactgagaactggccattacgaccaaatactctaagggactcccccaaaaaacagacagagaggatgagctttaaagtccttctgtgtctgaaatttggaatcccaggaaaccataagagggaagatattgactgggatgggctcaattctgtaatgaagcaatgcaaactgcagcttgcctattcgtatgtagtttgtaccactctcaaatgttggcaaagatatggagagacaggaactctgcactactggtccgagggtagattagtgcaatcaccttgtctatctaagcggatcagcc

SEQ ID NO: 669794 - DNA, 913 bp, Homo sapiens
ggaagagggtgtcgatgagtggtggtgactgagcggagcccggtgacaggatgtaggtgtggtataggagatctgcatatcctacatcggtgcgactagtaagccatgctaatttcagagaactcctggtgccaggcataaaattcacgcaccattctctgccgcagtgaaacgcttttgctccaggagagagttatgaccgtatctcaagactctgggctgggtgaatgttcagtagttggtgaccacgggaggaccttcggcatgaaggacatctgatattattccacgaaacagtaacaggttgttgactgtatggacaagttcaaaagattggtcttggatccatggacaatcaatgttaattccatgcgggaggatattggccctagccttagccactgtctgcaggtagggcaattgtgatgtggacccttactatattctcggggaccacgacatcacaaacattttgaagcatttgacgcatggaatcatccaattctactattaatccaagggtctgccactgggtccactataatgccttggaagacaacctattattccatccttcgtggttggcctggcatacttccagggctttctagcagggctcccctaatgtgtatcagctaactgtgagcatgcatgtgacaagtacaagcggaattcgaattacgacggaacctttaaggcccgggcctgtctggcattgactaggggtggaattcattggtcctgttagaaatccaggtaatagacttaagcagccacgaaatgtttcactttggaatatctggcggaacgatattcccctcctgttcatcactatgcgtgcgggtccgtccgtataagtattgggtagattaggtcttgaaagtgccccgatgggcggaaacatccgggttcg

SEQ ID NO: 669795 - DNA, 160 bp, Homo sapiens
atagatatgagaagatggcagagccgaacgtaaggatgccgaggaatggttcttcaccaatgacatgaggagctgaaccgctgaggtgccaccaacagcgagctggtgcagatgcggcaagagctgagatctcggagctccggcgcaccattgcagaacc

SEQ ID NO: 669796 - DNA, 164 bp, Homo sapiens
tctggcctgatgcactcctgataggctgaggactcagcaggagcaggcttgagtggtaagggattaggggagacttggaattcaatcttggacatgttgagtttgaggggcctattagacagttcctccaattcaatctactagaggccgggcgcggtggctca

SEQ ID NO: 669797 - DNA, 422 bp, Homo sapiens
  misc_feature (20)..(20): n is a, c, g, or t
  misc_feature (204)..(204): n is a, c, g, or t
  misc_feature (321)..(321): n is a, c, g, or t
caagaaattatttctttttnattttgttttgttttgtgtgtgagacagagtctcgctctgttgcccagactggagtgcactggcacaatcttggctctatgcaacctctgcctcccgggttcaagtgactctcccgcctcagcctcccgagtagctgggaccacaggcgcccgccaccatgcccggctaacttttgtaattttnagtagagacggggtttcaccatgttggccagactggtctcaaactcctaacctcaggcaatccatctgccttggcctcccaaagtgctgcgaattgtagggcgtgagccacttgcanctgggcccagatggatttataattcttaggccaaattaaaggaatactgacttaaggccagttaagtaaaatctttaattggacaagttggttgtaatttt

SEQ ID NO: 669798 - DNA, 93 bp, Homo sapiens
gagacagccctgagatcacctaaaaagctgctaccaagacagccacgaagatcctaccaaaaaaacaaaacaaacaaacaacacaaaaaacat

SEQ ID NO: 669799 - DNA, 413 bp, Homo sapiens
  misc_feature (133)..(133): n is a, c, g, or t
  misc_feature (136)..(136): n is a, c, g, or t
  misc_feature (159)..(159): n is a, c, g, or t
  misc_feature (171)..(171): n is a, c, g, or t
  misc_feature (179)..(179): n is a, c, g, or t
ctcgggtggccgaggggcttcataccagctgaagagcgacaaccgctggagccgcggatctcaccgccgctcagggtttttagaacttcagccataaaaatgggcagaattttccgtggttggggagttgccngcntgggcgtggtggccaaggccagngcgggggccggngcgaggcnttgttgccgtgggggggggggggggggggggggggggggggggggggggggggggggggggggggggggggggggggggggggggggggggggatttgcttgtgcaaactcgtgatacgatcctgaccaaccgctcagaactcatctccactcgtttcacaggcgccactggcagagcatttctttttaacaaggtagttaacctgcagtacagcgaagttcaagatcgggtca

SEQ ID NO: 669800 - DNA, 739 bp, Homo sapiens
tgtgatggagatggggtctgctttgctgcccaggctggtcgtgaactcctggcttgggagacagtcgctcctgaactcagacctcctaaagtgctgagggctttaatggtttcacattgaagcctgaagttgctaagacttaggttgtttcttatatctaggttggataagtacgatgaaagcgaacgcagagaagctttcacgttgtgagtactcgtaccagtgaaggatgcggtaatggcgaggaatagcagaataattggtgcttgtcaacagtttaagattctcctgtggatttgggtgagtgatcgttaaactgtttcgccaactctgccctaggatgtattcatttctctgtctaggctggtcggaatgggaagtttgatcatatctcttgtttggtgattccaagtacaactggatgacggagtattattgctgaaacactttgagcacgttgcgtctacgtagaaaccagttaacaagtgttatatctcataagaagaggtactgtcaagcagcgtgttcaaaacacaggtggcaatcagagtgcgcgccgcgcgcgaaggagcctggcgaattgaaaacgagtatagccggcgtactacagagggccccaaacgagagccgtcatgcgacacgaccccaggcagcaacgcccggagccgcagccgcacgccgcagaacacgaccaacggtgcgcacaggggggggtccacacgcgcaagcggcaagcgcg

SEQ ID NO: 669801 - DNA, 279 bp, Homo sapiens
ctgtatttagctactcggtagctgaggcaggagaatacttgaaccaggaggtggaggttgcaatgagccgagatcatgccactgcactccagcctgggtgacagattgagatttgtttccttaaaaaaaaaaaaaaaaagtttaaagagtttattgaatttacttgttgtaccttgtaagcacctcctcaactgcagtcggttaaaatactttgatttgacttgggatattgcttaattggtttaagttagcatttatttagtgcccacttgcttggcg

SEQ ID NO: 669802 - DNA, 1666 bp, Homo sapiens
  misc_feature (594)..(594): n is a, c, g, or t
  misc_feature (936)..(936): n is a, c, g, or t
ccgtggtatattttcccccgcgcggtagtatatgtgcgcgtcgctataacagaccaccaacgggctgttcccacgacacgcggggtgtttacaatgtggagaaagattgtttgcctcgtccgctgcgtgtttcttagaagaggatgaccccgccctttgcaaaagggcgccccacgccagttttgtggggcagaaggtgtagaataaatgccccgcccataaatattcctcggggcggtaagatgcaccaccaggagtctcctccacagaggctttgtgtgatgacgaaatagaggtgtcgccaagtactctctgtgccactgaggccgcagcgattgcttggtccggccagaagcgcaccaacgtgagtgaaggacagtgttgttatttctccgcagagagaagctgttcgctgtttaccaacctgggggaaaaagggcgccgcccccatcggatccccccacacggaatggtataaatgttggtgttttccccgccacagttctcgtctgttgtgggggtaaaaaataggctcgtggagccccccccagtggccccccccactgagagataaactgggggaagggcgcggtnttggggacccccccacacggggaagttccctccgtttccataacaccaacagggcgccatcacttgtgtgacagaaggacccacgtttgttttaccgaacggcggtttaattgtataacaaccccttttgttaatcgtgtttccgcgtcgggccgtgtgtggtcctggtccgaagagtacgccgccacagagggtgtgttccccccccttgtggagagagacttccccaacgagggataatatattgggtggcgacaaatataatatcgagtataagcgttgctcctctccctgtggtgtctcacaaacccgtcgcgcggacaggagcgcttactaagtggntattactaccacggagagagttctctcggagtgtccctctgattgcaccccaacgtgcgcccccaggagtcctgtgagtccacccagggagaatgttctctcacacgcgcacatagtgtcacccacaggagagtgtgattctgcctttgtgtgacacacactgtcgttgtgtgtggtgagacacttttttttgtgtgggacaccatgtcacccccccacggagatagaccacacacagtccctctcacacagaaggggcgccacacaccccccaacaatgtgtgacactctgtgaaaatatggcgcccacatgttctagagacgtatctgtttgttctccccctctcacaacaggtgcgcacatttcacgccacagagagagagagaatattctcttctccacaagagagtggctccacgtgtcttctcccccactcccctttatcccctcgtcgccctctcttatactacactcttggaagttttcttcacacctctaagagagacctaattgtggaaaagaacaaagaacaataatccacagatttcacgttttccctatgagaaacttctgaggcacgccaccttatttcttggctaaaatagaacctcaccctgctcatgacccacgaagagcactttaggataaatagaggaccctaactgaaggaaatcccttgtatatgaaaggagttattttagaaaacccaataaaaatattttattcata

SEQ ID NO: 669803 - DNA, 225 bp, Homo sapiens
atattccagtaagttattttgctctcactgttttaacaaaaaaaaaaaaccaccacccataaaattccttgaatacctggtcaaatggggagagttttaatgttttcatttatcattgtaaacccagggacatttttatacctcttttgtacgaggctgttacatgtagggcattctgtctttaggtagggataaattactctaaacaaaagagtcctagatagt

SEQ ID NO: 669804 - DNA, 419 bp, Homo sapiens
  misc_feature (149)..(149): n is a, c, g, or t
  misc_feature (375)..(375): n is a, c, g, or t
  misc_feature (377)..(377): n is a, c, g, or t
  misc_feature (410)..(410): n is a, c, g, or t
ggtgggatgtgccattttcagtccacatttggggagaagcacgcgtgttcttaagtttttagtgggttctagtaagaatggatgttgatttttagaattctctcctgtttattttttaacattttgtggtgggaatttgtgaaagaatncgaagtcaagagcatggtacggtgaggacccagcaccatctccaacctccccggggtccacgtggggtctgcgtgtggccgcctgtccctcagcacgatgtctgggtgtaaatctgagacatcacagcatgcaggctgcagacgtaggcatctctacaaaagaaggatgcgtttacaggagaatcgcttgaacctgggaggcagaggttgcagtgaatcgagatcnangcactgccctccagcctgggcgacaaagccgantccgtctca

SEQ ID NO: 669805 - DNA, 247 bp, Homo sapiens
ataggacctgtcacataaatggaaacacacagttgtaactgggattggcttttatattcagggctaactccacctgaagatctatcgaactgggagcatgtatcagctggttcgttccatttctgtacgctgcaggagtattccatacgtcccacagctttgtttacaccgtttcactcagttgttctctagctctttttagcatattgtgaacaacagctgctatgaaccattcactgcatacggt

SEQ ID NO: 669806 - DNA, 261 bp, Homo sapiens
acgtggatgtctctcatgtgttttgtactatcaaaacaaacaggtacaatacactacaaccagctatgtctggcattgctacactttatctaccaatgacatccttctgtgcctacagttaagcagcttcaacccttctttatatccctacaagctaccttcatcttttcctgtatatgttactgcctactttttattgtagctatttcttgtttccttttttttttttttggtacagattttcactctcccaccctcggc

SEQ ID NO: 669807 - DNA, 281 bp, Homo sapiens
tcgtaccctcccggctgctcgggaggctgaggggggagaatcgcttgaacccgggaggcggaggttgcagtgagctgagatcgtgccaccgcactcccccagcctgggcaacagtgtgaaactctgtctcaaaaaaaaaaaaaaaaattccagtattttgctaaagtttccataaggtttccaggattctagttctcctttaggagggatgcctcttgatctcattattttggttttaagattgttgtgtggcacgagttctggtaggacaaggggaaaca

SEQ ID NO: 669808 - DNA, 212 bp, Homo sapiens
ctatagctcgcaccttcaggcttgattgcaggcctgcctctggctccgtggactgctgcttggctggtggtctccgcagctggaaaccaactccaaacgtcttctccttcgcggagaaggctgatgtggcctgaagaagccctgtgtgcactggcccttgcaccctacccctagccatctcgggagggccccgcctgcaatcaagcctggaa

SEQ ID NO: 669809 - DNA, 175 bp, Homo sapiens
ggcctccaggaccctcgaaacccaggccctagggagtttgctcaggaagttcggagtatgcagggctggacctgggaaagccggccgtcggctggtctgggccttaacttattctcgggccgtgcggctgctaggttgctgttattttgtgctaataaaagagtaattaattcca

SEQ ID NO: 669810 - DNA, 434 bp, Homo sapiens
gcaggcgcctactactactaaattcggcggccgtcgaccttctgaaagggtcaacacagacatctcaatgctgccaacttgcaggtagccggtgcccttgtgggaatagaaggcaagagagggccatgtgcagtgcctcacacttgtaatcccaacactttgggaggctgaggcaggaggatgaattgagcacaagaattagagactagcctgcctgggcaacatagtgagaccccgtccctacaaaaaataaagaattggctgggtatggtggcacatgcctgtagtctcagctagtcaggaggccggggtggaagggttacttgagcccaggaattcaaggttgcagtgagccgtgaccatgccattgcacttcagcctgagtgatgaaacaagacactttctcaaaaaaaaaaaacgaaaaatgtccccct

SEQ ID NO: 669811 - DNA, 99 bp, Homo sapiens
cggcacgaggatgtgagcctcgtgtcatttccggggtggccacagggtagatccccggtggttttgtgttcaaaataaaaagcctcagtgacccttgca

SEQ ID NO: 669812 - DNA, 1255 bp, Homo sapiens
ggtgacgtggccgctttccagtcattggtcgggtttcggtcggcttcagtgctcggggaggaggcagatgacggtcgcggatgagcattggcaagtggcggcgtgcggtcaggtcggcagagggtgcagtccgcaggttatgcgtcgtcaatgatcccgcggaaacgctacgggtctaagaacacggatcaggggtgctcataccatgggttctctcaaagacacaggtcctgtcccctggcaactgcgtggcagtagcagcagcgacatcgcgcgtgtctgacgtatgaagaggcagtctcaaacagaagaaccggcccgaatcggtctacttgtgaggtgaagccgatgcactgaaggacaagcagtgtaggtggtccttgtgaccaggccaaagatggatgacatcagcagattgattcccgacggtgacacacgtgtccgcatgaaccaggacaagaaagacagacgcagcaaagcccgcccatcgcacacagagccgaaaccgtgactgcatgacataggcccctgagtgcacgaagagtccgagcacgcagacagcacgctacgcgaccgagacacgaaccgtgccacctagtaacagaaccgacacaacaacaccagcagacacagaagtaccaacgccaagcccaagcaatgcacgcaagcccaggacaaaccgaacaacgcagcacacaagaccacacaagcaagaacaaagcagagcaggcagtcaacgaagggccaaacactaccaaaacagcaagagcaacgcgcacgaacaccacagcgcaaaaaacccataggacaagacagaaacaagacaacggacaaccagcagaaagaaagaagcactcgggcatgggaagacgtcgcacagcgacatgaggacaagcacgacgaaacaaccaagcagtcagggcagaagagaaacaaacgaaacaacccagacgaagacgcgaaggaacagcagaaaaagacgagaccagcaggggaaccagaacagagccactagaagaacaacccacacaggcgaggcagacgcgaaggcaacagtgccagtacagcaccccagcgaccaaacataacagccccacacgcataagatcagtgagcgacagtcaagagaacataagaacaaagaaccaagcaacacacccaacgacaaacaaacgacgccactaacacaatggagaagaagaccggaccaaatcgaacacgcacaatagacggaaacatagacacactgcgaagt

SEQ ID NO: 669813 - DNA, 115 bp, Homo sapiens
tgttctattcgcatgcgagcgacggcacgccgttattgcagcacaaatgaacttacccgcgtactgtctaaaagtttggcattgaccgttacatcaacccgacaaaagaaattcg

SEQ ID NO: 669814 - DNA, 367 bp, Homo sapiens
gcaaggatggattaagaacagagagtaagtgaaatagcctggccgcgtgacttaaccggcccggagatgtgcgggtcaatggaccgcttgggtcggataggaccagagtgcttctcagtcaaggcctcagaacagaggagcacctgagtgccttcctggccgcgaaagcaagaacctttggccagaagaggaactgatctctgaagccccaggcgggtggaaagtcagggtttcaaggttattttgaatttaggtctgtgggccttgacggtggctcatgcttgtcatccagtgctttggggggcgagcaggaggctcgcttagccgaggagttccagagcatctggcacatagtagctctgtgtct

SEQ ID NO: 669815 - DNA, 454 bp, Homo sapiens
  misc_feature (10)..(10): n is a, c, g, or t
atcccttttncttggagatgttttcttgggggaaaaaaaatctagccccctgaaacctgttacaatgtttaaatctcccttttttaccttggctgtcataaaatcctcctgtttgagctaaatgtggcccgctgaagttttaaatgcccatatttttcaggctaaggccatggtggacaaagctaactcccctaaaatcctagctgggggtgttggaaaaaacggtacagtgcccctttcaaactccagggttaagtccgtttcccctccccgcccattataatttactacttttctaaagctgctgggtagtttgttttaaagccccaagactggccaaatgtgcccctgagtaaaggtcacccctttcatttgggggctcttttttgccttttaaagaatttttttctgtgaaaaaatgtatttttaataaaaaattttttgtggccaccca

SEQ ID NO: 669816 - DNA, 171 bp, Homo sapiens
gctctaagatctctccccgtacgccaaaaataaatatagggcttgtattgactaattaagtctgtgccgtcgctacagaagccctttcctttttcttaacgacaatttctcatctgtggtgctattgacatcttgggcgtacggggggacgagctcgaatcgatcatggtc

SEQ ID NO: 669817 - DNA, 357 bp, Homo sapiens
aaactctgtcactgacactacaaaataatgtgtactacagtgagtaatatccctgcaactgccatgatccatcccatatctataccctccaccctctctccacctattcacacatgcaatgccaaacaccctcttcttccatacacagaaatgccaggaaagcaagaccctacttgtcgtagcagaatggcaaaaaactgtatctgtcttatacccctatataagagaacccacattaaccacacaggatatgatgcaatataaaaagtaatcaagatttcccatccatcatacacatccttcccatgatccagtaaaatacaagatatccacaagaggctaaaaagcacaacccag

SEQ ID NO: 669818 - DNA, 154 bp, Homo sapiens
tcgcggtgagttgctcgcttgaggccaggagttcgagaccggttccggccaacatggtgaaaccccgtccccactaaataatacaaaaattagctgtgtatggtggctcacgcctacacgacggcagagcggatcacctaagttcagagccagg

SEQ ID NO: 669819 - DNA, 914 bp, Homo sapiens
  misc_feature (570)..(570): n is a, c, g, or t
gggaaaaaattatttggtggggggccccctcctctccctgtggggggaatttttcacgggagggttttggtgcggccacagaaggtgtctattgggggcgccccagggaggagggctcccctccctctcctggtcttgtgcacacagattttgttgtacccccgggtgtcccatgtgtaccgcgcgccctcgccataggtagcaccaggggcgtgtcctctcttaagaagagccccttttttccccgccatattttccgagagagtgttttctctctgccgctctttagaggcacaccccccctctggagagccctcttggttaagtgtttgttgggccccatctatctttttgtgctctaatacccgctcctcggtgttcacacaccccgccgggggcattgtgttacacgggccccaggggttttcgggtttctcgcgctggggagagccctctcccccctccccgtggttggccttccttcccactgccacggcgtttggcgcgcggagttgtatgaccatttttatagggtgttttatatagcgcgaagattccgcggccgaacgnggtttcttccccgatttcccgcacacacgtggtgttttccaaagggtgcccccgtggaacgtgcccaccagtggacgacccctcgcgagagctcctccttataccttgtgagagccctcttttttttatagccgccacaaccaccgagggcacggtctgtgcacactgttgccccccgccccactctttccacgccggcgccggttctaactcgcggggtgttgctgtgttgtgattttggcaacaggaaaaatccccctccccccccatggggggttttcccgagggggtgggccccgcccccccccgagagttccaactgaaaaaaacttatttttttttta

SEQ ID NO: 669820 - DNA, 410 bp, Homo sapiens
ttgttatactttccagaagtatacgttgtgacgatgttcctctgagacaggctcgttttctcaggtctttctacacttcccagattacctgcatgttccatgcttctacagctaggagaccgctcaggaaaacatgccacacgggcataccgaactttattacggggaaaggtcagtttagaattaccgctcctttcgtatgttaattttctggaatttcgtgttcgttaatttgaaagcactaaaagaacagaaggtaagcgtcagatttctgatgaggatgttcacgctatgcatgtcagttgggttcttttcctgcttctacagagcacggtcagcagttagttggatcagccgttgcgactcttgcatatcgtgtgtctaccctgtgggtccatccgagccatctt

SEQ ID NO: 669821 - DNA, 882 bp, Homo sapiens
  misc_feature (84)..(84): n is a, c, g, or t
  misc_feature (238)..(238): n is a, c, g, or t
  misc_feature (266)..(266): n is a, c, g, or t
  misc_feature (284)..(284): n is a, c, g, or t
  misc_feature (287)..(287): n is a, c, g, or t
  misc_feature (289)..(289): n is a, c, g, or t
  misc_feature (342)..(342): n is a, c, g, or t
  misc_feature (353)..(353): n is a, c, g, or t
  misc_feature (358)..(358): n is a, c, g, or t
  misc_feature (378)..(378): n is a, c, g, or t
  misc_feature (383)..(383): n is a, c, g, or t
  misc_feature (400)..(400): n is a, c, g, or t
ggctgtcgccgccgggagacaaagatggctgcgagagtcggcgccttcctcaagaatgcctgggacaaggagccagtgctggtngtgtccttcgtcgtcgggggcctcgaacagtgccgatgacactacccctgaggtatgctccatgatgacccgtacagcatctaaacgtgctcattccatgaccaacccactgctgcctcctccaggccccaggtatctctgtaagttctgcccncattgagcccctacttcaagtactccgntcatgatcaacaaggcangcncntacaactacccagtgcccgtccgtgatgatgggaacatgcccgagtgcccagncacccccagancctcngggcccagcctggagtggtnaaganactgtggcacctccacngacagaggcggcagctcccaggggttcccattgaaacaatgtgagaacctaataataaaccccccagttggtaatgcccaagagagggaaggtctcaatgtgggggagcaaatccaaaagaagcttctcagacgtgctgggcgcggatctgggaaaacacagtggggactaacatacctgcaggggccgctgaccccggtatgaacatgcttagccttcattccctccgcaagaccgtagcgtatcggggtcttgcggcgcccaccaaaaagcacgcggcggatgggctaccgctcggacaccgagagcaggggcggaccgcgaattaccaaggcccacaagccataaatatcacgcgcgcgcggtggtgaccacttttggggggcaaacacgtccccgcggcccgattctttacccccccgctcccaccagtaccacccactctttggggacaccccgagggcaacgaccgttgaagacca

SEQ ID NO: 669822 - DNA, 759 bp, Homo sapiens
  misc_feature (84)..(84): n is a, c, g, or t
  misc_feature (115)..(115): n is a, c, g, or t
  misc_feature (143)..(143): n is a, c, g, or t
  misc_feature (161)..(161): n is a, c, g, or t
  misc_feature (164)..(164): n is a, c, g, or t
  misc_feature (166)..(166): n is a, c, g, or t
  misc_feature (219)..(219): n is a, c, g, or t
  misc_feature (230)..(230): n is a, c, g, or t
  misc_feature (235)..(235): n is a, c, g, or t
  misc_feature (255)..(255): n is a, c, g, or t
  misc_feature (260)..(260): n is a, c, g, or t
  misc_feature (277)..(277): n is a, c, g, or t
ggctgtcgccgccgggagacaaagatggctgcgagagtcggcgccttcctcaagaatgcctgggacaaggagccagtgctggtngtgtccttcgtcgtcgggggcctcgtgcccncattgagcccctacttcaagtactccgntcatgatcaacaaggcangcncntacaactacccagtgcccgtccgtgatgatgggaacatgcccgagtgcccagncacccccagancctcngggcccagcctggagtggtnaaganactgtggcacctccacngacagaggcggcagctcccaggggttcccattgaaacaatgtgagaacctaataataaaccccccagttggtaatgcccaagagagggaaggtctcaatgtgggggagcaaatccaaaagaagcttctcagacgtgctgggcgcggatctgggaaaacacagtggggactaacatacctgcaggggccgctgaccccggtatgaacatgcttagccttcattccctccgcaagaccgtagcgtatcggggtcttgcggcgcccaccaaaaagcacgcggcggatgggctaccgctcggacaccgagagcaggggcggaccgcgaattaccaaggcccacaagccataaatatcacgcgcgcgcggtggtgaccacttttggggggcaaacacgtccccgcggcccgattctttacccccccgctcccaccagtaccacccactctttggggacaccccgagggcaacgaccgttgaagacca

SEQ ID NO: 669823 - DNA, 224 bp, Homo sapiens
tgctgaccacggcgtcgcaggccaaggcagtgctgagcgccgagcagtgcgcgaggaggaggtgcacgccggcctgggcgagttgctgcgctcactcagcaactccacggcgcggcaatgtgacctggaagctgggcagcccgactgtaacggaccccagctcagtgagcttcgctgatgacttcgtgcgcagaggaaagcagcattacaattgcgagcactcc

SEQ ID NO: 669824 - DNA, 819 bp, Homo sapiens
ataagtgatttactgatgatatgtcatatgatgcaaaaaaggttttgtgtcattaactgaaaagtagcagcttctctatccaggatgatgagtcaacaggtttcactaatatttgtcatgctgtacgcatttgtaagatttgtaaatgatgaaattcaaagaaaactttttctattgctaggagcctgccagaacaaaggccaatatataatgttgtgacatcatatctgataaccagaggtctggtatctacactcctggtgccccatcagtggttgtctccataagtcattttgcgttattacaaaaaaaaaaagaaatcctgatgttgacattatagcacactgctttctccacagagatgctgatatcaaaaacttgaagatacagtgaagttctggaataaggttacaaaactgggttaccggtatcaaagacccatttatgcaaagaagggttcaaacaaaaaaaaaacgcccaaaacaaaaaccgggacaggacagcgccattaacaccctccgggaccaatacaggacactccaggggctctccacaaaggaagcgtcctcatacgggaaatgcgaatggaacaggcgactggccagagcctaactataccaacgaagaaccgccacagacttgagcctgaaaggtgacatccgggacaaccgcaacaagcggcgcctaccacgaaacgagccgcccaactcgggaccacacggcgcgaccgtccgacctgggtaacaacccgggccacagctctccgaacaggggtcagggagggaacacagcggtgtagcttaaacgcgagacaaagac

SEQ ID NO: 669825 - DNA, 572 bp, Homo sapiens
gatcatatagcaactcttccaccatgaaaaaggagagaggttgtcctcattggaacaggcacttactcaggatatgggattagcctacctgcatgcaatgcttctcgccaagactaccatttatggactcaaggaatgccttatccactatcacggtattccacacagcattacctttgcccaagcactcactttacaggtaaagaagtgaggcagtgggctcatgctcacggaattcactggtcttaccatattccccatcttcctgaagcagctggatcgatagaatggtgggacggccttttgcggtcgcgattacaacatcaactcggtagcaatactttgccgggccgggtcaccatactccagaagaccgtgtgtgctctgaatcagcgcccaaggtatggtattgtttctcccatagccaggattcacagatccaggattcaaggggtggatgtgaaagtggcaccactcactatgatgcactcagcaaaatgtttgctttctgttcccacgcaatacggttctgatttactagtcatctatactccagagggcagacgctgcta

SEQ ID NO: 669826 - DNA, 349 bp, Homo sapiens
ccaggtggtattcagaccacagggtctcaatgggtgggtgaaccgtttaagctcgttgacctaacagggccgggcctttgaaaaatagaccctggctgcacggatctgcaaagcgcgtgacccagtgcggtttatcggcgcctggcgataaaaaaagctccctttttcagctatttccggtatagtgcgcgccggcctttaaccgggccgcgtataggtagcgcaattccccgaagtcagcttcggatgcacgtccgcacagacggactctaccttgacgaatctttttcattcatacgtatacgcaaatccccgccgacaaatcagacagggagactcttgagtctca

SEQ ID NO: 669827 - DNA, 1161 bp, Homo sapiens
gcctggactgtgtcttggttccagaagctgacgacccggcggacggtgagcgtctctattgactaaaagacagtgtccagtgctccgagctctaggcagtctactggggacctgcactctccgcgccgcacaccgatgcgccaacttctcgtggtcaacgtgtgaaaatcgatccgatcggaaaaacttctgatgggaattagctcaacagtgctccgggggtgacactgttgatgctagagagaagatatggcctgtggtctgcaggcggtgcacagcgcaggcaggtgggaagatcgaaacaggagcgggagacactttcgtacatcaaagatctccaccagcgagcgcaccgatcagcaggattaaccttcacacacgggatgggagagcaaggccagtagggaagacgcagacaagaacctggagtgccatgggaaaggctcacagtacaagagagacgcgaggagcgaaaacgatgcaggaaacagatgcaaaaagcagagcaaacgtggctcgaggcccgaaggcgaagacacagccataccatgaagacgggagcaagaaggcgcacgccggacaaggaacgcaacagactggcgacacgcacaacaagaagacaatgaaaacaaacagaagcagcgcggggaaacgcatcgacataaccaatagaacgccacatgacacccgcggacagacgaaatggacaacggaataggatcgtagacgacaccaagggggaacataagggatccccagaaaaaaagacgaacagcaggggccgccgaacgcggtaaaagacaacccgagcgaggctccggacaggggcaaccaaacacgaacaagggcgacacatagcgacaaagctagaccgccatggagataacagatgggagacgaaaatagaaaccgaaaaccaaaagaaacacaaagaaaaagactcagccaagacccacacgtagaacataaacacaccaaaacgagaaggagaacaagacgacaggcagcacggcagacgaagcggacagaagcggagagatgcaatgcaggacgaacccgaaccagaaagacagaaaaaggagcgaggcggagaacccacaagacccccaagcgcgaggaatcacacaagaaacggaagcaaggaccaagacgaaaccgaaa

SEQ ID NO: 669828 - DNA, 109 bp, Homo sapiens
tgtggagacggggtccactgtgttgcctaggctgatgtagagaccgtttataacgtgggaatgggaaccgctgacgggacaggtgtcctgcatggacttaacttttttt

SEQ ID NO: 669829 - DNA, 87 bp, Homo sapiens
ggagggaaggaaggagagcagaatcttcggaaggtgtttcatgtacctgagggatcctgccattacctccagagtctcccctggtga

SEQ ID NO: 669830 - DNA, 659 bp, Homo sapiens
  misc_feature (16)..(16): n is a, c, g, or t
  misc_feature (83)..(83): n is a, c, g, or t
  misc_feature (87)..(87): n is a, c, g, or t
  misc_feature (93)..(93): n is a, c, g, or t
  misc_feature (97)..(97): n is a, c, g, or t
  misc_feature (101)..(101): n is a, c, g, or t
  misc_feature (152)..(152): n is a, c, g, or t
  misc_feature (155)..(155): n is a, c, g, or t
  misc_feature (161)..(161): n is a, c, g, or t
  misc_feature (169)..(169): n is a, c, g, or t
  misc_feature (196)..(196): n is a, c, g, or t
  misc_feature (200)..(200): n is a, c, g, or t
  misc_feature (229)..(229): n is a, c, g, or t
  misc_feature (315)..(315): n is a, c, g, or t
  misc_feature (325)..(325): n is a, c, g, or t
  misc_feature (356)..(356): n is a, c, g, or t
  misc_feature (376)..(376): n is a, c, g, or t
  misc_feature (478)..(478): n is a, c, g, or t
  misc_feature (501)..(501): n is a, c, g, or t
  misc_feature (507)..(507): n is a, c, g, or t
  misc_feature (513)..(513): n is a, c, g, or t
  misc_feature (519)..(519): n is a, c, g, or t
  misc_feature (548)..(548): n is a, c, g, or t
  misc_feature (564)..(564): n is a, c, g, or t
  misc_feature (597)..(597): n is a, c, g, or t
  misc_feature (656)..(656): n is a, c, g, or t
tttgcgatggtgtgangctacatcctcccccagatggctacgatgtaggagttcgtgagggcggtgaggtaggtgaaggaggnattngccacnactntgtncaccatggtcttggtcaccacctggccaagggcccagggctggggccactncangatctntgtggggncctgcagggctgccggcagcgggggtngctncttcaggatgttgctgacgtcgtagagcnacacgttgccctcctcatccccacagagcacaatccccttatcagggcaggcgctgagcgagaagtaggccaactcggtggacgancattgcagcngcgccaggaccaccactgccaccgtggactngctgccccggcccccccacntcttcctccagctccacaggcagatggtgcccaggccgctccccttggaggccacgatgtcctcattcacaaatgccagctcatccactctccgtccagatncctcggagccctcaaagaagaanaattcntacttnacacancctccttttttgggggtggtgcagccggncgtaccagcagcagcngcagaaatcgcagccggccagcaggcgggcgtncgggcaggaggcgacagggcagaggcgcagggggatagaggtggtgtccagtgtgagcngct

SEQ ID NO: 669831 - DNA, 518 bp, Homo sapiens
tgcctaggtggccccgctagtggtggtgtttattcgtacgggctccgccggcgcggccttcgtcgtccttcgccgctggctagctgtggccttctttccaatccccccccgccggttgcgtcgtgtgatgccccgttccgtgcggctggcgctgggttatggtgtgtggcctggggccctatcgtgctaacgcacgcgctgcctgtccgcgcctccttgggtctgacgccttccgcttccgtgggtggccacacgtaatgcagggcatcccctctcgatcgtgagctcgccgagttccccattcctgtcctattggaatctcggaccgcatacacgtcctctccggcattcgactcttccttcccggtgggactcactgccttggcgctggggaagatgttgtttgcagttacatctcgattgttcggggcctgcgtgtgcgttctcggactcctcctagaagcgatgccatctccttctcctttgcacctttcgaaatgtcggtgtgcggtgatcgg

SEQ ID NO: 669832 - DNA, 499 bp, Homo sapiens
  misc_feature (125)..(127): n is a, c, g, or t
catccagcgcaggggcgcctgctgaggaacatccgaagcttgaggaaaccgcagataagtttttttctctttgaaagatagagattaatacaactacttaaaaaatatagtcaataggtacattnnnaaaatatgaagacttagaagagtagcatgaggaaggaaaagataccccccttctaaaacatgacgggggttgagatgaaatcttttcatggagtataaaatgtatttaaccgaaaatggagagaacggacttcagagccccgtattactaccattagttgggcattgcttttagatttatatgaaggtgccttaaacagcttaacgctcatcctaaaccggccgttatctaaagcactctccattccttttctcattcttatttgcccctttttaaccctcacttgtcccccttctacagcccgcagacttctccacgattcccttgctcccgtcatccaccaatatctctaaatatcgtccaatcttctgc

SEQ ID NO: 669833 - DNA, 192 bp, Homo sapiens
ggacccccgcgccggacccaacactttggaggccgaggcggcggccacctgttttcaggagccaagaccactatggcctggccggtggggcgtaatcccgtctccaccacaaaactacaataattagctgggcgtggtcgtgggcgcctgcaatcccagctagaggcaggagaatcacttgaacctgggagg

SEQ ID NO: 669834 - DNA, 591 bp, Homo sapiens
agcaagaagctggagcgctacctgaagggcgagaaccctttcacctgacagccccggaggaggagaaggagcaggaggaggctgatgggcggtgccctggacgagggggcgcagggcgaagcggcggggatctcggagggcgcagagtggcgtgccggcgcagcctcccgtgccccctaggtagccatgccccgcggggccgttgtctgcctgcacgaaccgcacgccgtccccagaggaggaggaggagggcgccgtgctccttggtcgtgggaaggggcgctgttatcggctctgagattcctgcgggcaagtccctgggtctctctggacgtgtgagtgacgacagaagagagtggctagcgcggggcgccccgtagacccgagctcggggcgggcccggaagtcccgggccggtgggccccggaaagtccttggggaaaaacccaaaaaccctttaaattaaaaaggatttttcccccatttccccaaaagtaataacaaataattataagaacatcggagtagagaactgtgcgactatgggcgtagagaacacatgagatggttggtttgggtttgtgggatgtc

SEQ ID NO: 669835 - DNA, 233 bp, Homo sapiens
attcttcctgtcacttatctaattcggctgttgattcttgtatagtgcttcacaaagttctcgtgctgtgtttttcagctccatcagtgtcatttacgtttttctctaaacatggttcttctagttatgcatttcctagtaacctatagtccaaggttctatagcttccgtcgcattcgggttacgaacatacttcctttatggtcagacagagtatatgtatatatatacca

SEQ ID NO: 669836 - DNA, 183 bp, Homo sapiens
actgatgttactatgcgcagcagcagcaggtacccttccgtgtagcctccacacctactactatcgagcccacgaccactctcggacccttaaaacactacagctacctcagacctagtctacggggcctctccaccagctaggcctactcacgctactccggagaagacctcctttaaccca

SEQ ID NO: 669837 - DNA, 743 bp, Homo sapiens
ctaagtaaaataacactaacaaacaaacccaaccagagaaagacacccacgaaaacaccacaaacaaaaaaaacaaacaacaaacacacaacaaacaacacaaaacacaaaagccaaaccacacccccacaaaaaacaacaaaaaaaaaccataacaaaaaacaaaaaaaaacaaaacaaactaaaccccagaaaagagacaaatatacatagccagccaccacaggacacacaaaaaacccaaatacaataaaaaaccgacagtaaagaatagttttagaacaccccctaccccaaaaaaagctaaaaactacacctagaataagtaaaaaaactaccagatatgtacacaataataatacaacagaaagtaaggcttataacattatactagaacactacaataagctaaagacccaaactagaaatagataaccccactaattagctatagccctaaaacctactaacagttaaatacaacaaaactagctacgccagaacactaacgagccacaagcataaaactcaaaagacctggcgagtacttacatattccctactagaggagaacctaattctaataatacaaaaaaccccagatacaacctcaccacctactagctcagcctatataccggccatcttcagcaaacctgatgaaggctacaagtaagcgcagagtacccacgtaaggagtaggtcaaggtgtgcctgagagagtgaagggtatttctaccaga

SEQ ID NO: 669838 - DNA, 417 bp, Homo sapiens
cccgcagctgaagtcatctgtcctctttccttactttctcacaacacttggtctctttgctcaagggcctagggctctacaatcagcaggtgataaagcaagctgggcctctgtccttccctttagggtggcaatttcccccataccccaggcaggtccagagatgccagtagccaggtactggagtcaaaaacctttgaaatctacttgatgctctattctactgcagctaagctggcactcaaactataagacaaaagtccttcctattcttcccttctctttccacaagcagaagagcttctccccaaggtcatcaccaccccagaaccacagagggtactgcaaggctactgccaatgttcacttcaggctcaagtgctcttcagtcatcttgtggtgaattcttccagacct

SEQ ID NO: 669839 - DNA, 1184 bp, Homo sapiens
cctcccccctagcgaaagaacaagcaaagcaaaaagacaaggacagcactgtagcttgagcagagatcatcattgttttttgtgtgctcactagtacacagggctcagcgccgtgtgttttttacagaccaagtgtcgtttcaacacaggtgtatcccgtaggtgcatccccctccatcagggccctcctcgagagcatacacgcgggtgagatgccctcacagtagggccccaaataacccacccgggtgtctccttggtattggcccccctctgtggtcgtcccagtgtgctccgcacccggttggtggcccctttatgcggcttctgtggtatttcgcacaataaattgtggagaacctccgctccggagtggacagtccaatcctgcaaagcgcgagcggaacttgctgcggaaaataccgtggtgacgaagccgaaagggagctatcagcgggttttacgcccttcagggcacccttgtagtggccccttgggacagcctcccgacctgctgcggattgttctttgaccgccctgtatgacgaggacgtgggtgaaggaggatccttctaccaagtgggagagtagccaggacccccctgagaccacaagggcaagggtgtggcccctaaatcttgtcacagccttctttcaaatggctccctgaacccgaggaggagtctctgacccaccactgagggctggtggggcccggggacctggagccccctggacacacagatggcccggctaaccccctggactccacaggggggcggcaacaacggccggttggcccattgggtcgcctcgtaagttgtagaatgttgttctgaaactaataaatgtggctcgaaagaggccggattggcttggggctgcctgggcccccctccacggatgcccccacggtgtccctctcctccccctggggcaccacgagaatatatttaataatataaagttcttgaaaatttggtgtgtcttggggtggggaaggggcaccaacgcctgcccctggggtccttttttttattttttgaaaatcaccttctcgggactgccgtcctcgctgctgggggcatattgccccaacgcccctgtaccaccccctgctgttgcctgggcccgggggaagggggggcccggtgcctgtaattattaaacatgaattccaatta

SEQ ID NO: 669840 - DNA, 133 bp, Homo sapiens
gccgcgggacacggacgtatgacacggaactacctctgacgtttcttctacattactgtgttacctgcctttgaactacggctggacctctccttttttacacacggtgtaacgcaccctttctcacggacca

SEQ ID NO: 669841 - DNA, 195 bp, Homo sapiens
cggcatggggtggggcctacaggtagaaagagcaacctgtggacttttgggaagtttttgagatgtgcgcgaagcacattgcatggagcattttgcctggagcatgttggttgccaatggaggaagggaggaagagtgaacagggcacagaggggccaccctgcaaagcttccttcctcacccacccccaggtcc

SEQ ID NO: 669842 - DNA, 458 bp, Homo sapiens
ctctataggatcagccagttatgtgaagctaaaatataaaattgattatgaatcagatattcagttgaacttccttttttcctaggatatactgcttttggtggtgtggtaacagcaaaaattaaaatgttttcatttaccatatagttatgtcactaaagtccttaatcagactctgtatcaaagtgtactggccacgaaaatgttaaagttgcattgtacgaattatttattttaattctgtacatatttttgaatttatatgtgtatatatctgtcactaataaaaataaagtatccttataatattgaagattataaaatgtcacttcctataatcatggcaaagagcattactcaaagttatagattacagtatgaaaatctgtaactacttcataaggtgtgatttccatgcaataactgcacgtttaaagtgtaccattttgttttgatat

SEQ ID NO: 669843 - DNA, 140 bp, Homo sapiens
gctcggaccttttgctgagaagcacctccaaaagggttggctttgaggctgtgccaaatgcagctttcttatactgtttatcatgccacttctggtctcgtcgggaagccgcggcgtactggctagcaggagatccgtct

SEQ ID NO: 669844 - DNA, 490 bp, Homo sapiens
tgagctcgattcccgaactcttcctgcgggtgcccaggccagctgaaccctggccaggcccagctgttggcttgcagcagccttcactctttggccttcttataatccctagtgaaggggttggcttttatttatttatgtatttatttatttatttattttgggatgactccgttgcccaggctggatatgcagtggcatgatctcggctcactgcaacctccacctcccgggttcaagcaattctcgtgcctcagcctcctgagtagctgggactacagacatgcaccaccacacccggctaatttctgtatttttagtagagatggggtttcaccatattggccaggctgatctcaaactcctgacatcaggtgatccgcccgccccggcctcccaaagtactggaattacaggcatgggccaccatgtctcctggccacctcgggagatttctaaacaaactaagacgcatgcttcattctcaggg

SEQ ID NO: 669845 - DNA, 485 bp, Homo sapiens
  misc_feature (149)..(149): n is a, c, g, or t
cagaagcatctttaagtattcaggtgtttttgagcttatggaggaggatacaggttttccagaattttgatttttgcttgaaaattcaaattttatattgtcagtttttcttagagtcttagtcgtttctgagaaaatgtctgccagtnttcaagtcctaataaccatggtttagatgttagtctttcaagtaaaaatggtattccgtaataaaagtgattagtttagctctcaacaaggtaagttatgctgcagaagtgctttatgagtacttcccttttacactgaatattaaaaaagaaatgtactcaacgagtaagatgaaattaatcattgttttctgcttctctgtcacgggactggcccctttttaaaaagtttcaagtggctggtgaggaagaatgcagtggccacagtattacttgtctggaccttatgctaagaccccaagcagctttttctaccattgattttgcaaccatcat

SEQ ID NO: 669846 - DNA, 124 bp, Homo sapiens
  misc_feature (51)..(51): n is a, c, g, or t
agaaaaaaagcaggggaagcacggggttaacggactgactgtagtcgcctncgacctgcggtcattttaggtcccgggaaaacggaaacccggaaagtcgcagcgagtattgagcgaggagcgg

SEQ ID NO: 669847 - DNA, 543 bp, Homo sapiens
  misc_feature (66)..(66): n is a, c, g, or t
agcccagtgtgtaaatgcatgggcccaggttgtgccagtgaggcctcatttacagaagcagtcagnggcgagatttgatcctgtgggctacagtttgccgaccccatgcatgaggcagtaaaaggccaagagcctggtataaattcataacgagaaaccaaggctctgaatcagccccgaagtgtaagcagcagcataatgatctggagcagcatcttggcgttattaaattcaacccattccgatggctgcgtcagcatctattgctctgtttattgtttttccttaagcaagcagttccatttctagaaatttatctcaagcacataaatctagagggggcacatcggtgttatttatgacgggaaaactgggaacagacacagccctaggctggaagaggcacagagtgatgtacagcatgggccagtggttaggagcagactcaggagccaggggacacggctccaattctagctctgtgaacacactggccgtgtgccaccctcagcaagttacttaatctctctctcttagggaaaa

SEQ ID NO: 669848 - DNA, 222 bp, Homo sapiens
gcgcgcgacctagaggaccccgtgctgcagaagtaatgtggttttgccatttaaaagtaatgttgaaaaccgcaattacttgtgcatcagtctaataataaacattgagatggaagtcagcagttgtgtaacttcgatgaataaataaagcattcaaaaggggaaaaaaaaaaacactccaccaggtttgaggtccctcatacatgggggcatcgataaaca

SEQ ID NO: 669849 - DNA, 209 bp, Homo sapiens
accaggtaactaacatcagtagactcgtctctatcaaaaattaaaaatagttgggcatggtggcacacaccggtagtcccagctactcaggaggctgaggcaggagaattgcttggagccgggagacggaggttgcagtgagctgagatcacgccattgcactccagcctaggcaacagagcaagagcgaaactccgtctcgttaggtc

SEQ ID NO: 669850 - DNA, 164 bp, Homo sapiens
gtggctctgcgaggcgagatgctgtgaggctctccttcttccccgtcgaccacaggccggccaaagattggctccagctctttgacgtcttgcgggggctgccactgtacacttgtgaaagggacgaactggcgtcttggggggtgcccgtcttgcgggggctg

SEQ ID NO: 669851 - DNA, 157 bp, Homo sapiens
gatcctcgtgaattgcaaacaggcaaaccagttaggagctgctgctggataaaccaggtgagcaatgagaaagctgggtctagtgcactggcgtgtgaaagagatcgtgatggaatttgggaagacacggaactgagtgtggaggctcaaggaggtg

SEQ ID NO: 669852 - DNA, 604 bp, Homo sapiens
agaccagttctctaccctatgaatgcatactaatctaacttactgtctctatggactgcctattctggtcctttcttataaatggaacgacgcaacatgcagcccattgttttctggctgctttcactgagcataatattttcaagattcacccatgttgtaacacatatcagtgcttcattcctttttatggctgaataatactccattgcatggacagaccatatttgtcttatctgttcatcactgacagacatttgggtttgttccattttttggctgtcatgaataatgctgtcagcatgtatgtatgtacgcggtttccttagtttttatctaatgtcattttcctgttccaggatccccttcaagataccacattatgtttagctgtcatgtttctaggctcccttggctgtgacatttctcaggttttcattgtttttactgaccttgacagttttgagttctggtcaagtatttcatgaaaactccctcaattatggtttatctgatgttttcctcatgattaagctgggttatgtatttctgggaggaagaccagagaggtaaagtgccaccgtcatcacatcatgtcaggagt

SEQ ID NO: 669853 - DNA, 563 bp, Homo sapiens
gccagggactcgctattgagagaggggaggtccctggcgaccacagtctgggtttctaggaacccttcctcacagaatgcacactctgtaccactggataaagcctccacttctcttccaggtgaacctgaggttgaggcatcctcacagctttcccaggcaccgccccagccccaccacatggcccagccccaacatttcactccagcctggccccagtcccagcccccacctttggctgagatccagacccaggcccacctctcaccccctgtcccaagcctggggtgctcttctccaccccagattaggggctgtggggcatcttaccctacatcccaggagaggacacagtctgtcatccccactggaaaggagtatcttgaatggcccttgaagaagcgaccaaagtggaagagggttttgccctctctcctcaaaaagtctcaggctggtctgagccaagccactggccaccttcccaagagaggccggcctcctggagccccaagtcagccccattctttcccgggtggcaccagccctgagctccagagcatggt

SEQ ID NO: 669854 - DNA, 1536 bp, Homo sapiens
  misc_feature (924)..(924): n is a, c, g, or t
tacacagcgtagatacatactagagtacgcggggggagtaaacctgtagcagcagtgtcaactaatagtactagcagccctctttcgttgggtataagcacgtcgtctgtggggagcacacccccatatttagaaaaagagcgggttctctttttcatcaaatttctcgggcgagagaattctagtagtaccctgcgggtgatccctctcttttctactactgcgaagtagacatatgcctctccgatcccaccttggtgtttagtgcagctccttctatataccctgggtggtggtagcattgccagtccgacccagttgtgtgtgttgtaaaagagggggtgcgctccaatgccttcttctgtggggttttttttctttctcccagacgagaaggagggtgcctctgtgcccccgcccccttcttcctgaccacctgtcctcaacgattgggggccacgacttccgacaaataagcgtcctctgcccccgccccccccattgtgtttgtgggggtaaacacaagatggggagaaaaccaacgcggcggccttttggtcgaatttgagaacagggtgctgtaatatacgcaccactcgtgttgggaataaatgttgttgaggagcgcacaacatttgcccccaacggggggaccacattttttcccaccaagaagatcctgtgggtagaattgcgtctccccctaatggctccttcattgacaaaacagcacccacgaggggtgtatcccgcggggcctttctcttgtgttgtgcccccccgcacacacgttgtgtgcacgactgatccaacgaccttgtggaggataaggcgaaaaacccccctcgtgggggacaaccactacatctctttgtccgggtggtgcagcaactccaacatggccccccacaacgccctgagccnacactgctgtgtcgcctctgccgcacaggtgtttctcgttggtagacgtgtcacacgcagagagatggtgtttcttctctgggtcggcgacttctctccggcgattagaaatagaccactctcataggggggcgccccacacacaggccgtgtgtgtctttacaatcaggtttgtgtgacacaaagcaccaagactggcgccctcgcctcgtgtcctcgttagacttctcggggcccaggtgctacaccgtgggcgccccacacttacaccagaaactgtgcttctcgctggaccacactgtgccttttggcccaaacacccagggccttccagcggcacccaagacttttgcgttaaaaagcgcatcatgagtgcgtgtctgtgggacagacctctctgagagatgtctccctgcttctgaggggcatcactttggagcccactgagagaacgcgacttgtgccacacccacattgcgagacctcagtcccttccaaagtgcactggtcacttggggcaattgtcgggaaacaccttctggggataaactgaggggactaaatgaaatatttaattcttgttaagatttaactgacttttctggcccttta

SEQ ID NO: 669855 - DNA, 380 bp, Homo sapiens
attgctctgactcagttgtatctgattgctcttacggatcttcgtctgctcttcggctttcttcatgtccttctccactcgtgaccgtcacatttcgttgtacccctagtatggttcgcacgtgtgatgtagacacaatccacctcccacagctgtcgcagcctactttccaaccttctggaatatgatacctgggcacacattatggagctccataatgtgtgcccactccataattgcccagacgttcgaggctgtagtacgcttcaagaggccactgctactctatcttgggtgaggcaagaccctttcaagctgtatgctgcttgcttgcttgtcgtggtcattagaaaccctgcattacttcaatcatgaattct

SEQ ID NO: 669856 - DNA, 1170 bp, Homo sapiens
  misc_feature (619)..(619): n is a, c, g, or t
ggcaagccgcgggccgggtcagtgacgctgggccgcccagtgggagtccacgcggggcgtcgggggcatccgtgatatgccgaagcgctacagaatccaggctagcccggtgctggagaagcgtgtgggcgtcgtggagtcatcttgtctggggcgatcgccaagagtcctctttgctggttcgtacttcgcccgaggcactagctagcgcgcattcacggcacgttgtagtgggcactcgcaggctgctcgtggatcagtcgctctatcagccgagttggctactaacttccatcgttcaaataggcttacttctattgtgcacgcatcgagcgtcacctattgtgagattgcggtaccatcgaatgtcatgtgctactcacgaggcgcgaggtctcctagacaccgaggtatcgacacaggaaccaactcttcttgtctatgtgcgagacatggtccacacgcgcaggccgctctactggaccacctggcattgcaatgcgagacagtgaggtcagactcactccgtgggcaccaatacaatgtagcgcgaccgctgcgtctctcggcatgtgttgagacgcagctcgcgagacgccagcgattgcgcgcatgcggntcaagcgcggtggactggccctaatgacactttgcgtcgtgtactatagcgaccttctcactctgttgcgccggtttcggcattaggtgcgtcagaagtcgtgtcaatccttgcttccagcaatattgcccttacaacatgggctgcctggcctagaggtcgtaataagacttggttgccgtgttccctggggccttggcatcgacttgtacattcccccggagatgcccatagtggcaagcgggcagtctaaagtctgtctattgggttctcgacatggaaacgtgggctcctctaatgcgtaggccaacctcagacttcatgctaatttgggactccgtccttgtaggcacctggggcccgtggacttccttgtcgtttgagctcccatcccagcgcgtacgccctttcaaagtggcgcagttgacgtctgggacctggaagtgcgaataccatggtgcggcatagcccgcgcccatatggacacccctgatgcccggaagagctcaccgggacataggccctggtgccctggagcaatcggccttggc

SEQ ID NO: 669857 - DNA, 210 bp, Homo sapiens
ggatctggaacgtctccctaacaaactcccatatcacaagcttccctccctgctctgcacacttctatgacactgaatctagtgggttagatattatacaacagtgttgtaaaattatctagtactacatatcctaagtagcaaaattgccttctactaggtcaaggtcaagcttattacactagtatgtttccctagactacgcacaac

SEQ ID NO: 669858 - DNA, 421 bp, Homo sapiens
gatgacccgccttggacgtgtttctttaacctcatccatataatagggccgtgggatggttgtagaggtaaagcaggatgatggtgttttaagaccagagcttgggaccagggctcctacacctaattttctctcctggtagctgaacaaaggtctaaattagcttaacaaaagaaccaggctgccgtcagccagagttctgaaggccatgctttcagtttcccttgttgacaattgctctccagttcctatgaaagcacagagccttagggggcctggccccagaacacaaccatattaggctagagcgtgaccagcaggggctctgtctctgctctgtttacacgactgccgaactttcaaaacacaacctctttactatttatacacaacaacaaaacaaaaaaacacaacaacaaac

SEQ ID NO: 669859 - DNA, 355 bp, Homo sapiens
  misc_feature (28)..(28): n is a, c, g, or t
  misc_feature (65)..(65): n is a, c, g, or t
  misc_feature (151)..(151): n is a, c, g, or t
  misc_feature (177)..(177): n is a, c, g, or t
  misc_feature (197)..(197): n is a, c, g, or t
  misc_feature (202)..(202): n is a, c, g, or t
  misc_feature (211)..(211): n is a, c, g, or t
  misc_feature (273)..(273): n is a, c, g, or t
  misc_feature (292)..(292): n is a, c, g, or t
  misc_feature (326)..(326): n is a, c, g, or t
tgtttaaatggaaaactgggtcccccanctgtgccttccaccaaaaaaccttcccaatggcccanttttggagaacctaaccctaacctagtcatgcctaacccaggaaatcccactggggaggaggttcccttttgaaacaaaatgctgntcagttagtaaccaagttactttgantgcaaaagcagctgtgtttnctganaagtactgnacaaatgtgtgtaattttctgtgccagacttatgactttttttcaagcactgtaatgtgggntggatggttagtaacaatnatatattagggtttctgtttaaaccctttcaggnctgaactgtatctccttttgttaattttc

SEQ ID NO: 669860 - DNA, 240 bp, Homo sapiens
tatctagaggatccggtctacccacaggtatgtatgccatgaaacatgtcatcatcccgcggatagaaggtactctggctaatatcatcacagagctggatgagagagagcgagaagagtcaataggtaaagaacatacaagagaagaaaaagattctaaaggaaaaatctgagaaggactgggagcaaaggagagcagctgggagaggtgcgggagcctggtgggccggtggttaagag

SEQ ID NO: 669861 - DNA, 293 bp, Homo sapiens
gggaggaggatgtcaggcagtcattgagtggcggtcatcggggggatatcctgcaaagagagaaacgatgatctgaatgaagcaggcgttggtgaggggcatgatcgagctaagtgggcatatgccgtggggcaagtgaattcattccactcccatgtatccaaacttacgatagtggagatcattcatgctaggatctcgatgtctgcctccaaagaggaagcctctatgtccgacagttgcgtcaggcatgggcagcacagaggtgaaggtgctttaccagtagttatagg

SEQ ID NO: 669862 - DNA, 191 bp, Homo sapiens
tttcgacggtgtctggggcatgagctagaggatggtggagcaggtagagacgctcccttccttagaatgtaccttgttgacaaggacagcgctgtgagcatcacaacttactgtgaggtatctgggattgagcctggtcaggaaacaggtagaccagcaggttccattgtatgcctgggacctggaccttg

SEQ ID NO: 669863 - DNA, 167 bp, Homo sapiens
ggtagaaaattgtcttgaccagctgagcttccatgatcggagggcaggcctcactaggagcaggagcatgtatactcagatgctgacagctgaggcttaatacatgatcataaacccaagagaacagtggggaggttaggacaccactggcgagggtaggacgcctg

SEQ ID NO: 669864 - DNA, 138 bp, Homo sapiens
tagtgtcaggggtaaactgcatggcccgtacaatcgcaaggagtctctttcctctctctctctctcatatgcacacacacacacacacacacacacacacatatacgcccaggtgagcataggaaaagggtatacgcc

SEQ ID NO: 669865 - DNA, 134 bp, Homo sapiens
tgcacccagacctgctatgatcctcttctaaggaaaggctatgtgcgaggttcaaatgtacaatgatggaatttcggtagaacacgctcatcatatcctaaacactcctaacatttaaatagcattgtgctccg

SEQ ID NO: 669866 - DNA, 617 bp, Homo sapiens
tttcggaaaagttcatcttttatatacttttttacactttctgtaataaaaaagaagcctcccagtactattgggccctcttttaaacgaccttcgaaacaactcccctctgtcttctccctgttcccgttctttctcccacgtctccgtttcctccgtctcgttccgccttactatggctctctcggccccccgtgcgcgcccctctggccctagcccctaccccttcctgtcctcgtcccaggtctccatgtgggtttctgggtggccacctgtctgccggctatctccctgtgccgtcccccgggccccttgcacgtttgtttttatggcccctctcccgccatcccctcttccatcgtgcctggtcgcccggtgtctcttccttttcctcacttcacgccttccgttttcttgggattttttcactgcttgctccgctccctttcgctcctatgaccgtccctctcctcttgcgttttggtcggtcacttctgcttcccgccacctctgcgtactacccgtccctatttgttttgccccgaggccctcgggtgggctctgcttccctctattgcctctgctcttttcgttttccttccgtgaccccgtcgccc

SEQ ID NO: 669867 - DNA, 114 bp, Homo sapiens
gcacaagggcattcctacaccctatatccccatacgtagttattatcgaaaccatcagcctacatcattccatgcaatagctcctggctgtacgcctaaccgctaacattactg

SEQ ID NO: 669868 - DNA, 883 bp, Homo sapiens
  misc_feature (876)..(876): n is a, c, g, or t
gcggtggctcacacctgtaattccaacacttgggaggccgaggcaggcagatcacaaagtcaagagatggagaccatcctggccaacatagtgaaactgtctctactaaaaatacaaaaattagctgggtgtagtggcacgcacctgtagtcccagctactcgggaggctgaggcaggagaatcacttgaacccgggagacagagattgcggtgagccgagatggtgccaccactgcactccagcctgtgacagagcaagactctgtctcaaaaaaaaaaaattttaaacaaaaattgggtttagaccaattcaactcaggtgaattttactgagcaatttggaaccggagtgaattctcctgagccaattttaattcctgtgatcatgccatacagtgtggcagttaacccaaaacccaattgggtgtctcattcctctgaagttatttccatcggatcatttctgtgaatttggcaccgatgattcatccatacatggttctcttatctgtgtcaaattcagcaggaccagttccctcagatagctccttggcttcagggggccctggacccatctcagggcacatacattcttgcttctgtacctggacttatgctcctctgcgaaggcctgcatcgtggtcacctgcctccttcacttttctcaggtatcccttgcggccatccattaattcggttccctctccccaattctgtacccctacggaattttttttttgggggaggtcgcttccccggcaggggatctgtccaaaaaagggttccccaggggaagaagccggggatcagttgagagtgagcgtggcctctctttgtgtcgctttctgtgccgagcggcggtccgctcctcccgnggggaac

SEQ ID NO: 669869 - DNA, 354 bp, Homo sapiens
tataaatgatgttgtatgtagtttgatagtaatagtattaactctgtagattactttgggcagtaaggcaattttaacaatactgatttttccaatccatgagtgtacaatgtttttccatgtgtttgtatcatctgtgatttctttcagcagtattttatagttctccttgtagagatctttcacctccttcattaggttcattcctagatatttcattttttgtgtgcctattgtaattggggattgtgttcttgatttgactctcagcttggaactttagtgtataggaaatgctgctgatttttgtgcattgattttgtatcccggaaactttactaaagtcatttatca

SEQ ID NO: 669870 - DNA, 412 bp, Homo sapiens
  misc_feature (23)..(24): n is a, c, g, or t
ctggctaagagtgaagaaaggannaacttttgagagaaagaaggaattgggagaattgttagagaataggcaagtattcattagaggaacacggctaagattgctaggcaaaattggattgctcacttggattagagcatgaaacaagttgacagcaaagagcataagcttcctttccccaccacagccccctccccacccatagcaactcgaaagcagcaaaagtttttgaagagtggcataaactggtatgtctttttagcaaaaagtaaaaaagaaacaaaacaaatagacccaaagaattctctgatggtccaggtaagagatgatggggaagcatatacaaagggatgtagtggcagtagaaatgatgaggaggagcctgggcaacatgacaaaacttcgtctctac

SEQ ID NO: 669871 - DNA, 1120 bp, Homo sapiens
gctggaggaagcagctgcgggcttgaccggctgtcggcccgccgcctccgctgcctgctatcggccccaatccggtccctctaggcgccggcctgacccggtctggcttgttcggggctcacgcggctgctgatggccgacagctcccgatggacatcatattatgtagactacttagggtgacatctgcctgagcagatctccacatgaattacacgccagggggtctgacagcacctgacgacggactatgacccaaattgtgacggacgagtgaagaatgaatgaagacagactgacgcctgggcggcacatggaggactatacacgtcgcggacgtagccagcggatgttggcgcagcagtggggctgatgcctattcgatccttgacggaagctagccatgttcactctgcttgatcgctacgaccctcccgtctgcgggcgtgccctccagatcgacgccacattgaccacgcttactctctcctgtctcctacgacggtactctcgaatccacgcactgctacaggctctctactttcggtcacacttgcccacgtgggccgatctgtccatgacactactgaggaccaggaatttgcgaaaggttccaagatgttacgtagctcacaacattgcatttggtaagagctggcctctgaccgtacccgccgcgtacagtccccatacaagaaccccatttgctttccgcacctcaatttcccctattcgacccccatcgacccaccatgtgtgcaagcggggttgatagtcgcacggagtatggtgacgcacaccgtgacaaaccccttcacctcctccctcccatcggcccctaggaccgcgcacccccatcttctctactgcaccggaccccccttcccatcgcgcggacggccacggcactatgcgctctcaacgtgcttcttccgggtccaaccggacacgggcggtcgagcccgttagagcccaaccttttgcacttgggcactccatcactgactttggccgcacccttcccaacgatcactcgcgcacggagcgagctcgatggagcggtcgtcccctatcggcgttacgccacctagcatgacaatctcgcgcgccaccagcgacg

SEQ ID NO: 669872 - DNA, 147 bp, Homo sapiens
cgccggcccgatgtcgatcctgtactatgattggactgactgagtatgggcctgtgaatatagattgcaacataacacaagaaatgctaaaaaaaaaaaccttaagctacatacatgtttactatcacaactccccagacattccaa

SEQ ID NO: 669873 - DNA, 817 bp, Homo sapiens
aagcagtggtatcaacgcagagtgcccattacggccgggggagctttaatttattaatgcaaacagtacctaacaaacccacaggtcctagactaccaaacctgccattaaataatttcaggttggggcgacctcggagcagaacccgaagcctccgagcatgtacatgctaacgacttcaccagtcaaagcgaactagtatactcaattgagtccaatagacttgagccaacggaacaagttaccctagggataacagtcgcaatcctattctagagtccatatcaacaatgagggtttacgacctcgattgttggatcatggactatcccgatggtgcacgtccgctacttaagaggttcgttctgttcaaccgattaatacgtcctacgtgatctgagttcagtaccggagtaatccaggtcggtttctatctacttcaaattcctccctgtacgaaaggacaagagaaataaggcctacttcttcaaatgcgccttcccccgtagaatgatatcgatctcaacttagtcattatacccacgatccagccaaggaaaaaactaaaaaaaaaggacataagaacctatgtgtttggcacgagacattggccccccgggaaaaagcgtgttactaaaacaccattgtgttgtagtcgaccggtggcacccataatgtgtcacgagcaaacggctgcgacaacacttggtttcccaaagaagagatctcgggtccaaacaacaaacgcgttgcagaattctccacaagataaagaaccgcccgagaggtcaccggaagtgtcttagaaccacccctg

SEQ ID NO: 669874 - DNA, 1577 bp, Homo sapiens
  misc_feature (927)..(927): n is a, c, g, or t
  misc_feature (1005)..(1005): n is a, c, g, or t
  misc_feature (1011)..(1011): n is a, c, g, or t
  misc_feature (1015)..(1015): n is a, c, g, or t
  misc_feature (1146)..(1146): n is a, c, g, or t
  misc_feature (1187)..(1187): n is a, c, g, or t
  misc_feature (1242)..(1242): n is a, c, g, or t
  misc_feature (1430)..(1430): n is a, c, g, or t
actcttcgcccttgctgtttgttctgttattagtagctttgtgtgatcgtatgtttgattgtattcgtctcttgttgtgttgcttatgtcgcttgcatccgttcctagttgttttcgttgttttcgcgttgtgtctgtgttgtgcgtgtgtcgcgtctttgcgtgctgttctgtctgcttgctcggttcgtctttttttcttgttgtcgcgtcgtgcgtagtgtggtgatgactactctttgaccccgcgtgtttccgggagacccccaccacgccggtgttgccgcacctaaatgaacctccgggcatattacaccctctcggatatttttatctattgcccccgcggtgcgagttaatactgtgttacacacaagggagacacagcttttcgtcgcaattcggtcccatttgttagagggacacacataatataggacacaagatggtgtacaccaaaaaaacccagcgctgtggtacacccgggctcccggagttttcccgccggaatagtttcgttcggaacaccatccacggcggtcccgcacatggacgcaagaaagaacatatgttgttggggtgaaaacgacctgttttcccctcctgaatttccaaagcccaagcagcacaccctaacattctttgccctggggtgagaaaatgcaaccatgaggcaacagagttgtttggggaggaattggaaagaaatttcacagagaacgtgtttgttgtcaaaaatagtctccggagggttctcgcacggaagtgcacctcccccgttttttaaagagttttgattgaaacacgtggttaagccgttgtatctatcaacatagccccccacccccaacggccttatatatgagaggcgttgccccccaggaataagcccaagtgtataaccaaggtggcgccaacccacgcgtngtgtccccacaacactggtgtgtagaaagaaatttgagtctacaggggagccccatttgagagaagagagaaagcctntgtggncttntcccccgcagatgagaaaaaatatgttcttgataacactcgcgaaaaaagctctataaatatattatatggagaaaaaaaaacacactctgcccgacaatataatataaaatatataatataaaataaagngagaaaaggagaaactcttgagacacctcttatatggtatncccgaggccacaaatgcacacggttctatgccacaaaacactataatggctatgntcctcatgagtttatctctatatgtgaggttttgtaagaaccacacaaaaatcaccacacaaaaatatggtataaaatattataaaaaccacaaattataatgttttatatatgaacccctgggagaaaagaaattttcacgcccaagtacacacaaatttataagcacttcctctttctttaatttntgtaattcctttaactgtggagatatgctcacgaaatgtcacgtttctgcttttatagtaaccacgagaattgagtaactgaggcaagggaaacgtaatttggattataaaatttttgctttaattaaaattcctttaaccagtgga

SEQ ID NO: 669875 - DNA, 430 bp, Homo sapiens
  misc_feature (1)..(1): n is a, c, g, or t
ntttcttgttgaggtataaaatgtaaacaccttaaaatgtcttccccttatatgatcactgtgtttgagtaattttgctggattttttaaacacttactttcaaaaaccaagttaatacctctgacatggaaattaaagcttcagcccagtgactctaagctaaggctaatatggagcctgcaaaaggaggttattaaaggcccagttaggttctttttggggagcctcccctgcagatgtcccagcctgctcacaccagccatgaagaagcctttatactgagaagctacagagcccaggaaagctggggacccacaggcagatgcagttaaagttaagatggaaggggattaggaaggtcttactggagatgaagttgttactgttttaaggcagtttctagacttacaaaataaaacaaagttatgt

SEQ ID NO: 669876 - DNA, 300 bp, Homo sapiens
tgctgtgcactggtgggatagtggaaactctagcctaaaaaaaaaaaaatgaacaaaacaaaaacaaaaacacacacacacacgcacccaaagcatctttcatattttgtcatctattctattgcaaactatggctttaaaataatttcaataagcctatatacttattttgttcacccattttttcatttttacaattaaaaatgaaaaggcaacaacaattgaccaaaaactataactgctaaagttggttattggtgtagggcggcaacttctttattcccacaggtgcaaacgcgg

SEQ ID NO: 669877 - DNA, 348 bp, Homo sapiens
aaaaatttggctccctttaataaaaaataattttaaaatagcttaaaccatgaaagtatacgttctgccatgaaagtataaatataaccggggaagtataagtattaccaatgaaagtgtaagtactgccagtggtaccaggggtccttgctccgagagcttccaagatggtggggggccacttacaaaatggaggcaggccacttccaagatggtggcaagcctcctgttctctgacctggggttcttggcctcacggattcgaaggaatggaatcttgagccgtgcggcgagtgttatagctctattacaagtcgagggtcacggaagagaaccgaggaacccaga

SEQ ID NO: 669878 - DNA, 637 bp, Homo sapiens
ccatcccgggttcagtcgtgattttccctgtggatatgctgtgtgaaccgtcgtgtgagtgtggtatgcctggatcaccgatggaatttgttataagcatccatgtgacaacttgcaggaccactaccacgtgggaccttgtgttgtttcttcccatatttggaagataaatttatgtgtagacttttttgtaagataccgggtaataactacaaatttattgagaatggtcttgccatgactcgtattcccagatgcttaagcaagccttgctgctaccaaatatttctatttttagaaagggtgttttatggacccatgcccccagttgtccagtcagagcccttggtgtttttccattgtttaaaatgtcaacctgtgaaatgggccattatttatgttttttttttgccttcctgataattgtatgtattgtataaagaacgtctgtaccttgggttataaccacctagtatatttaaacttacaggcttatttgtaatgtaaaccccccttttaatgtactgtaattaacctggttataatacgtaccatccttccctcatcccatcacaccactttttttgtgtgtgataaactgattttggtttgccataaaacccctgaaaaatattta

SEQ ID NO: 669879 - DNA, 650 bp, Homo sapiens
  misc_feature (69)..(69): n is a, c, g, or t
  misc_feature (92)..(92): n is a, c, g, or t
  misc_feature (104)..(104): n is a, c, g, or t
  misc_feature (106)..(106): n is a, c, g, or t
  misc_feature (110)..(110): n is a, c, g, or t
  misc_feature (116)..(116): n is a, c, g, or t
  misc_feature (118)..(118): n is a, c, g, or t
  misc_feature (122)..(122): n is a, c, g, or t
  misc_feature (136)..(136): n is a, c, g, or t
  misc_feature (139)..(139): n is a, c, g, or t
  misc_feature (148)..(148): n is a, c, g, or t
  misc_feature (167)..(167): n is a, c, g, or t
  misc_feature (170)..(170): n is a, c, g, or t
  misc_feature (176)..(176): n is a, c, g, or t
  misc_feature (183)..(183): n is a, c, g, or t
  misc_feature (185)..(185): n is a, c, g, or t
  misc_feature (188)..(188): n is a, c, g, or t
  misc_feature (195)..(195): n is a, c, g, or t
  misc_feature (205)..(205): n is a, c, g, or t
  misc_feature (221)..(221): n is a, c, g, or t
  misc_feature (223)..(223): n is a, c, g, or t
  misc_feature (272)..(272): n is a, c, g, or t
  misc_feature (274)..(274): n is a, c, g, or t
  misc_feature (295)..(295): n is a, c, g, or t
  misc_feature (304)..(304): n is a, c, g, or t
  misc_feature (307)..(307): n is a, c, g, or t
  misc_feature (311)..(311): n is a, c, g, or t
  misc_feature (336)..(336): n is a, c, g, or t
  misc_feature (350)..(350): n is a, c, g, or t
  misc_feature (360)..(360): n is a, c, g, or t
  misc_feature (362)..(362): n is a, c, g, or t
  misc_feature (385)..(385): n is a, c, g, or t
  misc_feature (392)..(392): n is a, c, g, or t
  misc_feature (404)..(404): n is a, c, g, or t
  misc_feature (435)..(435): n is a, c, g, or t
  misc_feature (446)..(446): n is a, c, g, or t
  misc_feature (457)..(457): n is a, c, g, or t
  misc_feature (464)..(464): n is a, c, g, or t
  misc_feature (473)..(473): n is a, c, g, or t
  misc_feature (490)..(491): n is a, c, g, or t
  misc_feature (502)..(502): n is a, c, g, or t
  misc_feature (506)..(506): n is a, c, g, or t
  misc_feature (508)..(508): n is a, c, g, or t
  misc_feature (541)..(542): n is a, c, g, or t
  misc_feature (549)..(549): n is a, c, g, or t
  misc_feature (554)..(555): n is a, c, g, or t
  misc_feature (560)..(560): n is a, c, g, or t
  misc_feature (572)..(573): n is a, c, g, or t
  misc_feature (622)..(622): n is a, c, g, or t
ggaattcccgggatcgcaggtcgagacagcaggcggctcaagtggacagccgggatggcagagcgtgcngcgctggaggagctggtgaaacntcagggagagcncntgcnaggccncnagcngcagaaggccagcnccnagctgatcnaggaggaggtggcgaaacnccngaaacngaaggcncngcngggtccngatgaaagcnaacagaaatttgtgcncnaaaccccccagggcacaagagactatagtccccggcagatggcagttcncnagaaggtgtttgacgtaatcntcccttgcntcnagcnccccggtgcagaagtcattgatacncccgtatttgaacnaaaggaaacncngatgggaaagtatggggaagacncccagcntatctatgaccngaaggacccgggcggggagctcccgtccccnccctatgaccnccctgttcccnttgctcngtatttggnaatgaataaactgaccnncattaaacgcnaccncntagcaaaggtatatcggcgggataacccccccnngaccccnggccnntaccnggaattctaccnntgtgattttgacattgctgggaactttgatcccccgatcccccatgcanagtgccccaagatcatgtgcgagatccc

SEQ ID NO: 669880 - DNA, 538 bp, Homo sapiens
aaaaaaaagcaccataagctgccttcccttctttttctttattctctgtcttccttcaaaaaaatgtaagctccatgaatagggtgtagtctgttttgtatactgctccctttatcctctggaacagcacctggcacagagtaggtgctcactaaatatgtgttgaattaatggatgaataggtataaaacatgtatgcaaagatactttgttttggaattctaggactaggaaagcactaagaatgctaccaccatcttttcctcctcagccattcattgctcctgtacctcctattcttagtatgttcatttttcagtgctattgatagctcacatgtttacattttagttgaaagattgtctctttcatgagcccaaattacaattcataagaatatcttttctttcatatttcctctgtgttggtaataaactttacttcagtttttcttttctcatatcagggaaaagattgtttagctatttataatgaattttaaataattgacttatgtatgataactgtatgagattta

SEQ ID NO: 669881 - DNA, 905 bp, Homo sapiens
gcctgtgaaaaagggaaataccaaaaccattggtacacgtgatgccttgcaataggtgctcccttaccaatttcagaagcttccctgcaagtagatatcgagagagcacattttccattagtagcctgtgtaataccccatatcacctctgctctgaggctgggtcctgcagcctgtggtagtcttggggaagaggtagccgcctgaaagcagagccttaagagaagcaatgtcggccctgacgcatggggtccccagtgggtggcctcaagaaccttcagaacctcataacccgagaaggcaaacagaatggtttcaggaagaggggtataggacgctcaaccacccctagggcttcgggaaataagatctgccccctgacgtggcacatttgtcaattgccccctcctaaagtggacagcgcaccaacactggacaagtgttacaccaacgactcacaggggtggtggtccaacagaggggctttagcacaggcagagggtgttaccctctatttctcatgcacaacatcgacggcgcatgacttcaagacagaaggaattccaaaccagacgcctaggagtagtggtgccacaagtgccggtaaatccatagcaggtgtggaaagcaaaagacttgaatggtatcagttggaagacgcaagggaagtttgggaagaatccagcactgtgtaaaaatggcaaaaagccctattctttacgagagaaatacgaaaaatgaagggcgggggaagagggggtttagaagagtggaaatgccggagtatggggaggcagagaaaggtggatcacgtgaggtcagggggttggaaacagctggcaaatgtgggacccaattttataaaattaaaaaacatacgatatgggggggggctagatacagaa

SEQ ID NO: 669882 - DNA, 847 bp, Homo sapiens
gatccatccagccctcgccggtcgccaccacgaccgatcccgccatggcgacggcgccgccgcagctcctcctcctcgccctgctctcctgcctgagcctcgcctctgccgccccgtcgctccggccgctcccacgcgccgacgacgacggcctcctcgcgcggaccaccggcagctcctcgtcgccttcggagcggggcgtgggcgcgcggacgtgctggtacacggtgcagatcaagacgagctgctcgtccccggcgcgcacgtcggacgcgatcagcctggcgttcggtgacgtgtaccgcgacgaggtgtacgcggcgcggctgggcggcgccgccggcgcgttcgaccggtgcgccaccgacacgttcaagatcggcgggccctgcgggtacggcgtctgctacctctacctccgccgcgccggccgcaccgggtggacgcccgagtgggtgagggtgtacgagcccaccgcccccagcgcgccctccaaccttccgctacggcgacccgctccccaacaacgtctggtacggcttcaaccgctgcccgcgcctcgcctcctcctcctcgtcatcgtctccttcctccgctgctggtgctgcacaggcgatgtagccattggtcggagcaggtcgtgggcactcgtgtatgtctgcacggtcgggggatcgaggtactacattgttggattcatttctgctgtgccgtgagtgattgcgtcgtgcggcctgtattagtcccgatccgagatggccttgctattatgggtacccacgagattaaaaccctcttcgggcttttttgggaacaccccaacacacaaccaacaaacacaaagccg

SEQ ID NO: 669883 - DNA, 394 bp, Homo sapiens
tagaggatcaccggaagcaactgcaacaaaaaagcacaaattatgctctcactctacatcagttgatagctgcattcaaagaggcgggacttctgttttcatcctcccagaagtctgtggcactggaacagttcttcaaagagagagaacagacacgcttccataatggtactaatttacagctgcaggcttcctttgcgggccacttttagaaataagtgccctgttagtaatgggcacagaacttgccagagagaggtatgaagtgcggtaaaggaggtcgcaaagggaagagaagaggtgaggaacagtatgatgagtggaaaacacagtgagatcagcagtgcactgaaatgagaaatgtagggagattccatatttatgtattctgttc

SEQ ID NO: 669884 - DNA, 252 bp, Homo sapiens
ccccatgctgacatgatcaaaatgccgaatgctcgacgcagttatcggttaccacaggctgttgaactcgataaggttaatgccctgcatgcggctggaaaaactcggtttgggtccgaggtacagaacgtcgcgggacgttgtgtaggaaatgcttaaggaacgcaacatgtctactcgtgacgcagggggaatatggtttgttgtcatgtgcagacctgagcgtgattgaagagttagttccacgcacgg

SEQ ID NO: 669885 - DNA, 103 bp, Homo sapiens
tgatttctgtcgtcctgtctctttttttctttccctaaccttctttcagccctcccctccctgtcttctttacccttgtctttcgagcgagtgaggagttggg

SEQ ID NO: 669886 - DNA, 1200 bp, Homo sapiens
gggatgtggtcaacttctagcgtgtcacaggctgcagactcccagtagtgtgtgcaagcagaggcgctgctccgatgtagtgacattatttcagtatacccttcaagccataagatgatattgtgttcaacttttctgctggaggctaaggcactgttattcctcaggcctccctagatgttcccagagacctagtgaacttctgggccccattggtaggtttatgaggctctccgttggaacttttgagccaaggttgaatgcaatgtctgggactctgtgtagacctctcggggtctagttcagtacaaattctgggaactcctagggaagttcgtagagatccccatgtggagaggcagagtgctctagcctcaccaggagacctcgtgagaggcgctacgaggagacatgatgtgggccgtgcttgaccagtctatccgtaggagatgaagcaggaggccgtcgggtgtgattggggctgaggtaatatcgggaggaacgatacctctgtggccatggaggtggcgtcgaccggctctactatagaggagacgagcttgctagataaggttctcgaagctcatcgcgcgtggagaagagtagctccacgcaggtgtgtccccccttccggtggcctacaaggaaaccatgtttatctccaaggggaaaaaaaaggaaattcaacttacatacaagacatagagagacagggaggtggcgtgcgcgcccgttcagaacagacgaaagcctcacccccgagagggtggcaccgagagagggctaggggcggggtgacctcacccgtgtttccaagggcggcaaagcggaagtgatgggacccgccggaacaagagacgtgacagtgcgggaaactcccaaatacaagtggcataagcgcggacaacagggggcactcgcgccgcacgttttatcacccaggaaaaggcttgctggggcagccaagctgggggcgacaccagcaaactggggcccaaacccctggggggggaaaaccctttgcaggggaagaacagcgggacaacccccctctgaacgtgcaacacgggggggcgggggtgggtgacaccaacaacacagaggtggggggcaaacacaacagaatgtatccacctctcacgacagagggaagacattcaaacaagggggtcctcctaagagggggccgacacataatac

SEQ ID NO: 669887 - DNA, 195 bp, Homo sapiens
gtaagagagaaccagtgcagcatacataggaggtagcggagggacaccgacagaagagccctcgttcccaaagaaaggtagtgtaggggggcatctatggaacagtcacctaagaggcaacagcaccagcaaggcctaccgtacctgcctagggtcccatagggtaaccgagctacgacatatcgtaatacatag

SEQ ID NO: 669888 - DNA, 304 bp, Homo sapiens
gccaggtcacgtgtgcactatatacttcgtcgacgcgtctgtacattacgcggtcgctgacttgcgacgatacctatggcgccagctgcaggcggccgccgtatgcatcctaggcctattaatattccggagtatacgtatgccggctaacgttaacaaccggtacctctagaactatagctagcatgcgcaaatttaaagcgctgatatcgatcgcgcgcagatctgtcatgatgatcattgcaattggatccatatatagggcccgggttataattacctcaggtcgacgtcccatggccat

SEQ ID NO: 669889 - DNA, 370 bp, Homo sapiens
atgacaggagttcaaccagtgcgtggggcatccgtaatccccgaccatgatcaacaacagcatgaacagtacaaccccatatcatggaaatcagagaaaaaaactttcccatcacgtggttacattcaaactttaacttccttagtaccatgctgcagatttcagcactgttacggtctggcaagaatgcccaaccctctggtgtctgatcatgtatctagcaacattgcagaatgaagaaaagacagccccggtctcagcccatggactagttcatacagtgacgcaggttcctgtcttttcacccttcctgctcagcaactaaaagatcaaggactaaaatcaaggaagactgggcagttcaaacact

SEQ ID NO: 669890 - DNA, 559 bp, Homo sapiens
tatgggcagaacaaactctgcaccgaaagaaagagatgccttgaaaatgtgtccatacttaagatgtttgccgaagtagcaagagcggagggtgactgtgtgagcaggagcgagatggcgccagctcctgcgggggaggtcctactgggcgctccaccctgtacaagaatggcaggctttatggcagctgccataggccccagggtcctcaggactctgcctctgcaccagtgctggtttcccgactaacttcaatctggagagatggtaagttatctaaccggctcttcttttggcgagactgctctttctcctttatcagagccccccatgccctttgcagctcagagtcttcttcctcagcgccaggcgccctgtgatccactttcgtcgtattctcttctttggtcttgggtgcagatcctaggcgactccataaattacctgatttcttctcccgagtatcggcgtagcgtcctttactatccttgcttgggacacctcgcctattatgcacatcagaggagtcgtctctccgaacggtggggtactactagaa

SEQ ID NO: 669891 - DNA, 1573 bp, Homo sapiens
tttatggatcgccaccgggagggctacgcggcggctgcagccatgggtgctgggcctgcgggggcgcggggggtgcgcgaggacctgcggggcggggcgggagagaaggctgccgggaccggccctagacactgagccgcggtgggatccccaccggctctgcgaggccctgcgagcgccagggaggcgccacgagggagccgggcagccgcgggccacttcaggggggcccgcctcgccgcccgggcggtcgagagatccttgggggcacatctcggggtgcggtgacccgcccggcgcatttcgggggtcggggcgcaattgccaggggacatctggagcccggccctgcttctgtcgggctccagggtacccctggatggctgcgctgtgccctcgccggccgcccgggcgccgcagcggctgagttcgccgggatcgccgggccgccgcccttgccacccgctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgcccgaggacatggaccaggcgctcgtggacctcggcgtgctctccgaccccggctcgggcctttacgatgctgactcggagctcgacgtctttgatgcgtacttggagtagggtctcgactgctgttcccctcttccctacacgatccggaacccatgccctggaccagccgccagatcatgccgccgagctggttgggggcaccatctggacggggatggttccccaggaggagaccctcccctgcctccgaggcctacctgctcccctcaaaagcttcgtgccaacagagaggttcctgtttgaacccaggagagtggaagagagattgggactgagtgctgaggttgggaaggcacctgctcccacagaagggggaacgcaagaggcatcccaagacctcatctgcctgcagtgtcaaatcgatggcctggccttggcttctgattatttgcagctgcgatggatgtttacaggaacccagccagagtttgcctccctgcacttcatcccggagcgcacctgcttcccccacttcaccttcggagaggacacttcaaactgcggacacacgcaaaagcgactcccagctccgtttgatgtgagttgagccttcaggccagctgggtttagcccgaggctggtcttagatgcagcgactgtttcaggggtgactcagaagaaaaagaagctgaggaagctgttggggggctgagggtgggattctcgctccttcatttcaggttactcgttcttcagcaagttggcaaaacagacatcatgctggtgagtgccacgttactcccctggctggaaatgcttttctgaaagtatgagtgttgtgcctacttaattctgataaacctgtctaagcaatacttaggaggcttacttctttggattaaaaaaaaatgtatgcaactccaa

SEQ ID NO: 669892 - DNA, 2018 bp, Homo sapiens
tttatggatcgccaccgggagggctacgcggcggctgcagccatgggtgctgggcctgcgggggcgcggggggtgcgcgaggacctgcggggcggggcgggagagaaggctgccgggaccggccctagacactgagccgcggtgggatccccaccggctctgcgaggccctgcgagcgccagggaggcgccacgagggagccgggcagccgcgggccacttcaggggggcccgcctcgccgcccgggcggtcgagagatccttgggggcacatctcggggtgcggtgacccgcccggcgcatttcgggggtcggggcgcaattgccaggggacatctggagcccggccctgcttctgtcgggctccagggtacccctggatggctgcgctgtgccctcgccggccgcccgggcgccgcagcggctgagttcgccgggatcgccgggccgccgcccttgccacccgctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgcccgaggacatggaccaggcgctcgtggacctcggcgtgctctccgaccccggctcgggcctttacgatgctgactcggagctcgacgtctttgatgcgtacttggagtagggtctcgactgctgttcccctcttccctacacgatccggaacccatgccctggaccagccgccagatcatgccgccgagctggttgggggcaccatctggacggggatggttccccaggaggagaccctcccctgcctccgaggcctacctgctcccctcaaaagcttcgtgccaacagagaggttcctgtttgaacccaggagagtggaagagagattgggactgagtgctgaggttgggaaggcacctgctcccacagaagggggaacgcaagaggcatcccaagacctcatctgcctgcagtgtcaaatcgatggcctggccttggcttctgattatttgcagctgcgatggatgtttacaggaacccagccagagtttgcctccctgcacttcatcccggagcgcacctgcttcccccacttcaccttcggagaggacacttcaaactgcggacacacgcaaaagcgactcccagctccgtttgatgtgagttgagccttcaggccagctgggtttagcccgaggctggtcttagatgcagcgactgtttcaggggtgactcagaagaaaaagaagctgaggaagctgttggggggctgagggtgggattctcgctccttcatttcaggttactcgttcttcagcaagttggcaaaacagacatcatgctggtgagtgccacgttactcccctggctggaaatgcttttctgaaagtatgagtgttgtgcctacttaattctgataaacctgtctaagcaatacttaggaggcttacttctttggattaaaaaaaaatgtatgcaactccaaaaaaaaaaaaaaaacaaaaaaaaaaaaaactttgtgtgggcgcgcgccccggcgcccctggaaaaagtttctcaaacccacgtgcgttggggcgcgcgcgcgcggcgccccccgtgaggtaaggggcaccagtgggcccaaaacggtggtcccgaagagaaaaccgcggggtcccaggacacagagcgggcggggatttccccacccaatataaaaagcgccgcggggggaaacaccgcgaagcgggttctgtgaaaccaaccccaagaggggggcatccgagaggaccaaataagggggaactcaatcaaccagagggacgtccagcgggaagctcgaataataaaaattaagcgcccccagcggggtagaaaacaaaaacacacgcataaccatcatatacaacactagaaagcacgtacacatcagcactacatcacacagg

SEQ ID NO: 669893 - DNA, 757 bp, Homo sapiens
gacagcccggctcctgtgggttcggcgaacatcgcgcggcggccatgggggcgcggctgggcctggcgtggccgggcccgaggctggctctgagtgcctggggctggtgtgccggctgcgtggcccgcgccctacgaacgcctgggtgcgtgtggctccgcgagatccagtccacgctccgcgagcggcggccggagcgcgccctggcaagactgctgcgccttccttgcgcccagtgacctgggccttgagaggacccgtccttcctgatatcctctacagagatgtggccttccttcaacccggatcgaccccatctcccatgacctgctatgtgaacctggcccgggactgcaagtgcccaaagaagctgcccagaaccccatgctgacagcacctgcgagatgtcctgccatgagcatcgacacagccccaggatgtgtggctgtgaccagccagcggacccagactcctagtcaccagtgagtccccaacaaaaccagtggtatccgctctgggcctgcaagctctgaatgcccaggtatctgcacagtcggaccctaggactctgcggcctaggcgagggcatcaaaggaaacagacaggacattggaagatgattgtgtagtgcatgcactgcatacactgggggtggataacagaagggactggataaacggatgaagtggagcatagatcaggatggcaagaaatggtggggccagggcaacatcagaaaacaacagtgaggatgagc

SEQ ID NO: 669894 - DNA, 313 bp, Homo sapiens
atgaggagtagtcagcgtgatgccaaaacgcgtcttcttaatccaattctaattctgaatgtttcgtgtgggcttaataccatgtctattcatatatagcctcgatgatgacagagttacaaagagctacactccagacacattcgtccaaatttttcagcagacgcactctgggtcgatgacctgaggtcggctctgcgatccatacgtggccgcaccccctcagcacgtgctgtgtcgcatgggtcaccgaacagtgtactctgttcctgacatatcggtataaaacaataaacttttaatggtaaaaaaa

SEQ ID NO: 669895 - DNA, 208 bp, Homo sapiens
ggatagagaagttaagagatgtaacataggacacacagcttacaatgtgatgcagcctggatacatatgactccagatatgtagctaatttgagcagataataagaggaggaaaaggcacaaacgcttatatgcggggaagggtgggcagggaagggaggaaagaagagattttgcttctaagggcagggaaagttggaaagattttg

SEQ ID NO: 669896 - DNA, 200 bp, Homo sapiens
tctggacgtggacatgcgaaaagatctgtacgccaacacagtgctgactggcggtaccaccatgtaccctggccttgccgacaggatgcagaaggagatcactgcgctggcacccagcacaatgaagatcaagatcattgctcctcctgagcgcaggtactccgtgtggatcggctgctccatgctggcctggctgctca

SEQ ID NO: 669897 - DNA, 1741 bp, Homo sapiens
tttatggatcgccaccgggagggctacgcggcggctgcagccatgggtgctgggcctgcgggggcgcggggggtgcgcgaggacctgcggggcggggcgggagagaaggctgccgggaccggccctagacactgagccgcggtgggatccccaccggctctgcgaggccctgcgagcgccagggaggcgccacgagggagccgggcagccgcgggccacttcaggggggcccgcctcgccgcccgggcggtcgagagatccttgggggcacatctcggggtgcggtgacccgcccggcgcatttcgggggtcggggcgcaattgccaggggacatctggagcccggccctgcttctgtcgggctccagggtacccctggatggctgcgctgtgccctcgccggccgcccgggcgccgcagcggctgagttcgccgggatcgccgggccgccgcccttgccacccgctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgcccgaggacatggaccaggcgctcgtggacctcggcgtgctctccgaccccggctcgggcctttacgatgctgactcggagctcgacgtctttgatgcgtacttggagtagggtctcgactgctgttcccctcttccctacacgatccggaacccatgccctggaccagccgccagatcatgccgccgagctggttgggggcaccatctggacggggatggttccccaggaggagaccctcccctgcctccgaggcctacctgctcccctcaaaagcttcgtgccaacagagaggttcctgtttgaacccaggagagtggaagagagattgggactgagtgctgaggttgggaaggcacctgctcccacagaagggggaacgcaagaggcatcccaagacctcatctgcctgcagtgtcaaatcgatggcctggccttggcttctgattatttgcagctgcgatggatgtttacaggaacccagccagagtttgcctccctgcacttcatcccggagcgcacctgcttcccccacttcaccttcggagaggacacttcaaactgcggacacacgcaaaagcgactcccagctccgtttgatgtgagttgagccttcaggccagctgggtttagcccgaggctggtcttagatgcagcgactgtttcaggggtgactcagaagaaaaagaagctgaggaagctgttggggggctgagggtgggattctcgctccttcatttcaggttactcgttcttcagcaagttggcaaaacagacatcatgctggtgagtgccacgttactcccctggctggaaatgcttttctgaaagtatgagtgttgtgcctacttaattctgataaacctgtctaagcaatacttaggaggcttacttctttggattaaaaaaaaatgtatgcaactccaacccctggggccctgcctttttttttaactttgagattcgggaaaggagttctaggcagaaccttgtggctgacaaacagcagaagatccagtggggttgagagagtctgccccagtcgggctggcgtgaaagtcccaggctggccccctgcccctaggggatcctcta

SEQ ID NO: 669898 - DNA, 1445 bp, Homo sapiens
tttatggatcgccaccgggagggctacgcggcggctgcagccatgggtgctgggcctgcgggggcgcggggggtgcgcgaggacctgcggggcggggcgggagagaaggctgccgggaccggccctagacactgagccgcggtgggatccccaccggctctgcgaggccctgcgagcgccagggaggcgccacgagggagccgggcagccgcgggccacttcaggggggcccgcctcgccgcccgggcggtcgagagatccttgggggcacatctcggggtgcggtgacccgcccggcgcatttcgggggtcggggcgcaattgccaggggacatctggagcccggccctgcttctgtcgggctccagggtacccctggatggctgcgctgtgccctcgccggccgcccgggcgccgcagcggctgagttcgccgggatcgccgggccgccgcccttgccacccgctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgcccgaggacatggaccaggcgctcgtggacctcggcgtgctctccgaccccggctcgggcctttacgatgctgactcggagctcgacgtctttgatgcgtacttggagtagggtctcgactgctgttcccctcttccctacacgatccggaacccatgccctggaccagccgccagatcatgccgccgagctggttgggggcaccatctggacggggatggttccccaggaggagaccctcccctgcctccgaggcctacctgctcccctcaaaagcttcgtgccaacagagaggttcctgtttgaacccaggagagtggaagagagattgggactgagtgctgaggttgggaaggcacctgctcccacagaagggggaacgcaagaggcatcccaagacctcatctgcctgcagtgtcaaatcgatggcctggccttggcttctgattatttgcagctgcgatggatgtttacaggaacccagccagagtttgcctccctgcacttcatcccggagcgcacctgcttcccccacttcaccttcggagaggacacttcaaactgcggacacacgcaaaagcgactcccagctccgtttgatgtgagttgagccttcaggccagctgggtttagcccgaggctggtcttagatgcagcgactgtttcaggggtgactcagaagaaaaagaagctgaggaagctgttggggggctgagggtgggattctcgctccttcatttcaggttactcgttcctccgctaattggctgccctcacataatactcgtgatcctcttac

SEQ ID NO: 669899 - DNA, 1876 bp, Homo sapiens
tttatggatcgccaccgggagggctacgcggcggctgcagccatgggtgctgggcctgcgggggcgcggggggtgcgcgaggacctgcggggcggggcgggagagaaggctgccgggaccggccctagacactgagccgcggtgggatccccaccggctctgcgaggccctgcgagcgccagggaggcgccacgagggagccgggcagccgcgggccacttcaggggggcccgcctcgccgcccgggcggtcgagagatccttgggggcacatctcggggtgcggtgacccgcccggcgcatttcgggggtcggggcgcaattgccaggggacatctggagcccggccctgcttctgtcgggctccagggtacccctggatggctgcgctgtgccctcgccggccgcccgggcgccgcagcggctgagttcgccgggatcgccgggccgccgcccttgccacccgctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgcccgaggacatggaccaggcgctcgtggacctcggcgtgctctccgaccccggctcgggcctttacgatgctgactcggagctcgacgtctttgatgcgtacttggagtagggtctcgactgctgttcccctcttccctacacgatccggaacccatgccctggaccagccgccagatcatgccgccgagctggttgggggcaccatctggacggggatggttccccaggaggagaccctcccctgcctccgaggcctacctgctcccctcaaaagcttcgtgccaacagagaggttcctgtttgaacccaggagagtggaagagagattgggactgagtgctgaggttgggaaggcacctgctcccacagaagggggaacgcaagaggcatcccaagacctcatctgcctgcagtgtcaaatcgatggcctggccttggcttctgattatttgcagctgcgatggatgtttacaggaacccagccagagtttgcctccctgcacttcatcccggagcgcacctgcttcccccacttcaccttcggagaggacacttcaaactgcggacacacgcaaaagcgactcccagctccgtttgatgttactcgttcttcagcaagttggcaaaacagacatcatgctggtgagtgccacgttactcccctggctggaaatgcttttctgaaagtatgagtgttgtgcctacttaattctgataaacctgtctaagcaatacttaggaggcttacttctttggattaaaaaaaaatgtatgcaactccaaaaaaaaaaaaaaaacaaaaaaaaaaaaaactttgtgtgggcgcgcgccccggcgcccctggaaaaagtttctcaaacccacgtgcgttggggcgcgcgcgcgcggcgccccccgtgaggtaaggggcaccagtgggcccaaaacggtggtcccgaagagaaaaccgcggggtcccaggacacagagcgggcggggatttccccacccaatataaaaagcgccgcggggggaaacaccgcgaagcgggttctgtgaaaccaaccccaagaggggggcatccgagaggaccaaataagggggaactcaatcaaccagagggacgtccagcgggaagctcgaataataaaaattaagcgcccccagcggggtagaaaacaaaaacacacgcataaccatcatatacaacactagaaagcacgtacacatcagcactacatcacacagg

SEQ ID NO: 669900 - DNA, 492 bp, Homo sapiens
cggtttatgctataattttctttctgtgtacctttaaaactctggtagaggtgtttaacttcttaatgtctaagtggcaaaaatttactcaagcaaaaaaattttctgatagccattttatgtcctattattaccccagtattggaacgcacaaatttttggctaagatattgagtctcttaaataaactggagcctctagagagaattcaaaaacagtaacagtttagaagttaagaatagtaacatttaaaaagaagattattattatttttttctttcagcaaatatgagtatcagaaaccacactttgaaaaataaacatattgggggatacatacatgcacacacatatgccttttaaaatatatttcctttttaaaacccgtctttgaatcaagtggatgtaatgtgctacttttagaatggaaaatgcatttactggcacgtctctgttcaaatttattttccatgttttctttaataagaccaa

SEQ ID NO: 669901 - DNA, 827 bp, Homo sapiens
acaatcacaagagtagtggttcaaatactctcgtaagtattatgggtaattatgctgtcttaatgcagcctattgagagttgggttaaaaatcagtaatcagtacttgattacatcactgaactatgaatatggagacatcctcattgacaaatgagagggcacgtctaatcaggtctagtatagcatatcgaagcagtaggtgctaactatgggatgttttcgattaccttttgttttcaccttcttgacataatgctatttaaaggcttgaatttttcccttttatataattttcaccttctactttcaaagatgttgtagtatgctatgtgtgggtcattgcgaagagagtgcattgtcctatcattcctaaacctggtctgctttctacattcatggtatggagaaccatggtgagttcgttttgtacaggtattatcctgatggttgcttgcttaatgcatgtagaggctattttcgccattcgccttttcgtttctcgacctgttttgtaaaccctataattatgaagcgattgcttgaggaaaataacagtataaaccatagaatagaatagactgaccaaagatggtgtcacaggttatctcttttttaactaggttataaaatgagtgtatttctgaaccacttggcagacgagattcacaacagttaaatgttcatatctgaagtcaaggaagctaagaaccatgttcgctttccggtactacatgcattagccaaaaggtagtaagctcgggcgcccctgaggtatacttaactctcgaaaattcgctgtgcggaggaacaagcttcaagggaata

SEQ ID NO: 669902 - DNA, 701 bp, Homo sapiens
  misc_feature (695)..(696): n is a, c, g, or t
tttttttaaaaaaaaaaaaaaagaggggggggggggggggaaaaaaacccccccccccccccggtggggggggatataaaacaccccccccccgcggtttttttttaaaaaaaaaaaaaaaaaatttttttttttttttttgggggggacgttttttttttttttttttctccccaaaaaaaaagaagggggggtttttttttttttttttggggggaaaaaaaaaagggggtttcgccgcaacccccccccccctcttctttttttttttttgaggggggcgggagtattattttttctccaccccggggggggggggcccccctctttttttttaaaaaataaagaggggcccccaaagagggtgttttttttaaaaaaaaggtttttttggggacgcccttttttattttttgtgtgcgccacatttattttttttttctgcggcggaagggaagggaagaaaatttttttttccccccttttttttgtggggtttattttagcccaaaacccccggaggggaccctttttgggtgttaaaaaaaagaaatttttggccccgggttcaaggcgtttttggggtgggttcccctccccgggttaattaacccaaagggtgggttaaattttgtttttcaaaaaagaaataaaatatgaataggttctgtggctgttgactgtcattattcagnnagatt

SEQ ID NO: 669903 - DNA, 173 bp, Homo sapiens
actacagatgcacagaaacaagtaaggaaatggaagtgaaaccccgtacggtgactgcagaccgcaagtcctgtgctaccagatcacagaacttatatttccaccatcttaccaatgtggcaccctttgcccagaaaaacgccaggactgtatcgagggaatggacatcagaa

SEQ ID NO: 669904 - DNA, 498 bp, Homo sapiens
acttgaacctgggaggtggaggctgcagtgagccgagatcatgccactgcactccagcctggaaaagagcaaaactccatctcaaaaaaaaaaaaaatttcccaggtgaaacgggaaattttccttttgacgcccccggggggcctttgcaacgggggtgccttggtttacttcagcccacaacttctcaacccctttgcagcgaggggggagcatgtgcagcgttgacccaggggtcgcagagacaccagggcacaaggacgacaagggcggtactacgatttcacacctgtgttaccttgggcaacgggtgtcaacaaactttgtggaagcgtacttcaatggccgccacaaaaacgagtgcatggggagtccggggaagctacaagtttctctaatttacattagggacataattatacggggtgttactttataactatgctttaaactctacttttgtgtttatgaacacttccgtgtgtttacccaaaaaaa

SEQ ID NO: 669905 - DNA, 296 bp, Homo sapiens
  misc_feature (182)..(182): n is a, c, g, or t
ctggtgatcagaggatccgtgtcatccccttgtagggtctcagctcttctctaactcataacatcctcatcgtgctcgtcatcatcggcttcttcttcttccaactcagggcacttcttcctcctctggtaattttaataactgggtcttcactcccatctgcatagtctgtgtctgtccgncccacagacatccgagtcatcctcctccgcatcagcagaatccacattgtcactttcttcagccagtgggcaaacacaacaaaactctaacccctcggaaacttgtcaaattcc

SEQ ID NO: 669906 - DNA, 685 bp, Homo sapiens
atcctagtgtgaatgccaattcaaatactccagatcatatggggggtttccagaataccaatgttgaaaactcagaaggcccaagtttcagccaacaagggtcccttcaccaaatcctgaaaaccctggggcacccagaatgcggccaacagtcaatccaagaccaaattggggtcagcaaacaacatgactctagcatcccgaagtaaaaacagtggggatctctcacaaccaagtatcctgccttaaatcgccccaaacaattaacagaaaggtaaaaccaaacataagactggacacaatttaagactgaaaataaaataactaatgggacaacacaatggaagtccgagagaaaagtcctaaggaaggggtgacaaggacatgctttaagcaaaagacgttatttcatttcctaaggtctctgatactatggggaatggggcataagggacacttaactggtcaacaagagacaaatggggctgaccggattttcccaagggacccaagtgaaaaacttgccggataacccaacttgggtggacttaacttggcccaaagggggggccctggcaagggggggctgtgaaccaattgtccggcaagcaaaaaggggggggataaggggggacaccattggttcccttccgaaggttttcccaagggagggcctcgccttgtt

SEQ ID NO: 669907 - DNA, 214 bp, Homo sapiens
cagcagccgaccgtgagaattagacatatataatatagatcaacagctgatcaatgtggtcatctgtatcgttggtgtaaggccatcaacctgtataaaaagcataaatcttcagtaatcattgcgactcttgtctctgtgccacgtgtaataggcaatggtaaagatcgcattcaaaagataaaaatgtgctcgagactagttctcctggtcc

SEQ ID NO: 669908 - DNA, 288 bp, Homo sapiens
tgtccctcctgcctccctggcaggtccttctaggggccctctcctggctggctttccaggggctttccttcccctctattcagggtccttctcgggtccacaccccggtccagtcgttccctaggacttggcagagagctgtcctctcagccaagatctcagcaaaatcggcaaaggaataagcatgcagagtgaagtccagaggcaaccagacaaaagcatacagaatcctctcacagtggggtcacacaccccaagattaactccaacaacaataagatgtaacaa

SEQ ID NO: 669909 - DNA, 741 bp, Homo sapiens
  misc_feature (741)..(741): n is a, c, g, or t
gcggcggctagcgagcggctggccggctccggctggctcctcctcctcctttggtggcgtgcggcggccctgggacctgagacccggccccggctcccctctccgccacacccttgcgcccgccaacgccattgcctcgctgttaatcatgaggtcatcctgatagtggaggcaggttaggtagaaagtgaagagtgagacgatagagcgataatgcctaggagacaaatgaaggtgaatagtcggtaggagagagagaacacatgtaaaatgatgaaaaataataaaaaaaacaaaaatgaaaaagacaagagagaaacaaacagtaaaaggacgacccgaaagaaaaagcaaaaggcggtacgagggcaccccgagatacgagggcaggacaacgagtatagaacaccagcgagagacacgagcagaaagagaaacacgaggcagcgacatcaaagaataacacgacgacgacaccgaacatggaaacgaaaaggcacgaaaatacgcgacggaagacaaagagtaaagcgaacaaaagaagacgccgacaaataaagagggcaaagagaggcgaaagaaatacatacaaagcgacggacaagacggaatcaaagacaaccacgaggataaaacgccagagccagacgacgacacaacaacacacaaggacgatacatagacccaccaccaacgagcgcgcccccaccacgacaaagacaacagaacaccaaaaaaacn

SEQ ID NO: 669910 - DNA, 235 bp, Homo sapiens
cccaaattttttttttaaacacccccctttaaaaccccctttcgggggggggctttccccgggggaaagcccccttttttaatgggtttttttggggggccccccctttctaagggggggtttttttttttttttgttaagggggggaaccggggttttttccccccaggggtttttttaaggggggggggttcccccccttttttcctgaaaaaaaaaattgggtttttggcca

SEQ ID NO: 669911 - DNA, 319 bp, Homo sapiens
tgtgacgtatcctatctctaagccacagggttaatatgctgagaacgttaagaggtcaagatatcccgtcatgctatcctaacacctggcccacatttaaaaagattttctctcataataggagtaatacacattgtgaatgtatttaatgccactaaacagtaaacttaaaaatgattaagatggtaaattcttaaataaataaaaatgcagaaaattttaagaagtcactggatacacggccatgagcttttccctccttcatccaacaggtttttaacactttccccatgcaggaaaatgggctttaatagtggaa

SEQ ID NO: 669912 - DNA, 106 bp, Homo sapiens
  misc_feature (38)..(38): n is a, c, g, or t
aagctccaacaagagaggcagagaaacaggtgatggcntggaggcgggtgtggggcaggtgaaggtactttgtgtgattgctttaagatgggagagatggcagtca

SEQ ID NO: 669913 - DNA, 839 bp, Homo sapiens
taaaacaaacccggttcctggggggggggtgggtataatactaagttgaaatgatatcatttaggggggaaggcgcttggtgaagtaggccttatttctctgtgtccttccgaacgagggggaggaattgtgaacgtagatagaacccgaccgtggattaccccggtctcgtgaacctcagaactcacgttagagacttataactcgatagaacaaacgaacccttataaataggcggcgtgcaccaatcgggagtgctccgtgactccaacactcgaggtcgataacaccctatgggtgtgatagtgtgactctcaaaataggatggcgctgtaacccctagggtaactgggtccctgtggggtcaaaagtatatggcgatcaatggagtatagtagtctcgcattaggactgggtggaagtctaagcatgtactggctcggaggtaggaggtcctgccccgaggtcgccccaaccgaaattttaaaggcaggttgggaacgtaaagagaccgagggggtatgagaaggacacgggaagagcactacaaataaataaaagccccaaagggcctcaacgaacagacgggagaaaatgcacacgccaacatacaagggggaaggagcaacaacacacgtggtcgagaaacgtaaagaaacacggctgaacctctccggagagaccaatcaaaacggggccccctattaaagggaacaagaagaatctgccaccccatagccgggagggagcccgcgcggacaacatggtgccaggggcggggggcccaaacggggacaaaggagagaaggacaaagcgaaaagacaagcaaaaacactca

SEQ ID NO: 669914 - DNA, 495 bp, Homo sapiens
tccacgaaggtgagtggcaactttttatgtttgctaaatgggatggcaatattagatttacttcttctgcaaccgtggtgtcaaaaatctgatagcaattttgattatctgtcccattggtgactttgtttgacttgatgaagctttccaaccacggttatgctttaatttttaattccctggaggacaaaacattattccattgatcatattccacacttttctgaaggtcatcatccatcagaacttctgatgctggaattctggaaaaatttgccagaattccatgagataggcttctagtactcctgtcccattcttcaagtgtaagggtcttaacaaacacttttgggaggggttcaatacccagtgcttctgccacagaagaaggattccacgatgttttatcacccaggaaatttagatttggtatggatctcaaactagaacactgtttacttccattgtgatgtttggtccctgctttacgaaatg

SEQ ID NO: 669915 - DNA, 780 bp, Homo sapiens
tgtacaggcacggttccttacgccccatgtgtgctggtgtgtgtcctgcctgtatatgtggcttcctctgatgctgacaaggtgggtgaacaatccttgccagagtgggctgggaccagacttgttctcttcctcacctgaaattatgcttcctaaaatctcaagccaaactcaaagaatggggtggtgtgtgtgggcaccctgtgaggtggtccctgagaggtggggtgcctctccagggcacatctggagttcttctccagcttaccctagggtgaccaagtaggtgcctgtcacaccagtggtggctggcatcttaactgtgtgatgcagatgtgtcctggtttcggagtgtagcagctgtgcttgaggcatggctcgtcacccggagtttgggggtacccgttgccagagccaggtacatgactgcgggcggaaactatgggatctggccaagttggactttgatccattgggcagatgtcccatagcctccctggagcctgtcatggcctgtaggggatcaggcagctcactgatgccagaacacctcaggcgaggagaaccttgactccagctgtaacttgtctgacttggacttgtccgcctgataccacgaagtctccccttgggaccaagcttggaggttgccacatagaacacaacagtctagctgtccccagtgacactctgaagacttgatggcctgcatttccacaggtgagcgggctctgtcaccacaactcagtctctcatgaggttcattcatgagcaaactag

SEQ ID NO: 669916 - DNA, 142 bp, Homo sapiens
ggtcatcggtagatgcgccaggtactcggcaagagtctctggctggacttgagaattactcatcggcaggcaactgatagctccagtttcggtcaggacttgctgtcgacgccccgcggatttagtagtagtaggcggccgc

SEQ ID NO: 669917 - DNA, 309 bp, Homo sapiens
agaataggatagttagaaagctgcctatggctggagggagaggcttatggcgatctctaagctttgcaaggggcccttcagaagtcgctgtggctcgtagatgctcataggttgtggcatgggaatgaccctgttcgaagagatactcgcccagcccagcctccgggccacccagcctgtggaggttggtcaggtggtcacccatcttcttgataagcttcacttcctcatctaggaagtgagtctccaggaagtcacagagatgggggtccgtgcgggcagaacccagggcatgaagatccaaaaggg

SEQ ID NO: 669918 - DNA, 826 bp, Homo sapiens
  misc_feature (653)..(653): n is a, c, g, or t
gtcgtggcttgcagcgaaaatagcgccagcagtttgatcaactggtccagggcaataaaggctatgcccatcagcacagcaaagcttcgtcctctcaaagcgtcctgcatcttcaacattccattccttcgtgtgttttcgcctgaatcggcggcggccagaagatatcgcacggcctgcgcagcgtccatctttgcaccggcaccgcccggcacacgccctcctccacatagaaagagcgggcacagtcgccccacacattgcctgctcttgggctcaaatccaccgtgatcagattgtgtaaaccgacggcttcatcactgggccgatagtcgcgtcccgactccgaaagcgcactgcgcgaacccagcaacacgaaggccgggcagtcgtaataccaggtctccggatagccggaatccgcaagcatctgcgtcgccatttcggcaatggacgcttcagttgactgtggcgtgattcgcgtaacgagctgctgcagcaccgacttggcggcggcctggaccacgcgattaggcaacatggattgtctctgactgatgggggattgcgtcgatagtatcagcaccctcctcgacagggagacgtgctcggattttaagctcgttcccacgctccgcgtgggaatgcctacngtgacgctccgcgtcacaaaggcagacgcagagcgtccagggctgcgctcccacgcagagcgtgggagcgatcaagtctcttcaaaaaaccgaccatccgatgcgctcgctcaacaactccaacgccttcatccccgccagggaattgcccgccgcattcagctccggtgact

SEQ ID NO: 669919 - DNA, 617 bp, Homo sapiens
ggggatgaaggaggatgcggcgaatcatttataaatgtgcgctgaagcagtgactccgaagcctaaattccagtgagggtgagtcgagtgctgtgctttcatggtgcctcttcttgtatgaagcaaagtgtgtaaaggtttgccataaaggacaaacaatgtgaaatacttcatacattacagtggttggaatatacacattgggatgatatggtgcttccggagagcagagtactctaaatactgtggtactatcctaatttgcagcaaacagtcgagaatcttcaaaacagcctgagtcagtgagtcagtcattgcagcagtgggaatgatgacgatggggctgctcctaggaatagaagacatctgtgtctgctaatgagaaaagatgttgaatgtgaaatacgaaatagaacaaacatgaaaacacctgtgaaatggagatggtggcagtatcatgttgagatcccttcatgacctccctcgtgaatgactaatgggccctgggtagactctacgtgttgaaaactgaggaaaacattctatcgaacagagttgaagttacaatgtaaatgattccttgaagagctaagacactgtggtttgttgatgactgg

SEQ ID NO: 669920 - DNA, 248 bp, Homo sapiens
ccgatggcgaagtttccaacaatatgagtctatgtattataactcaactgtacatttaagatttttttcaagatgctcaaatttcatgttatatatcaaactgcaaaaaatgttttcacacaaagtcaacaagcagatggcaatagggcctgtggcaaatcattctcaaataaatgccattcttaccaatgtccactaaatgcaaatatctgcatccctcgcattgcaatctatgtacctgtagcata

SEQ ID NO: 669921 - DNA, 178 bp, Homo sapiens
cagagaaagctttgttgagatataatttacccatttaaagtatataattcaatggtttttaatatattcacagatttgtacaattatcaccacattcaattgtagaacattttcgtcaccccaacaagaaacctcgtaccacaccttagcaatcaccactcccttctgtcgtcttctc

SEQ ID NO: 669922 - DNA, 269 bp, Homo sapiens
actcactgcacgaatcatctggagctagagatattgtaaagcatcatatgacactactattgcttaaaaactccacgaatcttcaagagagcaatataggaatggagagccacaatatgttatctgaaaattgagatgtgatacgactgaggggcactctaagagtctataacccctggcacactgatgatacatggtctactcttagaagaggaatgctatctttctggagatgctctagggtagaacacggattgagactctatata

SEQ ID NO: 669923 - DNA, 200 bp, Homo sapiens
accccagcgtgctgggaggagtcacgtgttctgccagaaaagaagagctctctgttgaaattctctggggaagccctgggtttcatcaattgaggacactgcaggttttctcagaacctctgatagattgagcctgtgagtctccactacaggaatagagcgctcagttccccaacctttttacaccatgaaaacacttg

SEQ ID NO: 669924 - DNA, 830 bp, Homo sapiens
tccttaattataacattcacaggcacagaactaatcatatttatatcttcttcgaaaccacacttatccccaccttggactatcatcacccgatgaggcaatcggcaggccagaacggcctgaagcggcaggcagatacttcctattctacaccctagtagggctcccttcccctactcattcgtgaactgatttacactcacaacaccctagggctcactaaagcattctactagtcactctcactgcccaaggaagctatcaaactcctgaggccatagcaacttaatatgactagcttgacacgatgagctgtttatagtaaagatacctctttacggactccacttatgactccctaaatgcccatgtcgaaggcccccatcgctgggtcaatagtacgttgccgagtactcttaaaactaggcggctatggtataatacgcgtcacactcattctcaaacccctgacgaaacacatagcctaccccttccttgtactatccctatgaggcataattataacaagctccatctgctacgacaaacagacctagaatccgtcattgatactcttcaatccaggcacataggcctcgtagtaaccaggcgaattctcatgcaaaaccccctggaagcttcaacggagcagtcattctcataaatccggcccagggagttagatcctcattaatattttgctaagaaactcaaaataagaaaggacttcacagggggttaaaaccttcttcagggttaaatcttatcccactataggtttggagagttagaaggcgtaactcggtttaccccatttatcttggagaccc

SEQ ID NO: 669925 - DNA, 926 bp, Homo sapiens
tcggccccagcggatggggaatcttttttggggacaaatgtgtgatcacggcgccgccatataccgggggcgactgtgaactccccccctcccatcagagcgcggaattatattattttggagcgcgccacccggcccaacacacccagagggggcccccccgcgcagactcacacacacaacccctcgtgccgggcggagggtaccacaaaacaaatcacgctcccctcgggaggttgtgacacctggggggattttttctccttggggggcccaaggagagaagtgtgttacggttgctgtgcagcctagaagggagttcatcatgatgtgtgtggttgcgccacgcacagacgagcatttgatataacaggagagagtgtggtgtgtgtcttcaccgcagggaacaccccgggtggtggagagaatttgcgctcctgggggttcttcttgtgcacagacaccccgcctgccgcgccccgatgtggttggggagatctcccctccccttagtgggtggtcccccgctgtggcgccgcacacaaaagaggcggggccaacacgtctgttctctcgtgatggaggaaagaagaagatttgttactcaccaacgcatgtttttgatatcttctcgagagagaatattagtataaaagagagaaaaagaaaaatgcgcccattcaacacgctttctctgagggaggacacttttcccacgaacggcacaagatttgtgtgggtggcgcatctcgtctccacggagaacgcgggcaaacatgatggccggacaacatgagtgcttattgtttttaaggggcaaaaatgggggtttttttttggggaaattagagcccccccaagccaaataaaacccttttttttttttcccccaaaaaaaaaagggtttttttttttttttcccccca

SEQ ID NO: 669926 - DNA, 1050 bp, Homo sapiens
ggcctgaccacgcagttcttgggtctgtgctgctggcctggggttgtggttgaggccgggtctccgctcctgtgcccgggaagatggtgctaggtggttgcccgacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaaaaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttgga

SEQ ID NO: 669927 - DNA, 392 bp, Homo sapiens
ggcctgaccacgcagttcttgggtctgtgctgctggcctggggttgtggttgaggccgggtctccgctcctgtgcccgggaagatggtgctaggtggttgcccggttagttacttacttctgtgcggccaggcggctttgctgctggggaatttacttctgctgcattgtgtgtctcggagccactcgcaaaatgcgaccgctgagcctgagctcacatccgctggcgccgcccagccggagggccccgggggtgctgcgagctgggaatatggcgacccccactctccggtcatcctctgctcttacctgtagctaccagtggtcgaggcggtgacgtggagggtgtccagaatatatgggtttaagggaggcaggttggggcacgctgca

SEQ ID NO: 669928 - DNA, 520 bp, Homo sapiens
gagctggggttaatattgataattgttgtgatgaattgatggccctaagatagaggagacactgctaggtgtaaggagaagatggttaggtctaccggaggctccagggtgggaatagttccctgtctaagggaggatagactgttcaaacttgttcctgctccgggcttcaataataggcagatgggagcaggaagtaggaaaagaaggaggtaaagagtcaagaaggcttagtggttggttaattggcggggaaaacggccaataattcggggggcaccggatttattcaggggggaactaagtccaaggttggccaaaaaggcctccggaattaatgaatgggtaaatttactaattgaacgaagaattatttacaaaatggcattgggcttggttgaaccgattaaaccgcttcggtagacatgtgggtcggttaccctaaggaagggttggcttggcttagggccaagccccgggcccggggtaacccgaagctccggaatttccggtaaatcca

SEQ ID NO: 669929 - DNA, 1245 bp, Homo sapiens
  misc_feature (1245)..(1245): n is a, c, g, or t
ggccctttgacctgtcaaagtgcaaggacggctgcagggcttcattgtggagcctcggcagtatcacactgaggcaggggtcagctgaaagacaaaagcacaaaatggcgaatagtcagatggggaggtgggaggacagctgtccgggctacacagtgacagtgggacattccagactcatgtctctgcatctcctgctgccttaggtaacctccgtcccttggaggggtagggataaggcagtgacttaacattctcccagtcggtgcgaaggtactaacactaccttaccatgtacacacattaactggcagttcccggtggtcgacgatgtccaccagacaggcacggatgaggggtgggtactacagcagcacatgttgattgcccaagacaaacaggcctaagagtcccgtcctgggaccctcgaactcaatggcgacagaaaatccgcgcaatttaaccacgtgaaacacgacttcccgacgtgccagggacctccccacgttggctccgctatcacgcgaccgatacttgacaactgggacttgaccgactgctcgcacaattgactcaagatgcaagacacgctgccctggatacctctctttggcccaggcgcaagaccaaagaagtctgatactcaacaacaagtttcgacctctctccgaacgactctgggagtccacacaccagcaagtactacacagaccgccgggcaccttgctctaccaggaaggccaaactggcatctatgggccactagcgccaactctccccaaccacgttgtgggaacacaagacatggatatttcgcataccaagcggaatcttgggttcccacaagaacaattgaagttgaaaacgtcgtccaaaagctgctaagaagtaagctttcacaccagcctgtaacctaccttatcgcgtaccacgatccaacaacaaaaacgcacaccgaggaggtacagacaacacacggatgcccacagccaggcccatcagcaaccgcagcgaccacacaaggtgacaaagcaagcatcaacccagtgagacaaaacatctcaaccgacaaacaaggcgaggatcattacattcagaagagcactacataaagaatagcggctccagtttcactgagcattatgatacatgtacgagaacaattataggagacgacatacgaacatgtcacacaacaaagccgcagcattaagatagcgagcagagtctatgtctctatctccn

SEQ ID NO: 669930 - DNA, 263 bp, Homo sapiens
cgtgacataaagatggacataataaatcagcccagtaaaccaaaagttgggattccaagcctcaggtgacctccaaagtaccctctacatgcatagcaaatataaaacatttgaggtatcggaagtaatgatataatgatgtaatagcagtggtaaaaatagcataggtggtagttataatcagtgtaacttttacagaagactttatttaaatgaaacctaattgttattgacctacctatttcacaatcgggataccgagc

SEQ ID NO: 669931 - DNA, 187 bp, Homo sapiens
tgcaagtccagacacacaggcaatggataacaggattactcaccatgtcgtgcggccagcaggcatcagcagggcagcagcaccagcttgacatggcgcacgtacatggccagggacattgacaggtttcacaaccatgatcttacaaggaccaatgcagcaataaccagcattatttggcaacaac

SEQ ID NO: 669932 - DNA, 3040 bp, Homo sapiens
gatctggctcccggaagttccacgtcagtcagtctgacggtcagtggatccctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaa

SEQ ID NO: 669933 - DNA, 3307 bp, Homo sapiens
  misc_feature (8)..(8): n is a, c, g, or t
  misc_feature (11)..(11): n is a, c, g, or t
  misc_feature (32)..(32): n is a, c, g, or t
aagaatgnatntgctagtacgaggcgggtgtnaattcggccgaggatcggtgggtttatctcaaggcctgagtagccggtaacaaacgagggttcccgggattggaccgacgcagccatgctgggcatggtagcatgcgcctgtagtcccagctacttgggaggctgaggcaggagaatcgcttgaacccgggaagcagaggtttcagtgagcagagatcagcgccactgcactccagcctggacgacagagcgagacttcgccactgcactccagcctggacgacagagcgagacttcgtctcaaaaagaaaaaaacctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaa

SEQ ID NO: 669934 - DNA, 115 bp, Homo sapiens
tactctagaggctcccccccagtacgcaagaggtgccaggatctgcttgtgcaggaatgatgggcattatgtcaggctgcacctctactcaagcttgctgtacactgagcgggca

SEQ ID NO: 669935 - DNA, 3309 bp, Homo sapiens
gatctggctcccggaagttccacgtcagtcagtctgacggtcagtggatcggtgggtttatctcaaggcctgagtagccggtaacaaacgagggttcccgggattggaccgacgcagccatgctgggcatggtagcatgcgcctgtagtcccagctacttgggaggctgaggcaggagaatcgcttgaacccgggaagcagaggtttcagtgagcagagatcagcgccactgcactccagcctggacgacagagcgagacttcgccactgcactccagcctggacgacagagcgagacttcgtctcaaaaagaaaaaaacctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaa

SEQ ID NO: 669936 - DNA, 685 bp, Homo sapiens
  misc_feature (638)..(638): n is a, c, g, or t
gtctcgagtttttgttttttcattttttggcaaggatacaaaaaattttatccgaagcccaggtacaaacgggccaacctgcctctacagcgtccacagcaaacacagggtctagacaagggaggagtttccctcaaacggtttaaatcggttctccccgcgtcacaagccatcgggtaaggcaagcggaagtgtgcgttggggctccccgtggtggcctccgcggctcacaatactgagccgtggaaatgtgcgtgttagcaaaatatcctttgtggtttccccataaaaaaccgccgccgccgcccctcgggttcctcacaacaggttttaaaaaatttataaactttttacccccttgtttacacgctttaacggaaaggggaccctaggagagcccccgggtacaggacgcgggggcggattaaaagagcccagagaacacaggaggagcgcccgcctcccgggccccagcatcagaggcaggcaaaacacagaattgagacttgggcccaaattttgagggaagaaaaacaccctgaagtttgaggagcaagtttcctaggcaactgcaggtaaaggcgtgtgtgtatggcacccggaggcaatgccaaaggcgggacacgcccgccccttcnctaaagctcaagggcctaagataggacggggcccctgtgctgaccca

SEQ ID NO: 669937 - DNA, 4577 bp, Homo sapiens
  misc_feature (3024)..(3024): n is a, c, g, or t
gatctggctcccggaagttccacgtcagtcagtctgacggtcagtggatcggtgggtttatctcaaggcctgagtagccggtaacaaacgagggttcccgggattggaccgacgcagccatgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagcagcctgatccttggccccttgagccgactggccatctggatggagcacgtgatacagctggaccaagttggttgcatcatcgattctgagaatgaaagggtttaatgttatctaggggttttcttcatttgattcacagtcctataaaagtgtgtgccaacttcaaactaaattacatttcagactttcctcaggctggagggattggggaaggaccttcagttttacagtttcaaaagcattttcaggaaaattgactaatttaggcctcacaccaantccgtgaggcagctagggcaggagtcactgcaggaagtgtccaatttatgaaagtgaatatattccaaatgtggctatattctttttggaaaaagagcaccatttctcacagaaacagcattcctaatggtagacaatttccaggccagcttacttcaccagcatgtaatagtctaatccaactcagaggacagaaacacagcttcatcccacataagcaggagggtggtggtcacagggatctcaaagtcacttgcctctaagtgacatttgctaacagacaaatgcctctacaagaggccccctaagattccaaggaaaggattcacaggaacgcattagtaaaatagcatcctagtgaagcaaatttgaaattatacacacacatcagacaaaaaggaaaatcgggttctacatcagcaatctgtcttaacttcagcatcacacaactacctatgaagaagacagaacaagaattcagttcttctggtctgtacttctcagaaatgtataaacaatttttatcaacattaaaactgtcctagcaaaaccaaacaatcactatcttttcacacagctgacactttcccaccatttgccatctcatcgctggagggcacagaaaaacgacactcaaaatgcttgtgcttttgaggctctgctatatacactaagtgaactactggcttccagttgggaatggagggctgaggacaccctaattcagtgcttccgcagctagcactcttcagccttccctgcgttccccttacctgagctgggggatgaagagcagggtgacagtgggagtaagtacagaattcctcaagccttggtagccttagagaaatgctctgggcttatactgaggctcatctaccctaaaggccatctctcaggaaaacagagctgttgtatcataaagcttttcagggggaaaaaaataaaaaatgttcatcacaaatctattgtgcttgttataatctaacaaagtccactaaatgtagtaacgaaatgtctccccaataaaaaattaagattccctttggagcttaggcatgtggccttataaagagcttaactggactgctacctgttggtatgttcagggcttcattaggttcatgcttaagtataatgcctgtgcctcacagaacaatttaaatttagcttaacaccccacccatacttaaagagcaaataaattatatttcgaaaagattttaaaataatctcaatataaaaaccaacagtgggaactgagtctggaataaatgtgtgcagaatcctaattcttttctgagctccactcagtgaggatatgcaccctctactgtccagcctgtggtttgcagtaagctcactcttctgttcagaatgaccacaggagggcctttacctaggaatagcaggaaaagctaagtaagtactcaaacttccctcccagtaagcatgaattgcttcagatgtaaagcttacatgtgatgagtaatactataatatcatacattaatatatcctaataaactttaattttcaaacaaaaaaaaaaa

SEQ ID NO: 669938 - DNA, 243 bp, Homo sapiens
actagtcacggttggctcagaatcttcagtgaagtctgagccatcttccccctgctctacctcctctataagctaccgattcattacttctctcccagtgaactatctagtcaactattaactaatcgtagtcaagtatgcaaacggggtgtagaactagacagggttgtttattggttgttgatcttaagcgctatatgaatggtgagattgttttaatgtctataatgggtgttaacttat

SEQ ID NO: 669939 - DNA, 365 bp, Homo sapiens
gcatagttataattgcccacgcctggctgtccccattctatgtctgcgccatgactgcgggtacctgccatctccactctgtcactagggctcctggctatggggacactgaggaccagccattgaggggtggaccctcagaaggcgtcacaacaacctggtcacaggactctgcctcctcttcaactgaccagcctccatgctgcctccagaatggtctttctaatgtgtgaatcagagcacaagcagcccctgcacaaagcccttccatgtcgcctctgcattcaggatcaaaccccgaacacctgcccaacctgctctcctcttgccactgcctcttcctcctgatttccaccttgccaggt

SEQ ID NO: 669940 - DNA, 3709 bp, Homo sapiens
gatctggctcccggaagttccacgtcagtcagtctgacggtcagtggatcggtgggtttatctcaaggcctgagtagccggtaacaaacgagggttcccgggattggaccgacgcagccatgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaatgaaggtacttgtttcctttctcaataatgaaaataggcttctagttttagaaggctgagccgaaactacaccttgcctagggatcagccccactgtcttttctttgtataactaaatctgcattttcaaatgttgtcaatcacatatttcttagagctgaatatccaggctgtagtctctaaacccttttcttgaactcattgcatcattccacaggtttggccccgaattatggtcaaccgactaccatttctggaggccagcactgtgcaacccctggtcctctgtaccccataaagccggggatctaataagtatacgttggcctatttggtacccaaaaaaacgcacaaactttttcagcgcagctattaaactgcaatgcaaacatgctaaaccggaccatccaaccacgctcagactccacagcgaagcaaaacaacgcagccagagaaaaccacgatgctacacaccacacaatgtccatacagccaggcgatgaagacacaattcatctagccgaccacgacagacaacagaatcaagtatgcaaccaaaacatcacacgacgattctctgcagtcatgcgtcatgtc

SEQ ID NO: 669941 - DNA, 3591 bp, Homo sapiens
gatctggctcccggaagttccacgtcagtcagtctgacggtcagtggatcggtgggtttatctcaaggcctgagtagccggtaacaaacgagggttcccgggattggaccgacgcagccatgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaatgaaggtacttgtttcctttctcaataatgaaaataggcttctagttttagaaggctgagccgaaactacaccttgcctagggatcagccccactgtcttttctttgtataactaaatctgcattttcaaaagcgagaaaaacaaaaaaagagaaaaaagaaaaaaaaaaaaaaaaaaaaaaaaaaaaaaaagaaaaaaaaaaaagaaaagaacaaaaacagaagaaaaaaaaagaagaaaaaaagggaggcgggcggccgaagcagcaacagaagacatcggacgcaagagggaaaagcgagtgacgaacgcacgacacgcacagtgagctgacaaacgagcaggccaccacaaaaggagaaaaagaagacacgagacaagagaggcgcgcgcgaagtatcaaaaggcgggccaggagagaacaacacacggcgagacactaagcagaacacatcactcatgtgaggggcagaacaaa

SEQ ID NO: 669942 - DNA, 2729 bp, Homo sapiens
tcattctcatgtattttgattctgtcacttaaataagaggaccgtcagctgtcctaaagagaaactgaaaaagcatgtgctttggagtcaaacaaacctgggttcaaaatcaggctctgttatgtcatgaatgtgtgtttgggcaaattatgaaatggaaacatatatatctgcttcataaaattatagtgagaagaaattgtgggtagaaagcatctggcacataggaaacactttacccaggaaatcctgttattatttcatgtttaaaatcgtaattcttagtttttgtttcttatatgttatgtgttatgtttatgttgcttttaaaaatcatttaaagacagtaggtcaaaaaattggtcattaagctgccaggaagtgttatctgtttgaatagaaagacttctatgggtctctttcacctgacacagtttattgtcggatgtttgtatcaaaagggagtatttacattgttctgaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaa

SEQ ID NO: 669943 - DNA, 1569 bp, Homo sapiens
  misc_feature (1233)..(1233): n is a, c, g, or t
gtattttcccgtttgaggtcttggtagtttttattttctttttttataaaccatgtgggtgcccctttataatttacctaattgttacaaaatttcctcaggcattgggtctggtcgggatagatatttatggaagtctttccaaataccactttctttaaacgtggtgaacactcctagtggtttccccagtatttattggaaccagcttatttctggccggaattcactctattagattcaaattattgggctcttgggggcaccaaaaattggcgcgggttgtataagcgaggctggaaccccccgagagtatggtcccgactcgttgcgggtccatcgcggggggcatatatcgctcttccactattttaaatttagagacacctcctcctttctaacagacggttcactgggctttcccacagataacctggggctcccttccttattaaaaaggggggaaacacttgcgcagatttttatacaagagggaggcaggcacgaagatctctatgttttctccattatatatttttaaacaagcgcgctatattgtgagaagggcgctataaacggcgctttattataatttccagcataaccatgtaggagcgggtcgaaccgctggcgcgggtatataataaaaccgcttccaaacgttcccaaagacacttctttttatcaactcccctttctaccaccactctgtggtgagacaacccacgacgggttattttttactatcttcttctctcacaacgaccgcctcaggagacctcctcttaatttgaaaataaccagattttttcacaacccacacgggttgggccgtgggaacaacaaactttgtcggggccgggtcccccacaaaacgatgtggtttgggggcgcaacagattttctcccaccgctccatattattaacccctttagagaaggcggtaaaccccgctttatgttgagggcgcaattaaattcttccataccaaactaaaaacgttccagaaggggtccccaaacaacagtctatactataacagcgtcgttataaaagacacccacaaagacgtgtgtccacaaaacacactttttagtggtctcccccccaagaggattaaaccatattttttcgcgcgtgggttcccgccgtgggtgtcttgaggggcacaccacacaactgttgcccacacaacggcgtcaggctgcttcaaacattcgtctaccaccgcnttggttcgctacacaaccaagacagagggcggcccaaatataggggtgcccccccactttaaaggagttgctatatttgtcttccccacagaagaaacatcaataaccgttgtggagggaggaccattccctcaacacgcggtcagtctctctagggcaccagacgcttcgccgttcaaacgacaacacttgcgtgcgcgagtccatacgcaactacatactatctggcggcgacatcttcgaacaatatgatatcggcggcagcacgactgcccacccacagcacgcataacttctccaacgactgtccgactactacttagcggcgcacgtaca

SEQ ID NO: 669944 - DNA, 136 bp, Homo sapiens
gagatgcagatcagcacctgcttctctgtcttctgaactgtctgggaccatcatggctcacactgaaggttttgttatccatcaagtctaggatttttcaccctcgacgttaccatgtacccaatcatatagaata

SEQ ID NO: 669945 - DNA, 3577 bp, Homo sapiens
gatctggctcccggaagttccacgtcagtcagtctgacggtcagtggatcggtgggtttatctcaaggcctgagtagccggtaacaaacgagggttcccgggattggaccgacgcagccatgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaaaaaaaaaaaaaaaaaaaacaaaaaaacttggtgtgcggcgcgcgcgccctcgggccctccggagaaacagtttctttaaacacatatccggtgtgggcgcgcgcgcggggcgcccaaggagggtaaaggggaccatgtgggccatataggcggggttccctatagggagagactccgggcgcccagggacataggggcgggggatttctctccccatatataaaaaaccgcgccgcggggggaaccgcggagggtttctgagaaaaacttcacaagagagggagagttgcgggagggtccatagaggggggagccttattacacacagagggaggtccaaagcggagacgcccagattactccaaaattaagcgccccggacacccggggggggaaatgacaaacgacaaaacaacagaaagaaaccaacacgaaaacaaaaaaaacacaacaaagacaacaaac

SEQ ID NO: 669946 - DNA, 514 bp, Homo sapiens
tgggctcacgagttccacccggcacagactccaaagctgcggagatgtataagcatgagccaccatacctacccacataatcacctctaccagacctaaactctcaacactgattacactggggattgagtcttaaacccaaagcatgctaggagggacacattcaaactgtagttatatgtcggattatgttgtatatagcccactgtatccaaactataatatcaacaagttgacacatataatacagttagtaactgtgctattatacattcattactaagtctttggaaactcatgtatattttatacttatagatggccgcataagcaatggcccctaggttaactagttggataaacataaccagctggatagtccaggtctagaacaatgatagtatttccagcagtggacatcagatcctagcagataacgaaaggctctagaaagtgactcaggccttgaggaggtagtgtatgctgaacaggctgatcatatggtatcacccag

SEQ ID NO: 669947 - DNA, 253 bp, Homo sapiens
attctatatccccgccgcgtcctttctccataaaattcttcttagtagctattaccttctttttttttttaaaatttccgttgaagtttttttaatccccaaaatctcctttaagtaaacacggcatcttacaatcaatccatctttctttttttctttttttctttttttttttttgggagagggagtcaaacccgaacacgggggaatcctcaaaagtcaacgggagggtatgcaggtcggggcaggggcg

SEQ ID NO: 669948 - DNA, 3230 bp, Homo sapiens
  misc_feature (3024)..(3024): n is a, c, g, or t
gatctggctcccggaagttccacgtcagtcagtctgacggtcagtggatcggtgggtttatctcaaggcctgagtagccggtaacaaacgagggttcccgggattggaccgacgcagccatgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagcagcctgatccttggccccttgagccgactggccatctggatggagcacgtgatacagctggaccaagttggttgcatcatcgattctgagaatgaaagggtttaatgttatctaggggttttcttcatttgattcacagtcctataaaagtgtgtgccaacttcaaactaaattacatttcagactttcctcaggctggagggattggggaaggaccttcagttttacagtttcaaaagcattttcaggaaaattgactaatttaggcctcacaccaantccgtgaggcagctagggcaggagtcactgcaggaagtgtccaatttatgaaagtgaatatattccaaatgtggctatattctttttggaaaaagagcaccatttctcacagaaacagcattcctaatggtagacaatttccaggccagcttttcacacagctgacactttcccaccattgccatctcactgtggggaggggtcgc

SEQ ID NO: 669949 - DNA, 1357 bp, Homo sapiens
agcggatgggaatctaatgccgttacaggcggagtttaggcggtaatgctcactcacccacccacccactgctcaccctctgctgtgcggcctgattcctaacaggccacagactggttgtttgggagacccctggtttaaaagcttgttcttaatgccttaatggagcatgggaaggaaattttagacttcctgtcttttggatacttgctgaggaactggacttgagaccaacaataaaggaatagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaa

SEQ ID NO: 669950 - DNA, 428 bp, Homo sapiens
ctctcaggctcccgagacctcacaacgagaccacacatagtgtctccctctctccttagagctacgtatcgctctctcgaaactactcgctatagccacgagtagctatacagttaaactaatactgctacgctgaacactataacccacaccctatacagcttagaaatgtatgtcaatcagtaatcaaggtctgtcctctagtaaatacgtaagattctcctgacaatttcgtatcagcccactctctatctcttttcgcctttaaaaatccacttgtaactgctgctagataccaggcaacttgaatctttgctcccagtttacaatcttcaagcttggcccaagtgaactgtctacttacatttgtggttcctcagctttttcctatgaaggaggacaatcaggacatattatttagaatgtgc

SEQ ID NO: 669951 - DNA, 1675 bp, Homo sapiens
  misc_feature (759)..(759): n is a, c, g, or t
  misc_feature (1164)..(1164): n is a, c, g, or t
gaagatgccggccgagatacggctacgtgagcctgggtgcgcctgggggtcgcgcaaggtgcgcgtcttgctgccccgggcatgcgtttcgcgccccgtggatccgctgtgcgaacgcgctgaacgagcgttcgctctgacctgggctgaatcctctacggacggaaggctcggggctttcagcagccctgcgtgtagtgcttcgtcggcatgtgacgttagagactcgagggtctgctcgtgaggggggagcggtggggatccaatgggccacgttgggcattgccgagaggggtttcacaccgaaaatagacgggcatgggctggcggcgtacacagcgcctttggtgggtataccactatggtcaggatgggaccagcacaagcgggtaattgccgaagagcgagtggagaatgcgcagttccgttccctgagccgggtgcccattacaccttttcgagtacgacagaggcaccccatgcctcgctgggtcgaatacgccgctgtaaggcctccctccaggatagtaggcattggtcctaaaagggtctgggcacccgcaatgcaattccagggttggtgagtcttaaacggcgcggagaagggagcgcgcggagggtccccgggtgaacgtaaccacgccattcctgtcgagggggaatctcacaaaggaatccctaaatggggagaccgcatagagaagaagcaatcggcaaaagggccaaagagcaaaaaagcctgggcaataggcggaaaangagagacggcgtaaacaaggaaaaaagataccccggaggtggggctgaaagggcatgacccgaagaagcacacttggagggtaccggcaacaccggtggtattggacctggtcccaaagttgtaagagctcccgcgatttgtggaaaaccgaaagaggggcgtccacacactgggacattgtgtgaccgggaccaacaaattcgcccttgggcacagagtcaacacgtgttgaaagaccactgacaaaaaggggccttcagcgattggtggccacgcggcgcttctgaacccaatgttcacgcgtgacactttgaaacagacgccgaacaaaggtcgagagacacaattggatccgagacacaagcagaacaaccaaggtggcgtcttggacgcggaggcgacgnaaaaggatgcatctggaatgtgtgccagtgtcggaaacaggcaaaggaacagtttgtgacgagaccaatgtgcacccgtcttttgtacaggggacagacgacaaacatgtgctgtcttttgacacacaccattggcatgggggtctaggtgacccacagagaaagagaggaccaacattgtgagaattccgagagcgaccgaatcgcgcatctaacgcaccgctggaatccgcgaaaggtgggcgccataaaagaggcgaagactcagtggtgtggagcatggccacccaggctggagacagtcgtggcaaggcgcaaattgacgaaaccaccctgtgtgaagaacgcaagttgccaaatcgcgagaggagagcatctgggacaagaccaaagagatggagggttggacatgaagaaaatggagagataaccaacagaagaacgagcagcgaggagagtggcaacgcccacgatctgtatgcagcttcccacgtgagaggacaccacgaga

SEQ ID NO: 669952 - DNA, 525 bp, Homo sapiens
ggtgctggaagtgatatctgggcttctattggactatctggtgtacactgggcaaaggttacagatgctgctggaattctaacctgcgctgctggccctttcccacgggttttgggcctctcagaaggggcaaccactgaagaagtacatcggagctaccaggagctcgtgaaggtctggcacccagaacacaaactggaccagacagaggaggcacagaggcacttcctggagatccaggctgcgtataaagtcctgagtcaaaccaggaagccctggggatcccggaggtgaacagaaacttccccctgaggactgactcttcctagcagagctgggcaaattgtcccaaatctagctttgcccaagaatggcatcccagcagagttcacgcacctgcttgcaggggctgggcgtggtggctcatgcttgtaatcccagcactttgggaggacgcggcgggcagctcaccgacggtcaggagttacgagaccagcagcctggacaactatcggtgacacttcg

SEQ ID NO: 669953 - DNA, 840 bp, Homo sapiens
  misc_feature (487)..(487): n is a, c, g, or t
ccagagacttgtgtactcgatggaaggaccagcataacccacacagcccttcctttccttggtgtgcacgatggctctatgcagtcttatctccagctgggcctctgggttcaggtcagacgagtgaccacggaaaggaggtgcgtgacagcctactagttgtgcgtgtcaaggctgtgcgtgatgcaccagagatgatctccagcgggggatggttcccagcaggaacggagagcgagtgatcagctcagcgtcggcggtctgtaaggtcatgcaccccgaaggcatatgcgacgtaaggcggtctttcgtcatccactggtgaacgacagaaagacaaactggtggctattggccatgctatgtacgacaggacttgctctacaccaaagccaatccaactgtttcactcactgtgacaggtcgactacactacgcgacagctttggactatactttccaatagcccctgacttgatgccccgangccttcgaccacgggcgacgataaggagaagcaactcgaagcaccttactagaaggttcaacaaacgtgcatctttccatccagtccataactgcacagctgcagcttggcagatgatgacggttttttagcaacaaggcatacagacaggttcttgctaattcctctcagacagagagagcagaactacgtcggaccaatctccgtctcccatactccttgtgagcacccgggaggattatattaccctggggacagcgtccccggactcaataccccaacatgacccacttattcaacttcgatccagcgcgatggccaagggcccttaccggccagcgtgaagctttccc

SEQ ID NO: 669954 - DNA, 285 bp, Homo sapiens
cggccccctcccccacctccgcccttttgtgcgtggcagacggaaaattgaaagtacctcggattggttgctttccataactaattaaatgtttgcatagggtgtaacctttgtaacttcgcttcaggctctgattggttgctttccgctatcagactgattgtgggccactatatttgcgtggggtgtacaccaagtggccaatgggaaacctctagagggtgtttataccccagaaaattctataacccggccgcaccgctcttgagccccatgtttcggctc

SEQ ID NO: 669955 - DNA, 288 bp, Homo sapiens
tttagtagagatgggggtctcaccatgttggccaagctggtctcgaactcctgacctcaaatgatctcagttcactgcaacctccgcctcccgggttcaatccaattctcctaagtagtaggggttacagatgcgcaccaccgcacctggccaatttctgtgtttttagtagagactgggctttgccatgttagccatggtttgccaggctggtctcgaactcctggaactcatgtgatctgccggcctcagcctcccaaagtgctgggactacaggtatcctcagtc

SEQ ID NO: 669956 - DNA, 360 bp, Homo sapiens
  misc_feature (12)..(12): n is a, c, g, or t
gatccccctganttgtcaggtctatggttcttctcatgtgtctccatgcttgcttcttatagatgacatttgccacctgaactctgtgacagtgttggtgtctcatgggagtcaccgccactgcctccgctctgtgcctgcgtgtcaggctccctattataccatgaattcatctaaaggccctggatcacatgcattctactattgctcacagcctcagcacccagtaaggtcgctgaattggggccaggcacagtgcgctcacgcctgtaatcctcacactttgggaggccaaggagttcaagagcggcatgggcaacaaggcgaaaccccatcgctacaagacctgagcgagccacg

SEQ ID NO: 669957 - DNA, 136 bp, Homo sapiens
  misc_feature (112)..(112): n is a, c, g, or t
agataatgggtgttactaagctaaaaagctctatacagcaaaagaaacaaccaacaaagtgaagagataaacaaagaatagaagaaagtgtctacaaactgtcatatctaanaaagggctagtgaggttccatcag

SEQ ID NO: 669958 - DNA, 102 bp, Homo sapiens
gactttcgggtcgtgcggtctttggtatgcgcctttacctgtctaagcttgcttacaatgtggacagattactgtaacattctcacgtgtagaatcactgga

SEQ ID NO: 669959 - DNA, 249 bp, Homo sapiens
gtctcttgccactctcttcccaagattcttttcccaatttcccgttccaggtcatggtaagcatcatcgggtctcggtgctggtcatttcagcctgtcagcagggcagtttcaccacccggcgttgggggcgtgccattccctcaagccacaccgggcagcgcatctcagcaggtgccagcagcggcatctcagcaggtggccaggggtcactgcagcgtcgcacattcggtcagtccatgggtccatc

SEQ ID NO: 669960 - DNA, 345 bp, Homo sapiens
tactttcagggagagggttcaggtccaggaccttctggagctctttgagaactccagaataagaactcttttaggctgggcgtagtggctcgcgtctgtaatcccagcagtttgggaggtcgaggcggtggatcacctgaggtcagcagtttgagaccggcctggtcgacatgatgacatcctgtcaatatagaaattagccgggcctggtggtgggctcctgtagtcccagctgcttgggaggcggaggcaggagaatcgcttgaatctgggaggtggaggttgcagtgagccgagatcacaccactgcactacagctgggacaacggagtgagactgcgtctc

SEQ ID NO: 669961 - DNA, 213 bp, Homo sapiens
gcatggaccatgatgccaagatgaggttgtcagtacactgacaccaaactggcgggatggcagcagcttattctgccatataaccaggtcttatgagattgacgtcacatctaggggctgatcaccccacacttgtaacgcctgcctgtgaggttcaccacacttttcccagactctgtggtcttcactgatttcaaattcgccaatatcacc

SEQ ID NO: 669962 - DNA, 147 bp, Homo sapiens
atgacttcggcttcattaacgcagatttcttatctccaggaagttcaaataaacttctcccttaccttgtttggagccccattccactctacaacttcctttgtcaataagggacaatcacccaggggagcaaagggtggaggtccc

SEQ ID NO: 669963 - DNA, 338 bp, Homo sapiens
atacctttaatatgtcacgatgttaaaactggtcagatgtaaaggaagtggggctaacatttcctctggggatgctgaaagtggtgggtttactcagactctcacataaattcattggcttttcccttctccttccacctctattagctcttcatctcctaggggggattctgatgtctgtatggagctggccgtcatgccgggagtggcctgctcatgtatttacatgcgtgctcatctaggctatcgctgagcgcgctgcagctccttaccggctccaggtgcgcagggctccgccgcaaccaacgacctgacgtgccacgagccagggcgcgaac

SEQ ID NO: 669964 - DNA, 857 bp, Homo sapiens
ctgtggtccaggatgaggaggtggggctgcctttgaggctagccctgagtcaccaccacctgcgtcccggaacggtgtcactgatgatccagaggcctgctggcccaaggtctgcggactgagagccgccgccaacaggcacggcccctgcctcaaacggaggcccccgactgcgggagagtccccagcctaacggcacgccccctgaggccatcacctcgaccgccatgtctcaccccatccagcagtctcctgcgctgagaagaggctgtggacactatggacaccacacaaaggcccagacgaccaggacagactgggagagcacggtgtcacacgaccccagcagacaaaacacacaagaagcccacccaagaacagcacacaacacagacaggcgaacaaagaagcaaagagaggatgccaaagaacaaggaaccgatacatacaagacccaacgaagagagaatccaccaagcaacatggcatggcaaccaatagagcaaccaagacgacacacggagagaccaccattaccagagaacacaccacgcagcaagagccatacaaagacatccatggaggaacggagaaaaaacacatggcaaaacaagacgacacataagatgacaatggacagagaaggagcgaaaacagaacaaggaagatagggacaaaaccagacacaacgacagaacaacagaagagcacaaaaccaatggaaaaaatacacactacaaaatagacgagaataacacagaacaaaaaccaaacacatcagcacaaaggaacaaacgaccaatgaataaaacacatcatataaagcatgaggacaatgagacacccatccagacaag

SEQ ID NO: 669965 - DNA, 338 bp, Homo sapiens
tgtgtacagggctcacacctgatctcattcctgggttcctagctcctcctgaaggtgccgtatgaggtacctatgcactttccaaacgctaaagtgaatacgcacttggagaacacttgcttgatactatagtggcattgccagataacgcggacaaagtgagaactacgcaggtatatggatgctgccttgccaagacctcactcacccagacactcctggatactcaaaggtgaccagccctattgacgcacaggcaggcacaaggatgcaaccccacagatgggacccagaaagcttgaacgctaatcatgaagcagctgtataaggagagaata

SEQ ID NO: 669966 - DNA, 325 bp, Homo sapiens
  misc_feature (238)..(238): n is a, c, g, or t
tgtagaccccagcgccgcgctttttgagaatatagtattctcaatatgagaagtttctggacaaaagaaaatcccttgaaaataagacttcctctctgtacacgcatctcatatctcaagcggtactgaatacaggaatgctgactcctggggaggcaatgccttttcaatttttcaaattcaccatgccaaaaatggaacatttgaaaatactgcaataattgactacattcgccgnattcatctgaatgttacattttgacactcagcatattgattttaacacctgctgcggctttctatgcaaagaaatatggcccagaag

SEQ ID NO: 669967 - DNA, 280 bp, Homo sapiens
accccccccccccctttttttccggggggggggggggggttccaaaccgttttttttcattgggcccttttgttttgggggtaaaaggggggtttttttaaccaaggcttgggacaccctcccaagggaagggggattgtttttgggcccccttgggttttttttttggggggggggggttttaggtttttggtttttaaaaccgggcttttttttggggacccccttgccccaaattttttcccggatttttgggccccttttaaaagttttaagggga

SEQ ID NO: 669968 - DNA, 312 bp, Homo sapiens
tcgacgcatcatcacgctccggcctggatgatgcaatcatggcttactgaagtcttgacctcccaggctcaagtgatcctcccacctcagcctcccgagtaggtgggactacagatgcttgccaccatgcccacctaagttttgtatttttttgtagagacggggttttgccatgatggcagtctggtctcaaactcctggcctcaggtgatccacctgccttggctcccaaagtgctgggattacaagcatgagccaccacacccagctctgtctaatgtttttggtagagacaggggtcgacgcggccgg

SEQ ID NO: 669969 - DNA, 175 bp, Homo sapiens
ctagaggatccctgttgtcatacctgcactgttgttcatacctgcactgttgttcatacctgcactgttgttcatacctgcactgttgttcatacccacctatcttcctaagatggagatccctccaagatcaagtggtgcgatgcgtggagcggagtactgtcgtgaagtccac

SEQ ID NO: 669970 - DNA, 347 bp, Homo sapiens
cagttacggtatgtctccctgcaacacagctgttgtacctcatttgtggtctgtggaagccttaaactctccagctcagaggcctttggttccccagaggccgctgcagaacctcctcagccaacggcagttcccttagagctagccaaggagatagagatggcatcagaagagaggccaccagcacacgcagtggaaataatgatgggactgaagactactgacatggcaccatctaaagaaacagagatggccctcgccaaggacatggcactagctacaaaaaccgaggtggcattggctaaagatatggaatcacccaccaattagatgtgacactggccaag

SEQ ID NO: 669971 - DNA, 488 bp, Homo sapiens
taccctatacgcacgatttatggttcaattatactactaccttattataatactcccattaatgcattaaattaggaataaagtcaaatactcaccatatattcaatatgatgtcctacatggctgaacacaaatcagacatttacaaagtctcgtctctgggaaccccttcgcgcccatttcattttgatatttttaatcatattcaaccactcacattttggctatgtaaagtcatagctcaacttgttcccttactgctctgcagcagatcacctgcctgtctcttttcaagtctaaagcagaaaaacaaaaaacaaacaaacaaaaaaacctgttctaaactaatcctcaaactgcctcagtcagtccttaaaacgtgttttaagtgatgctatagaaggtgttttaaacatctgacgtcgtacaaaaaaaattccatcagtattctgggcacagaagcccatcctcagtaaggggtacggctg

SEQ ID NO: 669972 - DNA, 663 bp, Homo sapiens
  misc_feature (114)..(114): n is a, c, g, or t
cctccgtgataacagatagagcctcccctgataatacttttgtggtccaagggcccctttttccgccagaaagataattcttccgtttatggtggttctgggtttgttcttccnggccccttggttgaagattttttccatgcgtcgccacctctgttgggggaaaagtgttgatttattgccttgcccccccgcacccccacgtccgaaagttgtgatgcttttatttttacaaaccgcccggcccccctcccggaaatgtaaaaaagggggttgggaaagttttcccctgggccctaattccaacctgcccaaggatttgcttttttctattatggggaaaactcttttctggcccaggttttcccaaggccctaaaaaaaaaattttcctttttgggtagaagggccgaaattttggaaggaactaaattttccccccattttaagggaaaaatggccttttttaaaaaaggttttataaatttggttccttttcccctccaactctggaattccccaaaaccggccaaggtaggggaaaatttaaaattttcccccttttttttttgggaattaaaccaccccttactataacccttttagaggaatggggacccccgccggcctttaggaaaaaaaaggccttgtttttccccgtgga

SEQ ID NO: 669973 - DNA, 961 bp, Homo sapiens
  misc_feature (163)..(163): n is a, c, g, or t
aggaagaggaggcgggatccgggcgctgcgttggctgcgggcttggtaccaaatggggcgtgcccgtgccggatgagctggacccagatggaccgtcggctgattatggagcccggccgatggcgtgtgctgcaaggagaaggcactcgaagtttatgtgctnctatgccgcaggtcttctgtgtgctggtgctggctccatgccttggcgtgacaggcatgccgttcagctgcgagtgccttgtagtaagcccagggaactggcagcagctcacagcttttccatgatcattgaacagagacagagaaactgaaattcatgacttgtcacgacatatcgagtcacgggtgccgggcacgggtgatgcacgggttataatcctcagcgactttggaagggccagggcctggcggatcacattgagcccaggagttcgagagcagcctgggcaacatagtgagagcctgtctctacaaaaaattagctgggtgtggtggtactcacctgtcccagctatctggaaggccaaggtgtggaggtcaaggggctgcagtgagccatggattgggacactggcatttctagcctggggtgacagagtgagaacctgtttcaattaagaaaaatagatggatagatagatcgatagatagataggatagatagattgatttgtatgggccctagaattacttttgggtatcaaggtgttaccaggtaattttagggaaactcttggagcttaagtgacagggggatatttttaacattcaggctaaggggtccatggtcaccggttgggaaattgttcttgggatccacggagaaaatgttggagtttacttccgtaacaaaagcgttccaaggacacacggggatacccacggttcacagcgggtctgctaccctgtgaccaaacacggcagcataacgagagttatcaactatatatattagcag

SEQ ID NO: 669974 - DNA, 1510 bp, Homo sapiens
taaaaagggtcaattctattttatgggttctgaaagggaggattcacccaggtggatccttttccctacacttctccccttcccccaaatattgaggcctctcttcccaacttacgtggcatattcagcattctctaatctaaccctcctttccccttcatacttccataatactatcctaacccgtgccagaagtaccccaagggccagggcccctcaagcgtggtgggaggcggtggagcagtgagacaaccaagacaaagggacctgagcccgggcgccagccattcactcacagtactgacgcaggacaacagggtaccccgggggtgaacactcagagaaggcctctcgtggcagtgtgccctcacgtgggcagagctgggcgccagaacatcccacaaccttcacagagagtggacaagaggagtgaaacgggggggaccacacaccgagggcacaccccgaggcacgctgcacagccaacacgacaacagagctcacgaccagccctgccgcacaaaatccgggggaaagagcgcccacacgacggacgggccacatagatggcggtcgaaccccgtgtaccagaccagcgttggcaccatgagtaccgcggaaacaggaccctctaggggggcgcgacagcgtgatacacggcacaactgcggcatgcgccaagggggacccaacacagaccatgcgcgcgacaagcggggtacccaccccccaagattagctccagcgaaagacagaacccacgcgcagccaccgtgcgtgtgcgcaggccgggaggaccccccagaagatcgatcctgtgtgcgcacaacgtgtgggcacgacacccggggaccacaaagtccgcaccacggcagacacagcgagtagttacacagcacacaacggaaagccacacgcaggagccccaccacgcggggcgtacacatcgtggcgccccaaatattaccgggcagaaggccgcccatcacagaacaaagacatcccaccgggggcctgggtggaaacaacacagaaacacgttctcacgtgtgtccactacacagcgagagcggccaccaacagaatacgaccgacggcgtccacaccaaaaatatgatgcgcacaacaacacatagccgcgagagagccccccaaggggacttatttcgcaacagggcggctaccatgctgggcgcgggaacactaaccacatacggagcagccgtctggtagcgccaacaacaaagcacgggggggccaccccatgagagacagacgtgaagaggaaacaataaagggggcacgctgggtcacctccagtaggtgggaacacaacggagcgaggggggtgtgatccacaccaaaggacgaacgcgggtgccacccagctgcggcgaggaacgtaagcgcacctcccagcggggaggcgcagcgctactaaaacaagacggactgcgtatgccccacctcgctgctggacgtcgtagcaggtaaacacagccgcgagtat

SEQ ID NO: 669975 - DNA, 1871 bp, Homo sapiens
gatctggctcccggaagttccacgtcagtcagtctgacggtcagtggatcggtgggtttatctcaaggcctgagtagccggtaacaaacgagggttcccgggattggaccgacgcagccatgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcccaaagaaccaccagcacaagaaccacagggtaccgacgctcgaacttcg

SEQ ID NO: 669976 - DNA, 232 bp, Homo sapiens
taaggatccccctcagctggcccccaaggtacacgagttggtgcagctgcgttggcgatgctgtctcaggccatgcttaggggcatgctggatgcggacgggaaccagtttgtggcctatttcctgcctgtagaagagacgttgaagaaacgaaagcgggaccaggcggcggcgctggcctatgcaccagatgatgtgtatgactacaaaattgcttgggggccagctggag

SEQ ID NO: 669977 - DNA, 2202 bp, Homo sapiens
  misc_feature (649)..(649): n is a, c, g, or t
tcttgctgatcttttgttagccatacaatactcacttgtcacggttagtggccaggatttctagcttcatttattgtaactacagggtggaagtacattcaggacttcagattttgaactgctgtcttcttttaaaattaagagctgatttctgggatttaggccaagttcataggtaaattatgatttcagaatatctcatttcatcattgctttattctctgatagccaaatgaagagagaaatgtcatggaagagggaaaagactttcagccctcaagatctacagctcaacaggaacttgatgggaaacctgcttctcctactccggttattgtggcctcccacacagccaacaaagaagaaaagcagcctgatccttggccccttgagccgactggccatctggatggagcacgtgatacagctggaccaagttggttgcatcatcgattctgagaatgaaagggtttaatgttatctaggggttttcttcatttgattcacagtcctataaaagtgtgtgccaacttcaaactaaattacatttcagactttcctcaggctggagggattggggaaggaccttcagttttacagtttcaaaagcattttcaggaaaattgactaatttaggcctcacaccaantccgtgaggcagctagggcaggagtcactgcaggaagtgtccaatttatgaaagtgaatatattccaaatgtggctatattctttttggaaaaagagcaccatttctcacagaaacagcattcctaatggtagacaatttccaggccagcttacttcaccagcatgtaatagtctaatccaactcagaggacagaaacacagcttcatcccacataagcaggagggtggtggtcacagggatctcaaagtcacttgcctctaagtgacatttgctaacagacaaatgcctctacaagaggccccctaagattccaaggaaaggattcacaggaacgcattagtaaaatagcatcctagtgaagcaaatttgaaattatacacacacatcagacaaaaaggaaaatcgggttctacatcagcaatctgtcttaacttcagcatcacacaactacctatgaagaagacagaacaagaattcagttcttctggtctgtacttctcagaaatgtataaacaatttttatcaacattaaaactgtcctagcaaaaccaaacaatcactatcttttcacacagctgacactttcccaccatttgccatctcatcgctggagggcacagaaaaacgacactcaaaatgcttgtgcttttgaggctctgctatatacactaagtgaactactggcttccagttgggaatggagggctgaggacaccctaattcagtgcttccgcagctagcactcttcagccttccctgcgttccccttacctgagctgggggatgaagagcagggtgacagtgggagtaagtacagaattcctcaagccttggtagccttagagaaatgctctgggcttatactgaggctcatctaccctaaaggccatctctcaggaaaacagagctgttgtatcataaagcttttcagggggaaaaaaataaaaaatgttcatcacaaatctattgtgcttgttataatctaacaaagtccactaaatgtagtaacgaaatgtctccccaataaaaaattaagattccctttggagcttaggcatgtggccttataaagagcttaactggactgctacctgttggtatgttcagggcttcattaggttcatgcttaagtataatgcctgtgcctcacagaacaatttaaatttagcttaacaccccacccatacttaaagagcaaataaattatatttcgaaaagattttaaaataatctcaatataaaaaccaacagtgggaactgagtctggaataaatgtgtgcagaatcctaattcttttctgagctccactcagtgaggatatgcaccctctactgtccagcctgtggtttgcagtaagctcactcttctgttcagaatgaccacaggagggcctttacctaggaatagcaggaaaagctaagtaagtactcaaacttccctcccagtaagcatgaattgcttcagatgtaaagcttacatgtgatgagtaatactataatatcatacattaatatatcctaataaactttaattttcaaacaaaaaaaaaaa

SEQ ID NO: 669978 - DNA, 118 bp, Homo sapiens
ccgtctctaccttcgttcatgtttatactggtttctaccctcttgggaataaggaatccatctccgggtctattattgtccttaacgtatgatctctccataagataagttccataac

SEQ ID NO: 669979 - DNA, 112 bp, Homo sapiens
tgacgcatgcgatgctcaccgactggggaccgcaaaggggggggcacccgccttgtgcccccggaaggtgacccgcggccaaacgggggcaccttcttccccaaacatgaca

SEQ ID NO: 669980 - DNA, 1053 bp, Homo sapiens
ggcccaattcatgccagacctgggaagagtgccaaagagcactctagtattgccatcgtctgaagcgagagcatgtaccacttcagggcagagtccactaactagctgcgcccacttactcgtactactactaacactgttggtgtgcctctccatatcagaaccatgggtgagaaattagcaggaacagacgctgtctgtacgatgtgaagaatatccggctctgttccggaagctactgcactaggggtcttgggaagtcaaaccttggagagacgtcgtcgagacgtcgccagacgtcgcgctaggtccacccacatgactactctcccttctgtggtacacattttgactaccctcgctacatgatacttattgctgatcttactcaattgactgccacagtgaacatcaagaatcaacttgagaacctgtgagtttaccacaggaacattctcgaggctgactgttgcttgtactgtagttgctagcgtgactggtagtcggtgagagtatgcagagcctggggtcactctgctcgagaacatatgcgtgcgaacaaaccggatcagcgatggatcgcaatttcgggttctctaaccacgactgggcgtgtggacagatgacacgtgagagtgtgttccggtgtgtgacatgacagatcgtgatgtgccaactggatgcgccatggctagcaggcaaggaaggcacccctggtggaaagcaccttgttgacctgagaaggttcgaggcactctagtgtttcaagaaacaaatcccggatagcgtaggccccaggacatcccttatgcgatagccttccccaaagtttttccctaggtcaggacagtggtcgatgtagaagtgacgtggatcgccaagacgctggtgaacaatagccctccggattaaagcccggatgcgtactgacagcgccgtggaagctgggcttgtcccaaggggaaacacaactggccccagagatcctgggggtaatccttcaaataggaccccggcctgggaaacctatagctccttacaggtgactaagac

SEQ ID NO: 669981 - DNA, 576 bp, Homo sapiens
tcttgatacagattctgaaagatgaggtagtatatgaaaacacgtgcttatatgtctaacgaagtgtgtatatatcctgcctcaatgcactcagagaggcttcatcgatccattgacatttgatctgaatatgaaaaaaaaaagcagcagtattcttccaggaagaatagattcagtaggaactcagcaggcaggaatggtaggacatcaggtgtaaaattaaatgctgagtccagggaagtaaacagcacattggggcctgaatgctcagatgatgggaataaacaaacaaaaaaaacaaacagacaggaatggacctttcatgccttccctgtcatctaatcctgacttacagtaaggagaagctaatggaaaggtttataagccaggtatcaatgggttggaagcttgtgtaaatagcaaaggctcaccggctagcagagtggcaaggcggcacagcagggcagggccaggctggtagaaaagatgtccagctgggcaggttgtagtatgagtgcacgggagaagcgatgcgcgctaaaagtagcttactgagacaaaagaggacagatcccc

SEQ ID NO: 669982 - DNA, 106 bp, Homo sapiens
gggcttagaggagcgttggcttttttcttttttcgccattggcgtgttcttgccacttatatctggggatcttcgaaaggggggagtaacttttgcaaaaatgtaa

SEQ ID NO: 669983 - DNA, 88 bp, Homo sapiens
gggtcggcgggagaatactactgtgttatatcatgccgaaatcaatattctataaaaacaaagattgcctggcaaatatttcctttaa

SEQ ID NO: 669984 - DNA, 272 bp, Homo sapiens
cccaacccctttttttttttcccccggcccgggagaaaaattttcccaaaccccggggccccttggggacaaaagggccccctttttaacccaaatggatattccgggttggaaagccacccgggggccttggggggcttccccccaaaattttttccttggggttttccctgggcccggggggtttcccaaaaaaaaatgctttttttttttttagattttttcctttgcccatatattaaaggggggcccaaaaagggtttttcccccca

SEQ ID NO: 669985 - DNA, 985 bp, Homo sapiens
  misc_feature (327)..(327): n is a, c, g, or t
atgacactgtgtggtgttgtacccccccttatgtgtctgggccgcaccaagcttcgcctgtgtggcgcaaccacggtgttgtttccgcccgccgtcaaagtggtgtcttccccccccgcgccacagggttcttgggggtctcgccccccgcccggggtcattgcaagtggtttccgtcgaccgtggtggcggagccccggggatgacttctgttcttctgcaccgcaaggggccccactccgggcccgtcggtgtgcgcaccactgcctgcgttggtgcgttcgtcctacgctccgaacccgtgaactactgcttgtttggcccccngttccgctctagctgtctcttgccacaatcagagcgcgtattccattcgcctccacaaacgaggtcgctctcctacccccgggggtgcccgcccatttttccgcggagtcaccccgtggggccactaacgcgtacgccgcacaagaccgcccgtcgcggcttagtatatttgcccgcggcggctatatcaggcagtgttgtctgtgcacacgccaacacaatatgttgcgcgcggctaatacgccgtagaggctcccccacctttctcgtgcgggctcctcccgcaatgtgtcggtgcaccccctcggtagtaagatcactgctattgcacaccaggtggagggatcataccctctattgtcattacaaccccgcgtacaatttattaagattgttcgagagtcatttggaccaccttcctgttgagtcacgcacataactccctcatcaggttaagaacaacgcctctccctcacaccctccggcagcaacacaaatcatgggcaggccccccccccctatgccatccaccatcgcctgcaacccctccaaacacggaacctttcggcgaccacaaagtggaagaaaataccacacccccaccaacccgtggttccaccccacccccagggccccccaagttttccccaacataaca

SEQ ID NO: 669986 - DNA, 201 bp, Homo sapiens
tgggaggggaaccccttcttggcttttgttcctctaaaatctgtgtgtaaatattctctcggagcttttactcaaaaaggacgaaattgggtgttttttaaaaaataaatttcagaggagcccaaaaaatttacaaaagaatgtgggagagttatagggttagattttgaagagaggagattctttaatacaggaggagga

SEQ ID NO: 669987 - DNA, 131 bp, Homo sapiens
ccgaggccaaagtcacaaccgagggtctcagctcaacaagcctcaaactagaacacaccagttcctccctggtctccagctctacgacccaccaatgtaaaataacatcagctcctcacagatctccatct

SEQ ID NO: 669988 - DNA, 792 bp, Homo sapiens
  misc_feature (341)..(341): n is a, c, g, or t
ccacaacatgtggctacttgtactccttgtcttgtccgcgtgaggacagaccgacttacacccgggggccccctttgaagagcctatctgtgggccccccccccccaaccaaccccaacaggtggtgcttaaataatagtgtttttataatatttttttgggggaaaagtttttccaccaagggcaccccagaacccctggacctgggtttctcccccggaattcccgggcccccaaagggtttccccttgtcagccatggagggcgagggggagccagaaatgagattcggattctttcccccaggaccagctccaactcccacccatggaagactgtgntgtccccccctccaccatgccccagactccaacgagctccaggagccagaatggaaccgcgagaccagcggaacgcaacggcaacgcctaggctttgtggaatgtccagaactgcattagccgctgaggagagccacccgaatggcgcccccccaacacccacggggaatgctcatcactggagactgcgactgggagagaacacctgccccctccctcgggttgggtggcccaaccacggctggccagcctccacactcccaactctgccagacaccctgacacccaccccggctttgaagagcatggagggggagcctcagagctgacagtcctgcttagagccctttaaaagacttgaaagttcactgggactcagtttacctttatgccttagcagaagattaatcctacctagagacctttgttccctttaagccattactgacca

SEQ ID NO: 669989 - DNA, 1846 bp, Homo sapiens
  misc_feature (1282)..(1282): n is a, c, g, or t
  misc_feature (1385)..(1385): n is a, c, g, or t
  misc_feature (1406)..(1406): n is a, c, g, or t
  misc_feature (1412)..(1412): n is a, c, g, or t
  misc_feature (1414)..(1414): n is a, c, g, or t
cctgctcatggtttcgtccttcgtggtgttacgtggtgcccccctcccatttctctgttttggaggagagggctttcgctcggctcgtgtggcgcgctattgctacttcttcagtagacaatgtgctgcttcctcgtttgtacagagagcggccttttttccccctcgccctctctctgcccggggttatttaattgttttctgctgcggcctttcgtcgcgagtcggcccctctctcgtttgtgtctccctgcatcctatatcgtagatggggttgcttctcggttggggacacttccttccccctcaagtagctcttttcgagtctgccaccaacacaccacgtggggttgttttttttgtacgggccggtcgacacactcacccgtcccatgtggttttctcctcccgctgcgcctgttctagctccctgacatccacggagggtggtcttccctatactcggtggtgttttctctctccctccccctcccttttgggcgcgcgtcccctctcgcgtcccctccctttggggtgtgggttcctcaaggatgtttgtttttttctgcccgacccccccccccctggcggcgtcgctcccaaagatatctcttcccgtctgtggttgtggggactccccggggtggggcgctccccaccatatacagtgggcccgctctccaacattggtgcccccgcccgccggtcctcgcaccgcccgcgaagaaattgtggaggaatgttttcgccccctccgcccctccgtggtggtgttttcttctcacctcggatgattttctcgggggcccccctctccccacggtgtcgtggtcctcccctctcgcccgcaaagaggcggttgttttttttacacctcggggacctttctctccccagcgaggatgcgcgtttacgccacatttttgtcgctcgtcaactctagggcgcgttattatatttgtaggagcagaatttatagtggacaatatttgcgcccccccctccgggccgcgcaataatagggcgcaccaccccgccctctcttatagtggtcttgtagagcccttctctcctctcggcgaaattcttctgggagaatagtataccgcccctccgtctcgtcgacgatatagagaggaaatattgttgggcgcccctcttctgagagagccgtctttgttattatctcgtgagatattatcacggcaccactcgcgagttttgttagagagacactctcttttttctccgagtgttttggagcccactctcgtgatgtttngagaggtgttatacactctgtgtggtctcaccctctcgggtgattatatacacgcgcgttctccagcggtgcttctgagagtgtgtttttctcgcggagtatntttctctctctcagagagagnctctgngnctccagagacaccccgctagtggtgtgttttgtgtgtctctctgacgggggtgtctctgtgctccagaggtgttggcgaaagtagtctcccagcaccgctctgaggcgaccccgctgtgtgccctctcttctcttagactcggagagtgtctcttggcgccccgagcacacaccctgcgggcctgttgacattgcgttttgagttggagacaccgggttgccatattacacgcccgtgtaaagtgattccattgtcttaatattaagtgaagggtttttttgtgacacgcccatatttctcgatatttttgaagagaagcaccacaccacatatttggtgtttttactgttaagtgaggcacccttaggccccccggcccacaccctcccttgtgtaagggaaaattaaagatgctccccggaaccccaaaa

SEQ ID NO: 669990 - DNA, 184 bp, Homo sapiens
gatttgttttctatgaaagaaaaaggttaaatgtatgttttcatttttttatgtttctacttcatgttttaaaaaattattcattagtttcctttggaaaacttgggtcaaatcattcttctgaatgtccattagaatccctgtgattcaggaaaatttttgaatcttcaactttattttgaaa

SEQ ID NO: 669991 - DNA, 242 bp, Homo sapiens
ggctacattgagctgtacaaagcttatccccgtacgagagcaaattctgtgagattcagtgtacttagtgttattattgtcttgctcttggtaatcctatgtacttttttaaatttaaaaatatcattctgaaaaagggtacataggtttcaccagactgcccagggatctatagtaggaaaaatagctaaatctcctgctctaggcatcccatgactaatctaggaccctgaatatccacg

SEQ ID NO: 669992 - DNA, 900 bp, Homo sapiens
gggctcttggaaatgagcggagagcgacgcggttgtgtagctgccgctggggcgccgcgaataataagccgggatctaccatacccatgactaactatggaagattataccaaaatagagaaaatgtgggaaggtaccctatggagttgtgtataaggggtagacacaaaattacgaggtcaagtggttagccatgaaaaaattcagatagaaagtgaacgaggaagggggttcctagctaggtgcaattcggggaaattttctctattaaaaggaactttcgtcatccaaatatagtcaggtcttcaagggatgtgcttatgcagggattccaggttattactctccattcttgagttgcctttccatggatctgaaagaaatacttggattccaatccctcctggtcagtaccattggatttcttcacttttgttaacgagttattaattaccaaaatcctacaggggatggtgttgtacctcttagaaggagttccttcaccagagactttaaaactcaaaatctctggatttgatgacccacgggaaccacttaacacctggctgatttttgtcttgcacgggagctttgtggaataaccttatagaggtatatacacattaggtagtaccattctggtaacgatctccagaaggtatggtggcgtccagtcggtactcaatcagtgacttgggtatggcccatattggctggtatcatagaaccatttcctggttcgaatggcactctacgagttcagcttggcccccacatgtgtgccgagggtcctagattaaaaattccaggacggacgatccggaactgtgaggggtgtcaaatttttaccactgcggggcacttcggcgaagcggacaatcaacgtggtgatttaaacga

SEQ ID NO: 669993 - DNA, 850 bp, Homo sapiens
ggtaccggtctgggccacagcgcacggtagtgcatcgcctggttgaaatgtactcatcaggctgctttctcacagaatagaacgagtgggagacagaagcaccagtggtgggggagaccccagaataaagctcttgcgagaagtggagcagcgatgagtgtgcagatcaagtgaacataccctgcaggatacatcgcagtgaaggagaggtatgccaagtacctggctcacagtgcagggagaaatgccgggaaagcttcgcgaaagctcaggagtcccatggtggagcgcctcactaactccgtgatgatgcacggggcggcaaccaagggcaaagaagctcatagatatgtggcgccatcggtgggagcatgcctttcgagatcatacacctgttcacaggcgagaacccttctgaagggtcctggtgaacgcccatcatcaaacagtggttccccgggaggactcccacacgcatgtgggcgcgccgggactgtgagacgacagggttgtggatgtgtccccctgggcgttgtgaacaaggcatctggcttgctgtgcacgggcgctcggggagggtgccttccggaacattagaccatgtgctgaagtggctggcagatgagctcatcaatgcgtggcagggtcctcgaattcttatggcataaaaaagagaacgagtgaagcggtgggccagtccaaccggtgattccccagtggtgccaataactgtttgccttgggaggtcccggaaaagaagagaacaaaaaaaaaattggggcggcggccagaaagttaaaccctctggcgccgcacaaaagaatgcaggtgcaaacgcaaaggtgtgcca

SEQ ID NO: 669994 - DNA, 161 bp, Homo sapiens
caggatcccctgcaaaaaaaagacgccttcctcacatattactactccttcctttttagcatgctccctaaaaaagtaacgtcactgctcactgacaatgcaccaggtcgcccaagagctgtgattgagatttacagtttattagtgttttttctgcagca

SEQ ID NO: 669995 - DNA, 320 bp, Homo sapiens
aggggcctttccttgggacccatggccccaggaaaagttttgcaccagcaggacccctttgagggccttcaaggttttcccaggagtccccctttgcgggccccccaatgccccagttcccttttgggtcttgtgccaagtcccccccagggcctggggttgttgggagccaagggccccctggtattcagttccctcacgattcccgatcaggggcacccccgccccctggttatttgtaaaaatttttattggccccaattttcctcggaattggggggcccctttggttcccccagttcagtaataacgtgggggag

SEQ ID NO: 669996 - DNA, 115 bp, Homo sapiens
acttaagaacaaagtggtgagacttttggtagcaaaatctgcacggttcttaaaatccagaaaaggtgttggttgatatagacagcaggacggctgccattcggctgccattggg

SEQ ID NO: 669997 - DNA, 255 bp, Homo sapiens
gaacgtatgagatcaaaaaagaacaaatgttttattattacttgagcacaagtgtaacctaaatatttctatattaaagcttaatgtgctttcttaaagatgccaaaagtgtaataaggtcataacctgcattattctgacactaaaatgtaccactttagtaatgtgcattaatctgtaacaaggctctggcaattgtagattagtttggcgtcccaaggtgcatggacaatgtaaatacaattaaattttggg

SEQ ID NO: 669998 - DNA, 364 bp, Homo sapiens
ggtgtgccccaaataaacttatgaacgcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaaaaaaaatggggccaaattttggctcactttggcaaattccccttttggggggcattttaaaaataaaaggcccgttgtttaaaaaagtcaaaatgggaaaaacctggggtttcccaaataaaacggtttggataaaaatccccttttgccaaggtgggtaaatctcaaaaagccccaacctaaaggcttttcctttggctt

SEQ ID NO: 669999 - DNA, 532 bp, Homo sapiens
ccttcaaggtcggcctgttcaggggtcgtttgagggagctttgggtcctacttgagggcgaagcttcgagggaggggcccctgcacatcctgttggtcccgccggtcccgccttcctgtggaggctccctgggaggccgccgggtgtctggccgggcctcccaggaaaccgaggagcagggctgccccccatcctgcctcagagcccatctccggagcaagccccatgcccagggctcgggggcagctgtgccttcgctggtttccttctctgggaagggggcatcctgggctcagctgggtttggggtgaagatgagccttcctgggcgtgcgtgcccctcccacgcctgcgctccattcggcatcatctactccatctcacggccaggcctgggactccccacccggggggccggcctcggggcctcagccggaatctgctacaggttctgcggtggtccaggggccctagaggtgccagcctatgcccacctggacacctgctcagcgcacaaggcagccacagccaat

SEQ ID NO: 670000 - DNA, 293 bp, Homo sapiens
gtttttttttaaaaattttttccaaaaccaatgggggtttttatttggaaacaggtttcttttccaaacacaaggttttgggtggcaggcccccttttttttttggggggtgggttaaactaaaggttgacccagggaatggctttttttttttgtttgggggggaaaaaaggttaaaaccggttaaaaaaggggggttttgggggggggttaaaaaacccccccggccggggaaatggttttttttggggtttttcccttcccaaaaaattttttaaataaaaaagggttta

SEQ ID NO: 670001 - DNA, 1129 bp, Homo sapiens
gcagcagagctccgggctgaagattgcttctcttctctcctccaaggtctaatgacggagcccgcgacgcggtgccaccatgcggccagaaggcggtatcgcttattcttgtgctacctgcgtgctcttcacttgcgaggagcggagctgtgaggcaggtaatgaaaaagtgcgtcgtgagaagctcaggacagcggctccgggttctggaaaggccctgaccttcatggccgtcggaggaggactcgtcagctcgtgctgggctgtcgccgcgtctgggcgttcaccggcgccaggtcgagtcgtcggcccaatcgtcgtgtggcatgtcctcgtctgagtgatgctgggtcgtgcgatccgtgaatgcgggggcggtgtgcccgccgggtgggttagtggccacgctgcgcagagacctcgggggcttcgggtggctagctagcagctcgctcagtagtgtaactactctggctgcccttgaattggctactgcctaccgcaccagagctatcatcgatacgctgagagcagggaatgcagggaagctaaagccaaagcgatggtcgctcggaaaaacgcttgcatgtccgttcgccttcggattgggtgcctagaactgcatatacgcgaggtaagggaatggaaagggaaagcgtgttgggcccttgggtaagcatgcaactaatggtagagacgtttgttgattggaaaaagccaccggggaggccagttcccagccacaatgtgtcgggagtccagggcggtgtacaaaacatgtgcgaacgcgcgggcgcaagtgtacaagccggacggggaaatgtctgcgacctcccaattctgtaagaaaccgcaagttgccaattgccccttcccgaaaggaattgttacgaactcgctaagaagaggagtggaaccaccgcgcccggtgtggtttagtaaataaactggcgcaccccaaaagagtggggagactgtacacaaaccggtgggatgttgtcctgcgacagggaggaaagattatcccccaagaaaaattgctgcccagaaaaattttggtgggatatattgcgacaatttccccccaagaaaacaagccctaaaggttgttaaaaacacacgagaaaat

SEQ ID NO: 670002 - DNA, 585 bp, Homo sapiens
ggtgaccaggtctctccagagccaaagatggatggtgtgggcaggccaggcattcccatgtgtggtagccaggcctctgtcatggactggatttctgctgtgagcttccattaggacttgtccatccaggacacacccttcaaagaaagtcaccatccaggcaccttctgaatgcaccttcctgtccttcttccccgctcctccccctttgtctgggggctcacttttgcactgaacactcacatgtgtttcctccttcagtttcgacttgcacaggaatctgaagcaaaagtgaaggaaggaaggtatcctgggtgttaatttcctgcttcatatccaagtgatccaacaaaggagcacaccttcatttgtatggagagtgatgctctgatcctccctctggttttttttaaatagtattaccagcccagcccagaagtagaaactctgccagcatttccattagaaacctcatttttcagggtcttttaactgaaccataaaactttatttctcatatgaaacagatcctaaaatgatcttggcctgctgtcaggatttttttaaattaatatacgtattaag

SEQ ID NO: 670003 - DNA, 170 bp, Homo sapiens
gcagtatactgcaggttcacttctgcaatcaccagcacaagaccacctcacacagtacttccggcttcacttcttcgaacgccaccactgagaccacctcacacagtactcctggcttacagttctttgacttgccaccaccgggaaccactctcacacatgtactctca

SEQ ID NO: 670004 - DNA, 477 bp, Homo sapiens
atgataccccctttaccctgtgattattatgcattgcatacctgtatcaaagtatcccataaatatatacacctactatctacccacaaaaattaaaagacaacaacaaaaaaccccacaccactacctcactgatgccataatgtttaaccatgcctttcacttaaagaattccaggaaataagccaggtgtgtggctcgtgcctgtaatcccagcactttgggaggccaaggtgggtggatcacctgtcacctgagctcaggagttcgagaccagcctgggcaacatggcaaaatcccgtctctactaaaaatacaaaaaattagctgagtgtggtggcatgcgtttgtagtcccacctactctggaggctgaggcacgagaattgcttgaactgaattcagaagcagaggttgcagtgagccaagattgtgccactgcactctagcctgggggacagagtgagactctgtctca

SEQ ID NO: 670005 - DNA, 193 bp, Homo sapiens
ctcgctacctctttctggccacgccggcagcgctggagcggatagcatctttgcactggggatcatgccgtatatctcggcatcgatcatcatgcagctgatgacagccgtcagacccgcagctcggagcagattgaagacaggaaggtgaaagctggcccgtcgcaagcattagccagatacaccccgctac

SEQ ID NO: 670006 - DNA, 772 bp, Homo sapiens
ggcgctgtggggcgggggcgaggttcgggctggttgttccgttgcgagctgcagctgcgatctctgtggtaggcccagaactgtatgctgacttgtaagtgaagagcagtgtgctgctgtgttctttggggtagtgtctgggatcagtacgatgaatcatgtcaataaggtgtaattgaaaagtgatcctctcttcagagatgtaaaaacaaacaaatccaagtctgatctcgctcttctcgctcagatctgctcaagatctcgttctcgtcatttcgaagtctcggcccgaagccgatctctctctcgtcaggaagcgcggctgagtctaggtctcgtcagatcatatctccagctcataacagagaagaaacaccagagtatatcagaatcgggattccgaggtcacaacagaggctatagaaggccctattatttccgtgggcgtaacagaggcttttatcatggggcaatataaccgaggaggtatggaaactaccgtcaatggagaatacggcaagcatacagtcctcgtcgaggccgtcaagatcccggtcccaaagagaagtccttcacaagtcaggagcatctgaactctgatatcgctctgaccggtcagcgtctcatctccgtcttctcaacatagcgattgatctctaaggcagttgacgggaaaaagctctctaagatgcgcatccgggtgcgagtacggagagaggccgagcagaatcttgaggctcagtaaacttgagccaagctgcaatgcactgac

SEQ ID NO: 670007 - DNA, 353 bp, Homo sapiens
atgttgcaggaacatgggtaaaggccttcgccatctcttgggtggtaaaacactctatagaggtcctctggtgacagtctggaaggtttacttaagagtgatcttacaagtggggattttgactccaacaggtatggcctgggtttttgacggagcagtcttagccttgcgctcctcagttttcagtgctggctgccccgctgggtctactgactctccattcattgtaggtaccatcatgccctgtgttgaactctgttttgggggtgctgatgtaaattcccatttgcttctcttagaagtttcaccctgcttccttcattcagggcccgcgatttgtgtcaggctcatct

SEQ ID NO: 670008 - DNA, 84 bp, Homo sapiens
caggggtgggaatttttttttaatatgtgtcatgaataaagttgtttttgaaaataaaaattgtttggcctttaaaaaaaaaaa

SEQ ID NO: 670009 - DNA, 346 bp, Homo sapiens
tttatgattttcatcataacattttcctttctctagcttacttgattgtaagaacacagtaataatacatattttaaaaatgtgttaatcaacttattttattggtaaggcttctggtcaacagtagactattagtagttaaatttttggagaatcaaagttatacagtggccgggcatagtggctcatgcctgtaatcccagcaccttgggaggctgaggcaggaggattgcttaagcttagaagtttgagaccatcctgggaaattctccatctctactaaaaatcaaaaaacttagccaggaagggtgaacacctgttgtcccagctagaggaggcgtcgacg

SEQ ID NO: 670010 - DNA, 763 bp, Homo sapiens
  misc_feature (238)..(238): n is a, c, g, or t
ggttttttcctttcccctaagttctcgtgcatttttgggggagcttcctttttttcatgctgggctgaacccctggttgtgtcttgtgaagccatgtgttttcttgcagcttgggagacgatctccggggactgggtgctaacccttgcgggtactcccaggtgttgagctccctgcaactccctcctttgcccttgccgtctggccagcctttggggatcccggtgttggtagacanaccacctattgtgggctccccttagggccttagctaccatagcaccacgctctcatctctgcaagtcggcagcacacagtggatgaaggcaggagacccagaaagcagtgcagtgcagctctaataaaggccttatttttcttatggtaaatcatcttttacatcctgtatgtacacatgtgttaaagagacgtaacctagctgggacattgttatagactttgatgattctagccagtatctggatgtgtgtcaagttgcagactgtggccttgttactttttacagtggcagtacttaacaagccgagcaacagtgtgtcagaccatggcgtgggtatgtattgtgcagcagatccacgagactgaggcagcgtgtcttcttcagttggtttctgctctgtaatttacctctgtacaattcattgttactgttctgtttttctattaatcttttgtcaacttcctgattatgtaacaaagtatgtacagtctactttagaatctcttcctatcacagttactt

SEQ ID NO: 670011 - DNA, 509 bp, Homo sapiens
  misc_feature (54)..(54): n is a, c, g, or t
  misc_feature (87)..(87): n is a, c, g, or t
  misc_feature (126)..(126): n is a, c, g, or t
  misc_feature (150)..(151): n is a, c, g, or t
  misc_feature (171)..(171): n is a, c, g, or t
  misc_feature (184)..(184): n is a, c, g, or t
  misc_feature (220)..(220): n is a, c, g, or t
  misc_feature (274)..(274): n is a, c, g, or t
  misc_feature (286)..(286): n is a, c, g, or t
  misc_feature (310)..(310): n is a, c, g, or t
  misc_feature (335)..(335): n is a, c, g, or t
  misc_feature (338)..(338): n is a, c, g, or t
  misc_feature (351)..(351): n is a, c, g, or t
  misc_feature (356)..(356): n is a, c, g, or t
  misc_feature (377)..(377): n is a, c, g, or t
  misc_feature (397)..(397): n is a, c, g, or t
  misc_feature (403)..(403): n is a, c, g, or t
  misc_feature (406)..(406): n is a, c, g, or t
  misc_feature (416)..(417): n is a, c, g, or t
  misc_feature (425)..(425): n is a, c, g, or t
  misc_feature (429)..(429): n is a, c, g, or t
  misc_feature (438)..(438): n is a, c, g, or t
  misc_feature (441)..(441): n is a, c, g, or t
  misc_feature (444)..(446): n is a, c, g, or t
  misc_feature (448)..(448): n is a, c, g, or t
  misc_feature (454)..(454): n is a, c, g, or t
  misc_feature (472)..(472): n is a, c, g, or t
  misc_feature (481)..(481): n is a, c, g, or t
  misc_feature (489)..(489): n is a, c, g, or t
cccttttcattagcagagatgaattgaaatgtcatgtctgaatgcaattcctgnaccccactcccaccccacaaaatcccaaaagtnaaaataaatcaataaaatccccatgatttactaaaagtnatccctccaaacctttctaactannagctgcagtggatgaaaacnaaggagggaggcngctggccatcatgtagcattcctgtgcatgtaagcntgaagggacagcagcatgggagccagaatcctgaatgagagtggtatataattnccttacttcatncttgccccctccctacataagacncctctgtcctggtacatgggaaatnctngagcgcggatgcnaaggntggttttcgtctacaattggnaatgcctgccccttattaanttcccnggncggggtgagnnagggggcnccanagagaaagngcnggnnngncagggntgctcaacactcttgtcnattccagtntaatgctntttaataacaaaaccttctt

SEQ ID NO: 670012 - DNA, 130 bp, Homo sapiens
ttgccttctgtggtactcctccgtgaacttcccttaacgtttcatgttggcacacatactccccccagaccccacagactttgatcgccctgaaagcggcccgggggatcataggcgaatcacgccgccg

SEQ ID NO: 670013 - DNA, 418 bp, Homo sapiens
aacggccgtccagcttcacgctacacataaaaatatgttactacactacgagattatcagatagactccacttcagactaatcaagaagctaaaggacataaatttagaattaaagcggtataccaccaaagattagctgtataatctctgacagtgatcgccacagattcttgttaaaaaagccttgtattttctcatgtagagaaatagtaaacttctgtcgtgcagctgattcccaggcaggaacatatttaaaaaaatatttataacccagtgcgatgcctttataagatataacagactgcctcaatgaaaacagcaaaatattaatctaccaatcaggaggtcactgagctttctctgaagagcagatattatgatgcttagtatttttaaatatatttgcggtaaaagctt

SEQ ID NO: 670014 - DNA, 441 bp, Homo sapiens
agatgctgtctgatctgcagttagtgatctgttatttggtttcgacgacagacagacttgggctaaagtcccaaacaagtgtgagtattatctgggtatcaatctgtaatttttaaaaatgtattcctcccatactagatcataagagctagaaggggggcaccattcttgatgtattatctcctatatcctaggattttgcgctgtgccaagcatacagtagacactccattagtacttgttcaatcaattattaaggtaatgtaacttatactctctgagcccccgttttctcctttagaaaattaagaacctacagttgtgacaatgtttaggaaactccaaagtgctgtggtaacataagcaattgctacagtccttgagaaatgctacccataatacttagagaatttgatacaactcagtctgacaaagctaaga

SEQ ID NO: 670015 - DNA, 410 bp, Homo sapiens
  misc_feature (1)..(1): n is a, c, g, or t
  misc_feature (52)..(52): n is a, c, g, or t
  misc_feature (65)..(65): n is a, c, g, or t
  misc_feature (150)..(150): n is a, c, g, or t
  misc_feature (352)..(352): n is a, c, g, or t
  misc_feature (367)..(367): n is a, c, g, or t
natgagcctaaaggcataacttagttgccaacacaggttggtcactctcttnacttcctcctcancctcaaaccccctcattggtctcataagaagagatctatgaccaactaatctctggcttacagatgtgttaatctgtctgcatcnctacaaaggaatacttgagggtggataatttataaagaaaaggagtttaataggatcaccattctgcaggctgtacaagaagcatggtgccagcatctactcctggtgagggcctcaggaagcttccaatcatggtagaaggcaaaaggggagcagtggatcacatggccagaatgggagcgcgagctagaaggagaggtcncagactttaaacaancagatctcacgtgaacctctgtgaatctcatatgagaagtcac

SEQ ID NO: 670016 - DNA, 223 bp, Homo sapiens
ttaaattactccccccccccacccagctaatttttgtacttttagtagagatggggtttcacctatcttcttttgtattgtttactttacaatttggtggttttttaaatagtcataatgtttgattcctttttctcatttgtgtttctgttctattagtgagttttaagcctttgtttgttttcatgatggtagataccatcctgtctatatatgaagatca

SEQ ID NO: 670017 - DNA, 112 bp, Homo sapiens
ctcgtctttatcttggtacgcatagaaagagcaagtgtacttgacgtgctggctgactttcaattttcttcaccatttaccggagcgaggccccagtagcgggtcccgtatt

SEQ ID NO: 670018 - DNA, 267 bp, Homo sapiens
tcgtatacccataacatacccctgctcttggcaggtcttagcttaggacgaaacggtctggggacagcttctcccgggagagcagacagtccattcgggacttgctagaggaagacatgcggcccagatctcaggtgatccgagctccagcatctaccccaggcctctagcagagaccaataaggacgtctacggctccaaaagtgtggaaagggcagcgtctggcttcccttcgcttttcagaagcgatgccctgaggctatagtt

SEQ ID NO: 670019 - DNA, 1193 bp, Homo sapiens
acccactccaccttactagcagacaaccttagccaaaccattgtaccgcataataaagtataggcgatagaaattgaataggcgggtcgcaattagatatagataccgcaaggggacaagatgaaaaattataaccaatgcataatcatagtcaaggactaacccctagtaccgttctgcataatgaatgtaactagaaataacttagcgagggtagagccaatagcgtaagacccccgaagaccatgacgagctagctaagaacaggctaaaagagcacacccgtctatgtagcaaaatatgtgtggaagatttataggtagaggcgagaaacctaccgagcctggtgatagctggtcgtccatagatagaatcttcagttcaaactttaaactatgcccacagtaaccctctaagatcccctgtgtaaatttaactgtgagtccaaagaggaacagctctttggacactaggaaaaaaccttgtacagagagtagaaaatttagacaccctatagtaggcgctaaagagcagccaccaattgaagagagcgttcaagcgttaacatccactacctaaaaaatccgcaaacatataactgaactcctcacacccaatggggaccaatctatcaccctatagaagaactaatgttcagcataagtaagcatgaaaacattctcctccgcataagcctgcgtcagattaaggcactgaactggccaatttaccagccaatatctacaatcacacaacaagtccttatttaccctcatggtcaaccaaaacgaggatgggtcatacaggaagggtccacacaagtaaacgagcttcggcaattttacccgctgttaccaaaaatacactctagcatccaggtttaagagacgccggcccaatgaacacaatgttacacggccgaagagaacacataacacgggcaagggcgccaacacaccgggccagaaacacagagcgcattaaaggtcaccacagggagccagaccgcctattaacagagagatcgcccgacaagggggagcaaacgacggaacaacccagcgacaatcacagctagccaaaccgaggacaacagaacaacaggggcgggacaccccagctagagcaagcctaccagacagccacaacacgcagcagcaccacactacgccgacacaggcagcagacccggg

SEQ ID NO: 670020 - DNA, 456 bp, Homo sapiens
acacagcaggatccccataaggatactcactttaagcaaggggcagatagtagaagatgaaacctgcagatagcagactatccacatcaatttgtgaggatcttgtcatgctctaattgaagaggaccaacaattaacagtagaaacaatagccaacaccacagatatctcaattggttaggcttatacaattctggttgaaaaattaaagttgagtaaactttctacttgatgggtgccaaaactgttgtgcccgtatcagctgcagacaaaagtatagctttcaatggaaattataaacaagtgggatcaagaacctgaagcatttgtttgagaaattgtaacaggagatgtaacaacttcatagtacaatcctgaagacaaagcacaatcaaagcaatggctatgaagaggtggaagtggtgcaatcaaagcaaaagcagacgggtcaaaagc

SEQ ID NO: 670021 - DNA, 191 bp, Homo sapiens
  misc_feature (189)..(189): n is a, c, g, or t
tcccttagaacgctgacactgcgggtgagcttcccagtggtcaggcgatgattctattcttccctgattttttctgaaaagccaggtttattttcaggatatatggaatatgaaaaaggcgttccctgcttctggtttgtatgaaaatcttacattaacataatacagttgcgaaagagtaaatatttntt

SEQ ID NO: 670022 - DNA, 164 bp, Homo sapiens
  misc_feature (14)..(14): n is a, c, g, or t
  misc_feature (30)..(30): n is a, c, g, or t
gggtcatgcatagnggcatgtggaggcatnggcgctttgtataccagtggaagggttgtgcaggatagtggtacccggttccatagagtttaagcgcatgatgtaagatattagggatggccttaagatgtgacgcgccgttgtgaattgcgatcgctttgccc

SEQ ID NO: 670023 - DNA, 1221 bp, Homo sapiens
tgaatgtattctcctataataagtggtctcaacacccattctgcgcggaaaagtctcttcgactgggaagtgagtaagacctccggactctattaccccgaggtcatagtgtaaagctaaagcatggaagctcttgtgttgtgcctgctggtaagagtctttggtttagaagtcttcgttctgaaaagtgtgacaagtttcatgcatttgggctcacttatctttagctcctgtctacaatgtctatgagaaagttgttgagtaataaaattgggggacaatgagaagtctactagtgaaagttccaatgggaagtttcaagtgggaatggaggaaatgatttgtgttcaaaataagcttgtggtttatgtcgtcaacttagatgctgggctttgaatttacactaggttgtataccaggactttggttcagacttatcgccagaaggctgtctgcaaagtttaagcttcccctaccaaggcatgagaactatatagggttaacactctctgtaacagattgtcaaacctggtaaactcattcagacgaggggcagcatagattggcgagagccagcaagtctgctatctttcggtgaccatgtcacgttagacacacctggacttagcctacttggacgacacgtgcttccttctttctaaacacatgtctatttacaatgagagcttgagtattcttgcacccagtggttgtgaaatacagttgtccacgaaaggccaacatctggtcaccacagtctgtaatctccaagcacctttggggagtccctaatggatgggacagaggcaccattgatgccaatgatggttcaaagacacagaccctcggatcaaacagtgaatgaaactcatcggtcatctagcctgaaaaataatagaaaaactaggcacagatcatgagtgcatgcgctgtaacccgcagctatcttggagagctgaggcaatgagaatgcagcttgaaacctggagaggtggaaggttgcagatgaggccaagagtctgtactcattgccctccagccgctgggcgtcagatgcaacgactcatcgtgcaaagtatccagaagcatttattcaggactgcctgtgtatcttggtgagttatgttaaccaagctgtgttcaataagaagtacccatggaatgcctccagatacaaggtatattttttacccatacagctaaacacaaatatacctaatt

SEQ ID NO: 670024 - DNA, 851 bp, Homo sapiens
ccccaactttaggactggccagatctaactaagcctttctttttatatgtcgcatgagcaaaagggaatggccgtaagagttctaactcaagccataggatgtggcatcacccggtggcatacctatccaggcaattgaattctgtggcacctggatggagtcttgtgttaagacactagctatcactgctcggctggcacaggaagctaataagctgactttaggacagcaagtgacaatccagctactgcactcagttgataactttgatggaccaaagggggcaccatggttttcgaatccgagaataactcaataccaagggctcctatgtgataatccctgtgtaactttagagactgtgagtaccctaaatccagctaccttgctcccctattgaatcagtgccaggaagcccccttcattgctgagtggatgtggtagatgaagtgttctcaagccagagagatctgacagatcggccctcggagaactggacatcgaatattttactgatgggagcagcttcatactagagggagtccatgcaaactgggtatgcagtggtgacttggactcagcagtagaggccacagtctttgtctacaggacgtggctcttaggaaaggcaaaggtggtaggtcttataagaagtccctggtagcaaaagaccggagggaatattggccatgattctaatttggttgggccctgcgtgtagggggctattccaggaaaaggactttatcggggggtcacacagggtcacaaattgggggcggttggagagccaaggggaagaggggaaaggaaaaggggaaacaggcaagaggagggggcccttagaaag

SEQ ID NO: 670025 - DNA, 109 bp, Homo sapiens
ctcggccgccctgtggtgttaggcgcgtgttcgggctcttgcgtccccgcaacccacaccgcggttaacttggctcttcgggttcccgccgttcgacaaaccaggccct

SEQ ID NO: 670026 - DNA, 183 bp, Homo sapiens
cggcttctatacgatacaatgtgacttatgtgggacccccacaccggcgaaaggctgaggtcactccacatcaaccccaggaggctccatccccattttgcaaatggggaaactgtagcacagagaggttaagtaactagtccaaggccacggagcctgcagatgacagaggtaagactggaa

SEQ ID NO: 670027 - DNA, 856 bp, Homo sapiens
gatgtctatctgcggatcctgtgagatacatggtgctctggacttgcaaccaatggtgtggacgtgagacacgatcacgtgaactgcatcttgactgctctctcgtaccgcactcactgcaatctccgctcgcgtatttgcgaaacgtccgcgtgaccttgctactcggataatctccatggtatcttgcgagactcatgggacaagctctcgatctgtagttgtgtctgggttccctttctgtgtctaaagctaaaacaattgcatgtcttcactccaaggagtaacagttcaagagaatctatctacacaaccagaatgtcggagagtcagcacgttacatactatgtctcttgtgttcatattttgttgagcacatgtcgaggggctctccattatcagtcgctacccctacatgcgtcctgggtggcttgttcttagtgtgtcagaacacgccgcaatgcattgttcgtgcctcctcgcgtaaatggccgtttgtacgcccctggttttcttatcccggcagtaactttggcgcagacgcgagcacacgcccgtcagaagggagcctgaccgaaggctggttcctccccttgtaaacgacttgcaaaaatccctagggttggtgtctggcacgcagctcatcgtgtccatggcaccatctcaattggagagccaagctggaaacgatcgaagtggggtgtaaaaactctcctagaacgcgcatggaaaatgctggcctatcggaccccgtgcggaggaaaaaacggctgacacccaaggcccctttgtggatctttccatgcccatgtgtgttctgcaccgcaacggagccccccaatcttctgttgacttt

SEQ ID NO: 670028 - DNA, 141 bp, Homo sapiens
tgaaggacatcaaagaggtaagagctctttcagtgaacagtgaacagtgtcggcactgcaggcgcaggagaagccagagcagggcagagagaggccatgagggacaggggtggattaaagaaccaagacaccaggagaagg

SEQ ID NO: 670029 - DNA, 935 bp, Homo sapiens
  misc_feature (712)..(712): n is a, c, g, or t
caaacactgcaggctgaagacaccactatatagtggttggtacacccgggagtagatgtctgagtatgttaaacagaaagtatacctttctccaagaatggatcaaaatagtttgtattatggatgaacgcgacgtatgataagtgttagagactcgttggattgtgatggaatctaaatactatgaggattttacaaaaaaattaatactctaaagtattgcgagagtatgttgtgtgtcgttatttccatagctccaatcaatagtggacgcctaagctgtaggtgtgtgtggatatgtagacagaagagaattcgattgagatgatccacattctggaattttctagtgtgagatagaaagtgaagaattgtaccctatagctggaaatcaacatcagctatcatacttctttgctggccgagacgagggaactggacgtatggcagtacatcttagatgagcttgataacgagaacactgagccagtatacaacaggcgtgtcaatttagtgctcgaatactgaggcgcacaggtggactggcgtgtagtgagaaagtatgcactgcccagaagaacttcaccatgctttctggcgtctgggcatggttgaccatggactccagagggacgagaggatgttgtcatggaggggaatttccggtaagggttcaaagatcgtgtagctggaatcacttatgaacttgatnaggctcagtcgggtattgattgtgctgacaagtgttcgcgttgataagattcatgattctagctagcaatgcgtgagaaggtatatttcgaagaattgggagaggggggcgattggcgaacgaaagtgtggaaaaaaggggcacgggaagaagaaagaaggtcttgtcgaattggcacttctctagggactcaggggggaatccttaagtggggcttttaacg

SEQ ID NO: 670030 - DNA, 693 bp, Homo sapiens
ataagccccttattgacttcctatcaaatagatagccttacagctgaatttcttaccctgcagattgggtttaaactgtgcttaacagctttagttttttgtgagattaacagattgtgaaaagtaaacttagccaaatctcatgtgaggattaaaaaaagcgatgtacccagataagtcaatgtgtacactaaaaggatactaaacaattttaaattaactatattaaggtattatgattcaaaatttacagacacccaggcaaagtaataagggcactgtttaataattttgacttaaataataaaagtaaggcttataaaaatttaatgcccaacaattaaagagcgcggaccgggaaaaaatataaacgcccaagaattataccccgaaacagtcaacatctaaggtcaatcctttaacacctttaggggaagttaacgtttgcaaaacaatatctacaaagctctacagtaaataagacactactataagccggccaaattctgggtgaagttttaccacgtaaacctacggatgattatcccggtccatccaagggttcctagggacaaagcaaatggccaataacaagtagattttaaggaaacctgataattaccctacgggtcattcccatattaacctaagagtaaaaacacaacgtcaaacatgaaccctccctgggaccaa

SEQ ID NO: 670031 - DNA, 721 bp, Homo sapiens
actatatgctgtacccatggtgctatatcatgcctcattggttctacagagatggaaccatgtcacccgctaaggtgtggctaatgccagtgcattagctaggctgcttgaggctctggagtggatgctaccaccaactcgtccatgtgacaatgcccttgtgcttggcttctccaggatgtctacgaaattggtgcgtatcgtgtacggtctcctgattggctcgagtggtggactggtgtttctcatgacccggtgatggtggtgcacctttgtgtccatgtctcccgttagcgacggatgtagaatctgtcgaccttgcaccagggtagtgctttgagtcgatatcgtctctccctggagggagcagactgtgtgcgtctgtcacgtgtcaatgcacatgtgtcttgttcatgggaatgttcgggcggtggccctcggtatgtcgttgccttgatcaggaacataagtgtagcccatcgcgatctggtgagcagtctggacttcatctgccccgtttgatgatccttgaagcatccaggccaaaataaagcgccaggctagtgcccctgtatatggagtggccacacggttcacttcgcatgctaagattagcggaagctgaaagggagaagattgactcagccgttctggtaacaaaagctcggaagattggtcctaaaattctggaaggtctggtgatgcgtgccagtggttgaaa

SEQ ID NO: 670032 - DNA, 159 bp, Homo sapiens
gttgagccacgcatgtagtacttttggtgatcttgaacattatagtactggggcttgtaggctctgtgtttacgaaagctcctcttcccagccaaggaaggagtctatagggccctgccgtgccttggagagttgatcctagagcccgcgtgctatggg

SEQ ID NO: 670033 - DNA, 1808 bp, Homo sapiens
gtggcttgtgtggctggagcagtgacctgtgccaggaagcgtgtgtgcctgtgcctggtccagtgagctggtctgcaaagtgcaaacagtggtgcatgacagatgtgtgtggatgattgaatgcctgtgtgtgcaatgctgtgtgatgctagcctggctcactccgtgtgcacgacgggtgagtcgtctgacttgctacctgcacgatggtttgatgccctcagttatcctgtgtgtgagtggcttgacatgtgcgtgtggcatgtgctaaagctatgtggtcggattgttgaaggctgtgttgagacgtatagcgactgaccatggacactcaatacttagattgggaaatagacgaatagcagctaggaaggtgttgcgtggggtgacttagcagtcaaggatggttgcattgtgataacgtatcgaggtgctgtgaggcgtacctgattgtggatagataaggagcatataggggcgcgcatcgagattggtgggtagcagtggtcaggcagacgttggcgaaagtggttgagcggaattatggtttacgacattaagttgatgattacgaatagtgacattgacactgacgatatatgagtgctattacaggaatacactcttacgaagtacgcgttgtacctgaagcgcatatgagaccatttcgcatcccctagcgtaaacacacagtataataaacaatttttgagaccataacgcgtacgtttgacaccaattacgagcacaggatcgggagaagactaacatacgtgtactttgtgacactaactctgtgaatatgcaagaacagacaaagtactatatggcagtaagggcaaacgcgtaggtcagaccacattactaagggttggccattcctgggcggcctcaaaaagccatgcaccacattagcgacaagggatccctccctcacacacaacatccaccgggaatttgcacatccaattcgcggacacgcaccaatgttggggacttcccagaaaagggaatacgcggggagttattataatcacacagaaaataattttgaattcatcgcataattatggggtgcaggttttggaaatatgcacaaaaaacagagaagtaagcaagaaccctagggagtaaacatattggatgttatggtatccacaaagaaataaactagtattggtaaaaaaaaaaaaaaaagggagtgtaaaagtgaagtcgagaaagtgtgataattccattggtgtataaaagggataaaacctatagacaataagagggtgataataaaaaaatactagcaatgaatagaacaagtaacaaacgccccagacgacagatgggaaccatatgagcgaaacactactgggaacccgcataaactacagagaattacgccacacagagacgtacaaagacagcgagccaacagagaacaaagacacaagagaagaagagtgcgataacagcaagagctgagatcaaaatcgaggtgagaaacacatagcagcacacgacgagagcaagctaacgatcatagtcaatgacgaccagtggagcgaccctacaccagtactctagacaacaagagcacccaaggaagagccaagagtaagcacagttaaatataataaagaaagaagtcacagtagagcacataagacgacacagaaatagatagcgacagctacacagacgagcatgctacctagctaagcaacagagcacacaagaatacgcgatagacagcaacataagtaaagacataagacagcatacgagcgtaaggaagtatcgatgcatagcacgtg

SEQ ID NO: 670034 - DNA, 788 bp, Homo sapiens
gtgcgatggtgctccagtgaagtgtggagtgagtgaagtgaagccccgggtgaccccgaccacgaggccagcacccagtgctcgtgacctgtgtgtgccagagcatagcaatgggtgggtgtgcatgggtggacgatggggccccagccacggagctgtggagccccagtgatgctgggacccctggagaggagccagtggggatgagtgcaggtgggccacggggaagataggcctggagcccttaatgccccaaagatgagcaagaagaggaatgctggagctgagccggctgggagcagcctgcccacagagccaggccctcagagtgcctcagaggtggagaagatcgctctgaatttggaggggtgtgccctcagccagggcagcctcagtgacggggacccaggaagtgggcggtcaggaccctggggaggcagtgcagccctgccgccaagccctgcggagccagggttggcccgacaacggtgagggaagcggagggaagggtgcgatgagggatgcatgcaggacaaggatgcttgcggttggaccagtgcgctgcgtgaccgagagccattggcccctttgcctgggatcgcaccgtggcgccagtcgggcggccaagcgccggagggacagcgacccggacggtggaagaaacggggggttctgcacgcgcagcgtcacgccaggaccgcgggtacgtaccgcggggccgcccaacgggaaagcggaaggcaccacgggggcacagccccacgatcggcgggacccgccacggaggc

SEQ ID NO: 670035 - DNA, 658 bp, Homo sapiens
  misc_feature (364)..(364): n is a, c, g, or t
ctctctctctctctctctctctctctctctctctctctctctctctctctctctctctctctctctctctctctctcctaagattaaaaacgccctaacccacttcttaccacaaggcacacctacacccactatcccaatactacttattatggaaacgatcacgctactcattgaaccaatagccctggccgtgcccctaaccgataacattactgcaggccacctactcatgcacctacctggaagcgccaccctagcaatataaaccattaacctttcctctacacttatgatacttacaacactaattctactgactatactagaaatcactgtcgccttcaaccccccctgcgctgtnacacttctagtgagcctttacctgcacgacaacacttaccaaattttagtacaataaatgctgaatgaattccgggggggggggggggggggcccctcccaacaaaacctcgagggggggcccgtgtcccaactccgccctataaaagacccgtgaaaacaaaatcaagggcccgctcttaaccaaacgggccccacggggaaaaacccagcctttcccccacattaatggcttttaaaattcccccttttttcccggtggccaacctaagaagcccccccactgcgcactacc

SEQ ID NO: 670036 - DNA, 311 bp, Homo sapiens
tttcgcccaggccggagtgcagtgacgctatctcggctcactgcatgctccgcctcccgggctcatgccattttcctgcctcagcctcccgagtagctgggactacaggcgcccgccaccacgcccagctaattttttgtatttttggtagacacagggtttcaccgtgttagccaggatggtctcaatctcctggcctcgtgatccacctgcctcggcctcccaaagtgctgggattacaggcgtgagccaccgtgcccggccgagtggacttttttcccatgagccctatgggcagtctgctacttggt

SEQ ID NO: 670037 - DNA, 604 bp, Homo sapiens
  misc_feature (27)..(27): n is a, c, g, or t
  misc_feature (100)..(100): n is a, c, g, or t
  misc_feature (127)..(128): n is a, c, g, or t
  misc_feature (235)..(235): n is a, c, g, or t
  misc_feature (237)..(239): n is a, c, g, or t
  misc_feature (251)..(251): n is a, c, g, or t
  misc_feature (253)..(253): n is a, c, g, or t
  misc_feature (257)..(257): n is a, c, g, or t
  misc_feature (268)..(268): n is a, c, g, or t
  misc_feature (308)..(308): n is a, c, g, or t
  misc_feature (345)..(345): n is a, c, g, or t
  misc_feature (357)..(357): n is a, c, g, or t
  misc_feature (361)..(361): n is a, c, g, or t
  misc_feature (377)..(377): n is a, c, g, or t
  misc_feature (388)..(388): n is a, c, g, or t
  misc_feature (398)..(398): n is a, c, g, or t
  misc_feature (414)..(414): n is a, c, g, or t
  misc_feature (420)..(421): n is a, c, g, or t
  misc_feature (427)..(427): n is a, c, g, or t
  misc_feature (430)..(430): n is a, c, g, or t
  misc_feature (433)..(434): n is a, c, g, or t
  misc_feature (439)..(439): n is a, c, g, or t
  misc_feature (443)..(443): n is a, c, g, or t
  misc_feature (449)..(449): n is a, c, g, or t
  misc_feature (451)..(451): n is a, c, g, or t
  misc_feature (454)..(454): n is a, c, g, or t
  misc_feature (456)..(456): n is a, c, g, or t
  misc_feature (467)..(467): n is a, c, g, or t
  misc_feature (472)..(472): n is a, c, g, or t
  misc_feature (484)..(484): n is a, c, g, or t
  misc_feature (492)..(492): n is a, c, g, or t
  misc_feature (495)..(495): n is a, c, g, or t
  misc_feature (522)..(522): n is a, c, g, or t
  misc_feature (525)..(525): n is a, c, g, or t
  misc_feature (543)..(543): n is a, c, g, or t
  misc_feature (564)..(564): n is a, c, g, or t
atcatacatagctctctttcacatcangcagtagaacactgcatttacttcatctcaggatactggatacaagattaatagtcagtttgtctcaaaatangtcaatgtgttctgtctgaaaacatgnngagggcttggagtaatcatatcattttacgaggtgctttagaaaaccaagctacaggtcctgaatacattccaaaaatcctaaataattaccaacagaagagagaantnnngccagccagtanantcantaaagaagtanaaaggtgcagacaatgtaactttaccaggaagcttaaggnggggcccagcttctcggcaggagtcagcaggcctggnagcctccatggntggngctgctgtgtggaaanaaggccatggncttcttgaantcctggaagctccagngcatcnncaccanctnggnnctgancagnacccgnancangnccagctcctgnagcangagttcattggngctgaccnggnagccgtggctctcctgcagcatctgcntgncccctggctcttgtcgtngtgctccccgcgctgcttccnttccacaatctcgccacacagcctcttcacacttgtttgg

SEQ ID NO: 670038 - DNA, 558 bp, Homo sapiens
  misc_feature (90)..(90): n is a, c, g, or t
catggaagtggatgggctgagactctcgaacagatcgaggtggagattctattggtgaaacacgactcctggagccagtaaaagaaatcnacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtggaaaaaagaaattaataaaagaattcgccccctttttgatgaggaattagatgttaggttcccagaagaaaatagggtacttcctcctccagcgggtaaggttcctattggaactccagctcgaaagctgacagctactccaaccccttgggggggtatgacgggtttccacaggcaaactaaggatcgacttatgaaaagtgttaatgaccagcctttgggaatttttccatttttaaaacctgatgatattcaatactttgataaactattggttgatgttgatgaatcaacacttagtaccagaagagc

SEQ ID NO: 670039 - DNA, 131 bp, Homo sapiens
  misc_feature (84)..(84): n is a, c, g, or t
  misc_feature (88)..(88): n is a, c, g, or t
  misc_feature (106)..(106): n is a, c, g, or t
  misc_feature (113)..(113): n is a, c, g, or t
ggaggctgaggcagtggctccttgctcagcagctgcacgcgccgtggctccggatctcttcgtctttgcagcgaaaacaaaatnctgncagcgccggttgacctcngccgccntgtcgttgccccttagtg

SEQ ID NO: 670040 - DNA, 240 bp, Homo sapiens
cgtattcctaataacggaagaggcatctggtttggtgttcgagcctggcagaatgaagctactactcagaggaggagatattctaacgtagaacattagacccaagcagggtgaggaagaatgagagtggataagacaggggagctaaacaaattaaaaaaaaatacactgagaataatggaaaccagatttcttgctgtcagataaaagagttataaagatggaaaagcgtaattaggg

SEQ ID NO: 670041 - DNA, 136 bp, Homo sapiens
ggactcgtaccccacctggactgggtcctgcgctcgtccttagtgggccctacaaacccagtctcatgattcccccaaatcccccagacccatctgccatcagccaggccactagctctgttcccccacccaaagt

SEQ ID NO: 670042 - DNA, 151 bp, Homo sapiens
gcatgatcacgccctcgatactcattctccttatctgcttcctagtccggtatgcccttttgcttagcactcacaaccaaaactaactactactaacattctcagcacgctcaggcacatagagaacgcgtctgaactatcctgtcccgcc

SEQ ID NO: 670043 - DNA, 257 bp, Homo sapiens
  misc_feature (104)..(104): n is a, c, g, or t
  misc_feature (171)..(171): n is a, c, g, or t
gggtatacgcaaggcggtttcatcgcttgggaaatcctatcttgtatttaggtgccaaggttataacccactgtttgaacttgtgccagataattcttccaaanatgtctcttctccaagcaccacgtctagctctttcttgaccagtctgaagaagccttatggcatctnctctttcctggacaactttatctcatgcatccatagaatctactaccttatctaaccgctctggacttggccttgccatatgccaa

SEQ ID NO: 670044 - DNA, 103 bp, Homo sapiens
ccgttggtggttgatgtaaatgagtgatgcaggagtcgaggaggttagttgtggcaataaaaatgattaaaggatcccaactggtgacctggctgacttctgt

SEQ ID NO: 670045 - DNA, 950 bp, Homo sapiens
agagataaaccttacaagtgtagtgagtgtggctggaccttcagtcagaagtcaaagcttacgtgccattcgtagacttcttactggagaataacgagttgtaaatgaatgtggttgaggtttttagttcaatagaggtcacaaccgtagtattggtctatatcagatgaagttcatactcggggagtaatacctatgagaaaatgatgaatgcagtgtgactaatagtgtatggaagttggcaaaaaattaaggcttcaggaaggacaggaggaatatccaagtatttggtagagaaatgctgatgggattggtgaatgaatgtcactacagtggagctggtcgcattgttttaataccggtgaaaagacgaggaggaatgcatacctgagaggagagaacctataataccatgtacggagtggtgtgaggatatggctttttggggcattgatgtgtgaatcttggcacgaataatgcgtagaagttcacacgtgggtggcagaatagactttaccatgtgtatcgtgaggtgtgcgtaaataagcctttaggattggcacgtcgaaggagtttgtttacacggtcttgaaaatccatggtgtaggggaaaactttgagttaatggtaaatgactttgttcacaccgcgttttcatgataagtgcttaacgaccatggtgaatctctggggaaatccgtaaggatgaagcagactctggctagggtagaagttggggggggttacagaaattggtaatactgtgagggtcaacagaggaattaaacgctggggagaaacgtgaaatgtttgttgtggaggattaagctgtcttgctatggacgtgggaatatcacgggggaacccctgggtttgtgggcgtaacattggctctggaaaaaagttggggatacaaaataaacggcgttggattttgaataaaaaaaggg

SEQ ID NO: 670046 - DNA, 1000 bp, Homo sapiens
  misc_feature (620)..(620): n is a, c, g, or t
  misc_feature (629)..(629): n is a, c, g, or t
  misc_feature (686)..(687): n is a, c, g, or t
  misc_feature (700)..(700): n is a, c, g, or t
  misc_feature (719)..(720): n is a, c, g, or t
  misc_feature (804)..(804): n is a, c, g, or t
  misc_feature (821)..(821): n is a, c, g, or t
  misc_feature (823)..(823): n is a, c, g, or t
  misc_feature (831)..(831): n is a, c, g, or t
  misc_feature (837)..(837): n is a, c, g, or t
  misc_feature (840)..(840): n is a, c, g, or t
  misc_feature (842)..(842): n is a, c, g, or t
  misc_feature (856)..(856): n is a, c, g, or t
  misc_feature (859)..(859): n is a, c, g, or t
  misc_feature (865)..(865): n is a, c, g, or t
  misc_feature (876)..(876): n is a, c, g, or t
  misc_feature (879)..(879): n is a, c, g, or t
gaggtgatccacctgcctcaacctctcaaagtgctgggattacaggtgtgaaccaccgcacctgttccttataaggacaattgtaattacatgtcaggcccacggggacactccagaatcatctctccatggcaatatccctggaataaaagtcctccttccatagagagcattctgtaatgtgtccacagcatgcttatccaggtaagaacatgctgggggccattattctgtctcccacgtggaattaggacgtcgacatctttgggaccattattctgtctcccacatggaattaggacgtggacatatttggggacattattctgtctatcacatgggattaggacgtggacatctttggggccattattctgtctcccacatgggattaggacatggccatatttacgggacattattttgcctcccacgatcagtgagtaattcaatcgccacagataccgaaacgtcaactgagatggtggctgacaggtggtctagggcctacaggggacttcaggacttggagccgagagagagccgagcttgggatggatctgacggtgaggtgccagctgtttcctccctcgtgggtgttccacgtccctcctgcaaancccagcggncccttgcttcagagtttcaggggagatttgacgatggagcagaggcagcttccgganncttctaccctgancttttgattcacaagtcanngctgggggagagatggagccaggctcttggtgggggagaagcgtctaaaacacaagcaggacagaaaaagcgcggaaatccttnggcctgcaagaagtgananggggagantcccanagngngccccaggaagcanggnccactncccagggagancanattcctggggtatgaaacctgtgggcttcagaagaactcacgggcgtatttacctcagaagcagaggcctccggcgtccaggcaaacgaagaaggccgggacgtggataccaggcctagta

SEQ ID NO: 670047 - DNA, 569 bp, Homo sapiens
cttttgtgggacttcagtcatgctgataatagaatcttctgttcatacaattctgtaatatttatttgtacagttagtattctaatgaaaggatgaagagtctgaactagaataccattctgatgttggagcggccgccaacttttttttttgtacagttagtattctaatgaaaggatgaagagtctgaactagaaggtaggtttaagccatcaccaggcctttgcaaatggcctaaatggtgttccctttgaaataacgcttgccacaagtatataataagctatattaattgtgttttgcataaaattgccaaaacacagtaatgtgtatatagtggtataagatcttgaaaaaaatctctataattgtgctctttatctgtgaatgggaaaagccatttttagtaggtgactaccatttgaaaaactcaattggatgtatatctgaatgttgcattgtattgtacagtatgcatattattgtttgtggttgcatatggcaatgaagtgtttgttttatattaaaaaaaacctgttatgtacagttgaaataaattttgcatttgc

SEQ ID NO: 670048 - DNA, 642 bp, Homo sapiens
gagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcacgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaaaactttgggggacagacattccaagagggaatgtgaggcaaagacttacatattaccggatttccaccaaagggccttgacagattgtgaactccccacgtttgcggctgaagaactctttaacctcttggaaactacttattatggcctagtgatacaaaacgtctataagggtggcccaaaaatcgtggcgggacaacaattcaattacacgagtgcacatgcggcacagccattgtgatagaggcagggggaaaacttaacaacacaggatcatctcagagaacacagagatagtataaccaggcgtcgctctcccga

SEQ ID NO: 670049 - DNA, 179 bp, Homo sapiens
atagacaccggatggtctcatctcttgactatgatctgctggctcagcctctcaaagtgctggggttacaggcgtaagccaccgaatctagctagacactgactttttcaacacattttccctggaagaaccaagacccattttgatgggcttcccaaaggggccattcaacgcctccg

SEQ ID NO: 670050 - DNA, 227 bp, Homo sapiens
  misc_feature (16)..(16): n is a, c, g, or t
  misc_feature (33)..(33): n is a, c, g, or t
  misc_feature (42)..(42): n is a, c, g, or t
  misc_feature (59)..(59): n is a, c, g, or t
  misc_feature (61)..(61): n is a, c, g, or t
  misc_feature (98)..(98): n is a, c, g, or t
  misc_feature (130)..(130): n is a, c, g, or t
  misc_feature (135)..(135): n is a, c, g, or t
  misc_feature (141)..(141): n is a, c, g, or t
  misc_feature (158)..(158): n is a, c, g, or t
  misc_feature (193)..(193): n is a, c, g, or t
  misc_feature (200)..(200): n is a, c, g, or t
  misc_feature (204)..(204): n is a, c, g, or t
  misc_feature (206)..(206): n is a, c, g, or t
  misc_feature (211)..(211): n is a, c, g, or t
  misc_feature (213)..(213): n is a, c, g, or t
  misc_feature (216)..(219): n is a, c, g, or t
tgcttatgtctttacngatggttctgtcaaacnacaaccccngagttataaggttgccncncattacagaagtgtcaattagatttaagacaattttncttttctttaaagatacagcatttaaaaaatnccccnaattgngttatgccaaagtttcnaacccttgtgcgtgtaacttgttacaaaattcccngaaaacntaananccccncncannnncccccccc

SEQ ID NO: 670051 - DNA, 484 bp, Homo sapiens
tcctaaggtgtgccagacgtggacgtgtcgggtgaagaagcaaggttagtatggcccagacggcttccggggaaacaggaaggagtgggacaatgagttaacctcctagagtacctttcagcgaggctcaggcagtacttcagggtgaggttcccggtggaattcactcactcagaatttcaaagtgcttgcggtatcaactcaagagatacaccatttgttttactattgttagtcggctgccatagtaactattttagttagccagggagagaatatatattagggaaacaaataaaagtattgagttgtctgtatcagttgaatgatctctctcggtgtgtgtgtgtgtgcgtgcacgcgtgtgtgtgtaagagagagaaagggagagagaaatggatgccacagttggactcatatgggtagctatggcttgtgtctgtgatagtctaaatataggtcttcaatgtgttgtaattccggt

SEQ ID NO: 670052 - DNA, 117 bp, Homo sapiens
cccccatgacctgtggctggaaccctacagtcccctactcacgacctacactctcctacccatgacccctgtgtggaaccctacagtcccctactcacaaccccgaacactggatat

SEQ ID NO: 670053 - DNA, 112 bp, Homo sapiens
  misc_feature (35)..(35): n is a, c, g, or t
gcagaaaagggaataataaggcaagagagagaganacgagaaaaaccaggcaagggtaggtcagatagacggtcagggacaaagacgacacccacgtcacggaagacataaa

SEQ ID NO: 670054 - DNA, 714 bp, Homo sapiens
cgacgatgatctacgagttactattgaggtatcgcgtatagctgaggaacactcgacgttggattgcatcatagcgtgcagtctcacgagttcgaaacgccaatgtgggtggatctctttacctgtggaataagaaagcagcctgggcaacatggtgaatgcccatctctacaaaaaatacaaaaattagccaggtgggtggcatgtgcctgtagttcccaggttcttgggaggccgaggtgaaaggattgcttgagctggggaggctgaggctgcagtgagccatatgccactgtactccaacctgggaaacagagcgagactccatctcaaaaaaaagcgaaagaaactggatcattggtttgaatacccctttcccagcagcagcgccccccaggcagttttacaggtgaatatacctgatatttaattaacaaatctttaagctatttctcagaggctaggaaaagaaggcaagcttcacaactttttttaaaaggctaagtttaaccttgatctcaaaaccatataaatacgatctaagaaggaaacattttttgtaggccaatctctcgctttcacaagcaaaaaataaacgtcttaagtggaatattaacgaaattgaaccagcaatgtttaaaaagtcctacatggttgagcagtagaagtatccggggatgcgaaatacttacatgaaaatctatctgtgtccac

SEQ ID NO: 670055 - DNA, 517 bp, Homo sapiens
  misc_feature (18)..(18): n is a, c, g, or t
  misc_feature (46)..(46): n is a, c, g, or t
  misc_feature (101)..(101): n is a, c, g, or t
  misc_feature (119)..(119): n is a, c, g, or t
  misc_feature (126)..(126): n is a, c, g, or t
  misc_feature (129)..(129): n is a, c, g, or t
  misc_feature (147)..(147): n is a, c, g, or t
  misc_feature (155)..(155): n is a, c, g, or t
agcactcagcaccaatgngttcagaccctcccaccgcctggttgcncttacaccgcgaggaagcttccctcgcaatttgtggtagattactatgagaccancagccctctgctcccagnccagctntgntattccaacccaaagagncaagcaantctgcgctgaccccagtgagtcctgggtccaggagtacgtgtatgacctggaactgaactgagctgctcagagacaggaagtcttcagggaaggccacctgagcctggatgcttctcctgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatac

SEQ ID NO: 670056 - DNA, 869 bp, Homo sapiens
gatgagccactgcgcccggctgtaaatgtcaagagattcaatacatacacaagtatatctgctgagtacaatagcattaaattaaaatttcagcctgggcaagatggcgaaaaccccatctctacagaaaattcagaaagaagaataattagccaggttggtggcaagagtccccatctctacaaaaattagaaaaaaataattagccaggtcggtggcatttgcctgtactcccagctacacaggaggctgaggtgggagaatcacctgagcccagggaagttcaaggctgcagtacaccgtgatcacaccactgcagtccacccatgggtgacgagtgagactcaaaacacaaaacaaacaaaattaataactgaggacattctcggtcaaaaacatcacacaacttaattaacttaccattaactaccagaaagaggcagtacagtagcttgcgccatgtaatcccagcatatctggaggctgagcgtggccagatcactcgaggcaggaagtcaagaccagcctgggtacatagcaagacctcgggtccaaagaatacaaacaactcagtgcagaccaggggggcccaggccggaggccacaccagtcggacgccgtccggaagaacaggacactagaagctcaggctagcaacgcacacccgccacaccgcggcgcgccaacacaacagacgcccaacaccaggatcaacggggaacaacaacacagtaataaccaccacaacaacgaagctacgaccagaaagccgcgcacatccacaaggtgaccgacacgtaacctcgtccgccctcggctgctctacaagacgaagaagacagcaacgagcacgaaaaacaggaaaacct

SEQ ID NO: 670057 - DNA, 101 bp, Homo sapiens
cttagaggatcccccaatgaagaagataaagaaaatcaaggagcatgagacaaggtcagcagccacctcaacgtcggtaccgccgcaactggtacggcggg

SEQ ID NO: 670058 - DNA, 192 bp, Homo sapiens
aatctcactcttggccagcgcacagtgctcatgcctgtaatcgcagcactttgggaggctgaatgtagcgtgaagatgaaagacaggaaaagcatcgattgaaaatgacggctatgttgcccaagccgatctccaactcctgttctcaagtgatcctcccacctcagcctcctgaatagctgggactatagg

SEQ ID NO: 670059 - DNA, 474 bp, Homo sapiens
  misc_feature (261)..(261): n is a, c, g, or t
ctttgtgttctacatttcatttgctttttatattacacaatttttatagaaaacaataatagggacttctattctacctagcatagtagatgtacagaaaatttctcccagtagagaacacttaagagtgatgaataaaatatctaataagtcatggctgaaatgaaagtaaagtgatagggaaaatataagagacaagaaataagaaaggaagattctacaatgatgaaagcttgaaatagtgtttgctctcaggtcatntgataattcctaatgactatagctgggtttcaatgaccacaaggctgtgggacacagggataatgcatggggctacagcagcctggaagactgaattagagactcaaatgcagagttgggactcttcaggataataccatcaatggataaactaggaaatgccctgtctaaagaaggaacactgcctgtctcagtcttgactttggatggaag

SEQ ID NO: 670060 - DNA, 265 bp, Homo sapiens
aagtagctatagagtggagcgcattacatgggtgagccgtataatgttagaccaaatccccatgagccacaaatttacccctgtgacaaagcagcacatgtacctcctgaacctatagtaaaagttggaaagagaaaaagaaaaaaaaaaaagtctggaactctgaaaggtggatgggcctcttactcctttcagtttttgtcaggtttggcttcttgtatggtgacgctttattatttaggttcacacgcctttaggactatga

SEQ ID NO: 670061 - DNA, 373 bp, Homo sapiens
tgaattaaacagattttatgaatgtctatgtaagctactttatatttccctgtgtaggctttgcttacgtgaatgcttgcttattgcttcaaaatgtaaatcacagatagctctgtgcgatataattgaataatgagtaacttcatttggctaacttatacctataaatcttttaatccataatggcctttttaataacatgaggagatgaacaataatgtccattggtctacatgtatgccaaccacctgtaatgcattgggaactgagctagcagctggaaacagaggcacaagtaagacatagtgtctgtacacttcaagcccattagccagagggagcaatggaatgaatattatagcatgagtattta

SEQ ID NO: 670062 - DNA, 299 bp, Homo sapiens
ctgggcattgttggaaggggaggtgaatgtgtaaaagctacggtaggtaaacaacagacagtgaagaatgtcaaatataagctacagtgctaatctctgttggaagcactggattccgaagtgaagagcagtagtcggacagcctcatctgtatacactaagctctctagaagtacgctggaataaaatgccttgtaacgtccttggtgacaggacttcaatggagacacacaggtatccatccgtggaaacactggagttcaagaaactggtcctttcagatcattttgcgagggtct

SEQ ID NO: 670063 - DNA, 125 bp, Homo sapiens
aaactatactctctatactaatctccctacaaatctccttaattattacattcacagccacagaactaatcatattttaatatccttcttacgaaaccacacttatccccaccttggcctatcat

SEQ ID NO: 670064 - DNA, 437 bp, Homo sapiens
  misc_feature (338)..(338): n is a, c, g, or t
  misc_feature (340)..(340): n is a, c, g, or t
tttataatccaaagttctctggcaaaattgcctccatctctcatttcattcaacattcattcattcattctacaaaggccacttgtcatagattgtcttgtattatcacctacgattgaagtgtctttttctttctgtttaattgcaaagaatagaaattcactcaagcttgtttgcataaagggaggtgaattgaagagatgtcccaggatgtcttgtcatcaagccacatttcccaagagttccagtgaatgggacccttccagttatcattcaccctggacctgcttagtgcaggagagggttgggggcacagttccttccaagggggcctgtgntnggctgatgtagcagttgtgacctgcaattagcctacaatggggggcaaaatcatgtaacaaaaagcctattttgtattaaagcatcaaatatctcaa

SEQ ID NO: 670065 - DNA, 236 bp, Homo sapiens
cacagcagaattcagggcaaatcgaaactcgtgaaggtgcttgtcccagtgtttgtgctgggtccctacataggaagcaatcattgtcttcaaggttcgatttactctctcagtgagattggtctgtgggtgataggccgtggtcaacttctgcctcaggttccatctttggcaggtctcctcaaagagatcagagacaaattgggaacctcgatcagacaggatgtagtcgacgc

SEQ ID NO: 670066 - DNA, 110 bp, Homo sapiens
aagaagatgaagatgtagaaggggatgaggacgacgatgaagtcagttaggaagaagaagaattttgactttatgtaagaagatttaagattaggattaggatgtagaga

SEQ ID NO: 670067 - DNA, 963 bp, Homo sapiens
gctgcggtgaacttgcccctggaacgcgacgccgagagcttcctactgaagagccccatcgcggccctgatagcctggacaagagagtcatccatcattattccacatgtgaattctctatctgacgcgtggtgccccgcgatgtgcctgtgttcatcgagggcaagcgagacctgtgcgatgtcaactgactacgccgcagccatcgtacgtagcccatgacgatcatcatatcacatgaagaggcaggcatacaatggcagttctatcccgtcacgcgaccgcgaacgttcatgtgaagcccacaggcactacctggccgcatgcaagccacgacggcgcttcaacggcatgacgctacaagaccgttccgaccgtcaacgactccgcagacatggagctggaggaagcggagaccggcgaggaagctcatgatagacacggctgacaggaccaagtgacaggggcctgacgccaagtcgctgcatacactccacattgccattatcagaggccgtgaagccatgctgacactatgggccatgccgaggctgagggcctgcctgggacggccctccaggtgcatgtcccatgaggaacagatgagcagatgagagtggtcctgacactgctcatgacagccagcaccacgatttccacactgatgatcaatcgccaatcaatacaacactaatacctcggctggacgcacccacaacccactgagcacacgaccggccccacgaaccatcggtcgaaggcatcaacgcatcacagcgctcgaggcgctacgacaagaccccacgcaaaaaacaacaggggcacagcaacacacaagcacggtcactacacaccccacagggaaaggcgctatcaccacgggatacaccaccacagatacaagaggggcagcagaacacccatctaaaacaagtaacccacgacgagaataccctgagcaca

SEQ ID NO: 670068 - DNA, 242 bp, Homo sapiens
tcccgctctcctcgggctctctgcccccgccccgtttctcctcccccatcgcgagggccccttccctcccctccctgcgggcgggcaattcaaacccgaaagtgcaggaaggcggcgctcggggttggcgggcgggggaaagcgctgccgccaaaaaaccgccgccgagatgggcgctcttgtgcggtatggccccgcccctcgcccacgttccccgcgcacgagacgcgcgctgtcgccgc

SEQ ID NO: 670069 - DNA, 1266 bp, Homo sapiens
  misc_feature (1266)..(1266): n is a, c, g, or t
ggacgaataccctgatacgcatcatagaatacctatacagtagtaggtagcctatacacccaaagtagtactagacacacgtaggtacgagccctaacaatagccaccctactaccgtaccatacagtatggtaagagaataactagatagagacctaatatgcatatgacaaacgagggccctactaatagataatactagctataccggcactactagaaagctagacgcacacgccaacctaactgggcgatactagaaagccacctaatgtactacaggcctaccgatagcagtaggtagtacaaccaacctaggccttaccgttataccctagtggccatgctaacaataagcctagaccctaccggcagagtatagggcgagtacgaacaatagggtaccacctataccccaaccgtacttctcgatatatactatatattagctcttagggctatataggcccccatactacgaaccaagtcccgtagcgaacgcccgaggccaggtaattaccgaggcttactataaacaggataggcccgtgcaaacttacaatccccaaggccaagggtacttatacggaataggcccaaagggaaagcgataggaatagcggcttaggcccttaggtaggaacgccccacggtcctaacggggcgctggaattaaccttaacaacccggtagggacttagcctaggtacttatacccgggtagtggtaaccgggcattagttacgccattaggaacaggcggaagggcgttaccggcacataggcaaggcccaaggcaattaggccgtattcacacccggatatggccgacagtgaagaagccacacggaaaacctaaggtccaaggccctataagccttatcgaggttagggccaccacttagggcagttacaccccgctaagacccgagaatcaggtaaccacacgggacacaatggacacgggtaccttaggttaggcaccaattaccactgccaaaccccttaccggttagggcgccccttaacgagaagaggaattaggggccgaaggttaccaaacgccttttctacccacttatctcggcgggcgcaacaaattaaaaagcgccaaacccaaactgcccaccgaattaccgccagaggtggacagggcccttaccgttatataccgagacgatcgcgccctgtgcgcaatatacatttaccgagtgaacatgcgccaacgcgcttatcccaaccttataggagccccacagtaggtan

SEQ ID NO: 670070 - DNA, 339 bp, Homo sapiens
tgatataagtgcgcaaaggttacaatagatgtctaccctcaaaaatcaatatagaatgatttgtcatcatccatttaataccacaagggtatcagccacaaactagaaatatcactcatatgcaaataaaataacattcaagactatatatcgtagaggtatattacatcttgtaatggatggacataaatctattcacatactcatcctatcctcaaattacactattctctcctctcattcttactttgtactactcatattctcacactatcctcctacgcataaaatataatgtatcctaatgaacagagataccatacgtgggcaaggaaaaaa

SEQ ID NO: 670071 - DNA, 450 bp, Homo sapiens
  misc_feature (14)..(14): n is a, c, g, or t
  misc_feature (24)..(24): n is a, c, g, or t
aaccatggtccaancccaatcccntgtacatgaatgcctcataataacctaaaagtggaaacaactcatgtcccatcaactgacgaacaaaatggcaatataccccaaacaaggcaatccttactcagctataaaaaggaataaagtagtgatacatgatacaacatggatgaaccttaaaaatattatgcttgggtccagagtttcagtatgggaagatgaaaatagttctggaaatgtatgacgttgattattgaacaacaatgtgaatgtacttaatgtcaatggaatgtattcttaaaaatggttaaaatggggccaggcacagtgctcatgcctgtcatctcagcactttgggaggccaaggtggaaggatcgcttgagtccaggagtttgaggttgcagtgagctatgagagcaccagaacagtctagcctgggtgactttgag

SEQ ID NO: 670072 - DNA, 266 bp, Homo sapiens
caaatgtacttgcgatactggccctggagagaaagcgagaggagcgcagcagactgtgtgatatatgataattgccccaaatatttctgtcactaataacacgctactccgttgagcgacgagcaacattgtacagcacagctgccaaaatcccaagcacagccctctcagcacacaggccaaggccagggctcaggcagcttcccccaccattcctgcagcacacattatgcagtggcagcatggcactgtccagcccgttggaa

SEQ ID NO: 670073 - DNA, 974 bp, Homo sapiens
  misc_feature (974)..(974): n is a, c, g, or t
tcttcacctgaaatgcctctagtgaaaaaaaagaaaaaaaaaaaaaagggtgtcagccccctttgcgaggacctgtgttaaaaccgtgagaaccacgcgtgccgtgctaaacggacagagaagttcacccagccctcaggaagcaggtgtgttgggccactttggagttccctcaggtggggaaaagaaaattaagaagctcaccttcttagcccattgtgttcccgagtgcctctctgtggaaaccgaggtgtgtttgtggcccacttgtgagaagttctccctcgagtgtggggaaaagagaacaaatatagagaaagtctccacctctctatagcccgagtgtctcccaagtgcccctctgtggggggtgtgaaaacacctctcacccagagacaccctctctgagacacgcagggttgtgacgaggaagaggaaaccaccccgagacgagtgtgtgggcgcaagaagaagctctcctaaaaaaacacacccacccacgagagagagggcacacaacaaagagggggggcggcccccagaagagacaaccccccaaacagaacgcactttctctctcagagggctccagagagaaaccctcctttgtggggcatctcctgtgtgtgagaggcgccccgcaagggggagagagcccccagggggaaagttgtgtgagaggagagaaacacactgtgtgaccctccgagtgtggcggggagaaaacagaacaggcgaggagtactacgacggcggagaacacccaacgagcggacgacaccgccccctctttgtggggtggcggcacacagaggaacaaccacaccgggggaggaacaagcgccgctgaaggacaagaggagacgcccccccccgacgaagaaaaagaacacaacaccacaccaacaacagtggtggagggacagaaaaggcggggtgtttgaacacgacgacgtaagagcacacacacacan

SEQ ID NO: 670074 - DNA, 885 bp, Homo sapiens
aactattccatagggtcgcgtactaactccggtaagtgagcatgatcagaattggtagctatgatctgctgtatgagatcagtgggtggccttatgatcaatcagtgtaagcacggcatatatctgacagtacggatagacgctcaagaatggcgtgctgtatgtcatctctgtaccataatcagtgggtcactaccccgaacgtcgatcatcagatattaagctgagctcggacatccacggaagcaatatgaaatgatctgctgcagtgctctgagccctaggattcatctttctttttcaccgtaggttggcctgactggcattgtattagcaaactcatcactagacatcgtactacacgacacgcactacgttgtagctcacttccactatgtcctatcaattaggagcctgtatttgccatcataggaggcttcattcactgatttcccctattctcaggtacaccctagagcaaactagccaaaatccatttcactatcatattcatcgcgtaaatctaactttcttccaaaacatttttcggctatcggaatgcccgacgttactcgactacccggatgcatacaccacatgaaccattctatcatctgtaggctcattcatttctctaccagagtaatattaatacatttccatgatttgagaagcttcgcttcgaagaggaaagtcctataggtagaagaccctcataaactggtgactttgttgccccaacctaaacattgcaacggttataattacaaagggattacccaaaggtaagaaccaggtcatttcaacaaacaacacaaattgacgcccacatcttaaatattggcggaagagaacggatgtaagtgcaacggggaaaggttaagg

SEQ ID NO: 670075 - DNA, 409 bp, Homo sapiens
  misc_feature (13)..(13): n is a, c, g, or t
  misc_feature (20)..(20): n is a, c, g, or t
ttcgtctggttcngaggatncaagcttacgaggcaggttcactaggaaaactctataaatactttgagttcatttaactaaacttttgaattagtgaattatagactcaccttcagcccttaaactgtaacctttaacctttccatattctgcctggtcccagaggctcctggaaccacatgggtgaaaactgctttcataattgtaaatttctaagttggtttgatactgctaacacagaatcagatctagagaataccattagcttctaatatagagacatcaattcttgacttgtcaagaataaaaatctcatgagataataaagttgtactggtcttcagattttttttttttttgggtaatttctttcacttccctcgttaagctggggtacccgagctcgaat

SEQ ID NO: 670076 - DNA, 894 bp, Homo sapiens
gcgatgacgcaggcatgcgacgagagagtactgacgaccttcctcacggctcttatgtgagtccctcatgtcccataagcaagtggtcacccgtttcgtctccccggaaccctttgctctgaaatcgccctctccccgaattactggtcgggaatctcaactgaatgtaattcatggcccattaattttccaaggccgccccctatctaaattacgtattctccggaaacactattttttcggcacacaacaatagtccttacaagacaagtcaaaattacccccccattccttgctactgttcaaaagatggggatccgcacaccatttttgggaaataatcctgcaaaaattttaaaaacaaatctgttccccaacaaatggttatcgccccgcataattcctaccccggacatgtcccacatcttttgttccaaatatcctcggagcaaagaaatattatctaacatattaaaattttcgtcagacaccccccctcgttgtgcagaagagatatcaacccggaccaccacaattttctataaataatatagtcggcaccccatttgagaattctaaatgatttctacaacttaattctcgtcaattcaccacttaatgtgaattaacccactctatagttcttctcccttattaatatctggaggacaccctagctctgtgcattaaaaatacattctgccttaacacaccacgtgtagaataattcacaaatagtgagcagaagacacacagcgacccaccccacccccctgcgtagataaaaccccacaatgttggaaaccgtttgcgagactcttaactgtcacgctggaacacccaccccttggacccccctttcctccaccaacccttggggccaaaaaacaatac

SEQ ID NO: 670077 - DNA, 932 bp, Homo sapiens
ccatacgccccctcattatagtccgctttatacccatactccttaccacataattcccacttatgggcccgcaggttgtatactaccgtagggaccgccatattcctcaggggcactcacacacaccactaccgggctcccaaaaaggctctctttagtaatccgggagtatatcctctagtttttttgttcccctccccaagaagattttgtttctcttctcacacacaagagttttttttagcagccctttttgctcaccccatcccacgcgttgccgccctttccccccccctcatttggaggaggcgccactggggccccccccactcacgagtggctactaactcccgctctgtttatttcgctcctcggtgagagtgctcccaccctactctctctggaacagcacatagctcgctgtgttttatctctcgctcgctcgttcgaggagtgttcctctattcaccctcgggggggctgtccaccccactattgttgttatatagaggaacaccctcccgcgtgaccactcattgcattttcgagacccccgcgttttttgttcaccatgttttctggggggttgttttttggtacaccctccctgtcaaagctcatctcgggggttcttttggtgtgtcgtcctttcacaccattttctgcccggcgtattttccggcggctcagatcatgattattgtgataccccccacggcgttctccaccgggtcgtcctccggctcgcttgttgtgggtcgatacactgtctcctaaccttcatttgtcgtttctcattgccccccgccaaaattttctcccttaacacccaaaaaccctttgggtttgaaaaccccccccgattttggccttttttaaaattgggtttgtttttttttttaattttccattttttgtaggggggtttttta

SEQ ID NO: 670078 - DNA, 438 bp, Homo sapiens
acagatgaggcagagaaccctcttcaaagaagttgtatcaattgtatactaatcaacaacagtataggggaatattttatactttcaccaacacagatattaaccgttttttaatctttgccattctggtggacaaaactgtttcattgtttgcatgtattttgttagattacttgtaggtttcttagttattttgtttggttttctatgacttgcttgtttagcttttgctcagtttttccttggggtgtttgagaggggctgcttttacattcctttcttttgatttggtacaattaatcctgcctgtctctgaacaagaagtacactcaatgtatctggatgttttgactatgaaagtatgtctttaggttttacatcacattaattttttgtaggaacatataaaccttcggttctctgcagggtaccgagctc

SEQ ID NO: 670079 - DNA, 101 bp, Homo sapiens
agccacggccgcccccgaaaccacctccatagctggcagagtgagctctgctgtgctggtgggccctgtgctggtgctggtgtgcctgctggctggtgcgg

SEQ ID NO: 670080 - DNA, 114 bp, Homo sapiens
attcgagatgctctatagggcggtagtggtatgtatctaaagaagagataagcagatttatagaacagctacctccaatgtcagattatggtcttcggaataagaaatcatgga

SEQ ID NO: 670081 - DNA, 412 bp, Homo sapiens
  misc_feature (235)..(235): n is a, c, g, or t
  misc_feature (366)..(366): n is a, c, g, or t
taataagggaacctatttgattttaaaagtaatattgtaatgataccagaatagtacggcagcctcactttcccgaacttgagggagataaacataatttcccattaagaaaatccttgaggcccaagtattgtggcctcactccccgtaatcctcagcactttgggaagcccgaggtgggaggatcgcttgaggcccaggagtgcgacacccagtctgggcagccctagcaaanctccgtctctacaaaaaattaaaaaatgagccaggcacggtggcatgcgtctgtggtcccagctgctttggagactgaggctagaggatcgcttgagcccagaaggtcgaggttgtggtgagcaatggttngccactgcactccaaccttggtaacagagtgagccactttgtctcc

SEQ ID NO: 670082 - DNA, 771 bp, Homo sapiens
  misc_feature (180)..(181): n is a, c, g, or t
  misc_feature (439)..(439): n is a, c, g, or t
  misc_feature (475)..(475): n is a, c, g, or t
ttctacaaagtcagagcccccttcctacttatcttacaccatacacgggcagaacacctttcctcaactcgattaacccacccaactccaacctttatcccttcctgattctcaaataacactgacaccaactcccataacaacctcattctaaactttctctgtggaggggggctaccnnacccacacccccctatacccaccctgccataatttctttattgttgcggcttttttacactatcaaccgacctaactcacaaaactttgaataaccacactctcctttttccacatctttacatcccccacctaaaacaaaattcaaaagatccaccccctgcgatagatcgattccatcttgtcctctccaccgaatggctaccccctaactacccacttaaggtctttaacactttataccagtcccgtttaccanaagcggaaaatggccaatgaacacaaaacaatcaanaacccatttaaaacaccggaaccccccacccccattaaaaccccttactcccaccaatgcattcttattaccaaaatccccctaccctactctcgcgggaataacctacaagtactctagaccccttttcaaaattaatacccctcaacaaagcttcttatcaaaaaaaccctgtacatccaaatcaatataatcgacctattatcttaaaagcacaaatcccgttacatgctggactttctctcttcaaactccagccctatccatctttaacccttacttcttcacccctttta

SEQ ID NO: 670083 - DNA, 1204 bp, Homo sapiens
  misc_feature (342)..(342): n is a, c, g, or t
  misc_feature (503)..(503): n is a, c, g, or t
taatgattcggctctcactgttctaactccagcggtgcatgcgaccaagagcgtggcagattctgctcgtagatgcacctcgaggctagcgcacacgaataggagttcttaccacagcgcgtgaggtgacagcattcgcggtgattcaggccgtgtccatgcgggacatggtgattgcacctaaggcacttggcatgcagtcagcgtcgaatcgaacaatccaaggcgcatttcatgaaacgttgtcgtacgatgctatctcgactcatggaccagtgtcgtgatgttgttcggtcagtcttgatctatccaaaggggcgacttgtggatgcgtccgaatantgcggtctaagcggacaagggttgcctgtcggataatctatgtaatcgtggagaatatcataccagtagacctcatgtgaatcacacatgggatcagagtaaactcatgtaaccaagtcagtctcgcgtgagagagcatatcggaacgggatcacctgccntggtatagcgaccaagagctgtattcgagcgatctctaatttcgccgtgtgacctcagatcgcgaatgaactctgtagcagcgatttcagatgggaatgtaccgctggacagggaaggacaccggatctcctgccccatgtgtggctgtcgatagcggcaacggcggaacgctcttccgcacctataagcgagaaacttccgtttcgccccatttctgccaggacttctcttaagggggaagaaaaaattccttcgttggctttctgaatccttaggattttaaccttcaaacattacccaaggaatttggacttttggggccaccggcaacgcccaatttttcgtaaggttccccagagggaacaaagaatttgcggcggcacactttcctggagccgacttgggaggccatggcacgctgtggtctcatggggggactttagaattgggcaactttggattgtagacccattctttgcattgaggcaggttgggaagcattggcggcggaaacccaaagggctattcctaggtggcccatggttactttggttgtagagacatagaggcggacgttgcgcattccggggggacgagttacggtgactcccctttccctgcgcggagtgctcttgatgctccccacggcttccttccgagccaagccctttttcggacttaggccaaccccccctgttta

SEQ ID NO: 670084 - DNA, 1593 bp, Homo sapiens
gaagacaaatcctgtccacactcaatacttaggttacacctaagtcccgatacatctctatgcacacctattattacgctactcaaggcggaatgacgagactccacgggcatagggagcagctacgtgtactagataaccgactcggagaacgggattccacagtcgtgagcgctaggcggttgaaagtgcgcacatcgtatctaacctcccatcactatgcattccttgcgatcaattgcaagtagaccttgaggacaaatcccacgttgttgcagagagactagacccagacgggcttaagatctcggccgaagactcacaccgcatctgactctcaagcaagcagcctaagatgatgcagagctcggactgattgtgatgcgacccaactatccgtggggacaccagtgttgactacggtaacaatcaggcatcctagacactttccgaagttcatagccctagtcaaccttgggcatgatgctacaaaatcttgacgtcatgtcaatctgaagccttgtgtgccgatttgttccgcgcagttgcaattcgctgttgactactcccaccgcgtctcggttgcaaagtatcccacaccctttgctcttaggcctacaccgaataccccacggaaaagccattgaatgcctctttcgcaagaaaaacctaggcgttagaccctatgacccgtgtggttgcccccagggacttagtctgagagcagataccctttgttacaccaagccaacaatcattaatcaggcgacccttcatatgaaccgcaaacccccctatgcccaaggcgtacgcccttgaccaacccctgctatgcatgaagctaaccaccttcattcgccaggtggactttgccggcgggcccctttgcccaggcattgacttactttagacctaaagaaagagaatccttcctcctaggaaaccccccccacataattgttgaccccgacaccttttgtgcataccaaacgccttgactaaggccatagggcacaggctaactatgtggctagtgacgcctaatattacccgggtgcttgcacctaagaactttgccgcaaatgaacccccccttgcggcgccttctccagcttaggcctttcgatgttgcgcccaaattgcccctgtggaccttttccaaatgtggagggccttcactactagggtataacgcccaaacccaaaatcgaacccattccacacttggaccgtcgctcttgaagctggattccctgatagtatcgctctattcagccaagttgacccctggaaccgggaacttcccccctctgtttgcccttgcctttggaacagggctgtcttcacaggccttgtggacacaacgcttaggccgtctttgttggaccctttccactgacccaacctctgtccccgggcgactccctttgtgtgctcggccactttctttgggccctcctcagacgtggtcctccgtcttagcgtggacgccttggccccttgtgtggcatgccacacacaagtctgggtgcttcactctgttgcgcccttggccttggatcttgtcggccccagcgagcttggcttcacata

SEQ ID NO: 670085 - DNA, 708 bp, Homo sapiens
ctgctgctccgtggcccagagaccaggcctggccctcaattattataaggaggctggattatggagtgactgctctgcgcatctgcaaggactatgtgcccagccagctggaggctctgcaggaagaatatgagctgggaagctactaagaacgggggccatgggcgtgttggagggattcgtggacacaatgctcgcacactgcgcgagcacgtgctggatgatgtacatgcctgtgcctgtggacttgctacctcaaatgtgcgagactctgtgaaacagctggcctggcgtgagaatgtgcttggatgaaggcagctgaactctccatcaagtttctgcctccccaacgtaatatggaatgtcgttctggctgtaggaccccagctgatttggaatttggaaagcacatgtgcagctgcagagctctatctgaatctggaccttgtcaaggaatgcaatcgatgctttcatcgagggtgaggacgtggaacaaggcgaagctgtgtagctaaggagttagatcccaggtatgacgactatgtggaccaggcatcataaagagttcctcaagaatcagggcaacgtggactcgctggtgggtgtggctgttgatagctgcatgggacctgtatgtggagcagggccgtgggacatgtgcttggaacagctaacaagcagactaccagattctgcccagtatgtggc

SEQ ID NO: 670086 - DNA, 400 bp, Homo sapiens
cacccacatctggatctccccaggcaggatggtcagaaactgctccaacatgaggatctctaggatctgctccttggtgtgaactccggctgcagccattggaaacagagcttccgaagctgtctcagggtctcgtggggcccagacatcacctggtaacgaaactgcctgaagatctggcgtgcggcctcagggctggagagctcagcttcaggggcagcatctggtccagagaatggggagttctcagcctttgtcaaggatggaccagcccagggcctgccccaggtcaatgggcatcgtctggctttgcaggtcctttgaggtaaagagcttccaaggtggaattgtctctgtggagaaccaggtcttcacagggaagctcacgccgcggggccgg

SEQ ID NO: 670087 - DNA, 303 bp, Homo sapiens
tgacctcagggtcggcttaattattaggattttatgtttttaacaaaaacatttggctgggtgcagtggctcacacctgtaatcccagtactctgggaggccaaggcgggaggatcaattgaggccaggagtttgagaccagcctggccaacatggcaaaaccccatctctactaaaaatacaaaaacaggccgggcgcggtcgtcacgcctgtaaccccagcactgtgggaggccgaggcgggcggatcacaaggtcaggagatcgagaccatcctggctaacatggtgaaaccctgtctct

SEQ ID NO: 670088 - DNA, 811 bp, Homo sapiens
gcaagacttgtaaggagctctataattacaatatctgatatttttacagtctgatctttgacttctacatatagtggaaatctagccaatactaattggaggagatgggaactgtaaaagatcaagtatgctaatttataagcaaatagtaaaaactcataaaacagagtaaacagtaggggtagatatatcatttatgccataattcacataaagacgaatatataaatctaaaaagtcactttactatgctatagtattactagtaagtaggctataatatattatgttataattagagggccataatctacactactagtacactacaggcttggagtagcaggtaggtaataaatactacaaggctacactagcaatactactagcactaaccaggtatacaaagcagatatctacagtagacctacaagacctactacgaagtagctagggacatacacggcgtagagaccaagaaacgacccaagactaagataaaaggtcaataacaagacgtaagagaacaaacaagagactttaaccacagccctaatgagataccccagcaattaaaggagagagctagaagatagggaatgaacccaggcatagaagaccacaaggagaatattacaaggatccaagaacaggggggccaacaaataggatggaaaaccggtagatcatcaggaaaaaacaaaaaaaggctaggaaaggtaagcaccaagctaacccctagaaacgaaggcacacagccatagaaaggaagcaaaaaaaccacaggagagagaagcaaaatcaagaaggg

SEQ ID NO: 670089 - DNA, 372 bp, Homo sapiens
  misc_feature (141)..(142): n is a, c, g, or t
  misc_feature (147)..(148): n is a, c, g, or t
  misc_feature (151)..(151): n is a, c, g, or t
  misc_feature (154)..(154): n is a, c, g, or t
  misc_feature (160)..(160): n is a, c, g, or t
  misc_feature (172)..(172): n is a, c, g, or t
  misc_feature (176)..(176): n is a, c, g, or t
  misc_feature (179)..(179): n is a, c, g, or t
  misc_feature (186)..(186): n is a, c, g, or t
  misc_feature (188)..(188): n is a, c, g, or t
  misc_feature (191)..(191): n is a, c, g, or t
  misc_feature (193)..(193): n is a, c, g, or t
  misc_feature (195)..(195): n is a, c, g, or t
  misc_feature (201)..(201): n is a, c, g, or t
  misc_feature (203)..(203): n is a, c, g, or t
  misc_feature (208)..(208): n is a, c, g, or t
  misc_feature (213)..(214): n is a, c, g, or t
  misc_feature (221)..(222): n is a, c, g, or t
  misc_feature (225)..(225): n is a, c, g, or t
  misc_feature (238)..(238): n is a, c, g, or t
  misc_feature (241)..(241): n is a, c, g, or t
  misc_feature (248)..(248): n is a, c, g, or t
  misc_feature (255)..(255): n is a, c, g, or t
  misc_feature (257)..(257): n is a, c, g, or t
  misc_feature (260)..(260): n is a, c, g, or t
  misc_feature (262)..(262): n is a, c, g, or t
  misc_feature (265)..(265): n is a, c, g, or t
  misc_feature (273)..(273): n is a, c, g, or t
  misc_feature (276)..(276): n is a, c, g, or t
  misc_feature (281)..(281): n is a, c, g, or t
  misc_feature (303)..(303): n is a, c, g, or t
  misc_feature (307)..(307): n is a, c, g, or t
  misc_feature (317)..(317): n is a, c, g, or t
atttttaggtgggaaagatgatatgcagaatccactacaaggtgcaacagaaaatcgtattggaaaggacggtacatctggcgcagaccagcagtggcacgattccaaacaaatgtcagacgagagcgcttcatggggagnnactgnnaantanaatttnaagcttcatgangcanganatgttcnanttnanancactangnaatantaccnncgatgannaangaaatcaacctcnagntgtaccnaaagggncntangncanacgggganaantagcntttatggaggtacaaataggantctnctgtaagagnggggcagcaattacttaagacaaacctgcatatacatatcaacccgaatcaatgt

SEQ ID NO: 670090 - DNA, 112 bp, Homo sapiens
tattggacccgtttctgaccaaccactcaatcagtttcaatgatccagacctgtcagtcaccccactccagcctcacgcctcactcctcgtcatggcacccgtttctagacg

SEQ ID NO: 670091 - DNA, 526 bp, Homo sapiens
  misc_feature (336)..(336): n is a, c, g, or t
  misc_feature (353)..(353): n is a, c, g, or t
  misc_feature (355)..(356): n is a, c, g, or t
caaattagccaaatttgaccacttacctccctggacccagagattgggcttcttttgccgtttctcccagcccggcgccaagcctctttccttgaacagcccggcgggtggttggattcctgcctcaccttcatcaggggggtgtcaaggggggccccagactgtaattcctgttttctgcccgtgacccccccccgccccttatttcccttggcttagttttagagagaccactgtgacccctgccatcaatttgggggttgggaatttttggttaagccccccccccctttgttccccgggcccaacccttggggggaaaccgggggccccggngggggggcggtccccgnanngggggggatcttggggtggggagggaaggcccgcccttaaggttctttttatgcgctgctgtagataccgggatgaattttctgtacatgtttggttaattttttttgtacatgatttttgtatgtttccttttcaataaaatcagattggaacagtggaaaaaaaaaaa

SEQ ID NO: 670092 - DNA, 143 bp, Homo sapiens
ggggacaggcccaagatcctgatggacagtcccttgctcagggtccctttcctgcagtgaaacaccgactccttccgcagctccttggaaccggctcccggcccgagggcgatggtgtcctggtgctccaacggtgtttcgat

SEQ ID NO: 670093 - DNA, 459 bp, Homo sapiens
agacctggcggatagagccctgaggatctcccagcttgtgtgcgctgactctggcatcctacagacccggattatactcacactatgagagaggatggatcacagggtctaagggtggccattcagaggtagaagatggaggggcggcagattctggcagtggcagcagagggctcaatggacatggctagaggggtaaaaaattcaggacatcccccaggtgctgcctcagccagggctgcatgcggaagagattgatgtgaaagtctcgtggcggcgggaccttgctacgcaggggccctttagcgggagtttttgtcagcagagccaaagcaggggttgtaaagaccccagctcaccagacccacctgaaacaacctgaatctccgctcaaggaaaactgctcccccagatactcccttgcagggactctcatcctcctgggtcccactgcatagg

SEQ ID NO: 670094 - DNA, 137 bp, Homo sapiens
ggtagtgcaaggcctagccatggccattaagcaagatgaagcagttaatggctttctcatcataaagtaagaagtactgttgtgtctccacatgccatgaccgtatgtatagcaaaccatcctggctccacaaaaac

SEQ ID NO: 670095 - DNA, 257 bp, Homo sapiens
tatgttttttcccccccccccgggggggttggccccccccttggtgtgcgggggcccccccccttttttttccccccaaacccgggggggggggggccccccccgggggggggggggtttttttttgcgtttccatattttttgggggttcccccccccccccccgtggtggggtggggttttagagaccttttttttttcccctttgggggccccttttgggttttcccccttttaagcccccccttttttttgta

SEQ ID NO: 670096 - DNA, 150 bp, Homo sapiens
catttgttgagcggaccactcccctcacattccacaggcccatggactcactatctgtaacaaactcctaccaacacttaccaataaaaaaaaatgtgggtaaaaatttataataatattttttagaaaaaattttttttttttaattat

SEQ ID NO: 670097 - DNA, 707 bp, Homo sapiens
ccgggctgcaggaattggcacgagtttcttttcagctaatcctttcattatctcaccttgttaaagtgaaaatgtcattatagcttttttcaggtcagcgcccagatcctgctgctaaaacctcgtctaggtcctgatactttatgaatcagagacccatccgccaaagccatgttcaaagggcaggatcgagagtggcaagtatcactggtcacattcaagcgcctctttcagatgtgagtatcgctgtctataagcagaatatttgtccccgaaagatgtataagtaaatcatgtttaagagatcagtggccctattgtattgcataactatttcagagatgcctcgcgttttaatccacctgtaagatgtggtataggaggttaaccagtcgcccacgccccccagcacatatgggtggggggttctgcacgtttcactgtataattatttttataaacttaagggaaacttaaccaagaaaatgtgtgaaaggcgggctttgtgcccttggtttgcgtgggtctgtgaagtggattttcctagacggttggtttttggggaaaagagttaaggggcatggccattgaccaaggtgatggattaataccaggtgtgctttttcagagggaaatatttttggcatacccaaggggtaggggagaaagggttaaaaatatcctccatatcttggttattctttccg

SEQ ID NO: 670098 - DNA, 913 bp, Homo sapiens
gttttctattgcttaaactgaattaattttttttcatttatattttgctttaatatgacttgatttttttttctttctcgagtttataacatttaagtatttctggtggtttcagcataacctatacaggattagaaaaacagtggtctatcaaagtttttttttttttttgggttaaaagcttttcacttaaaggttaatatttttgccttatttagagaaaatcttgagaaaaaatacaaagagaaggtcttaaaaaagcagtattaacaaatttatttcccattcttaacttttatttatccctaattatgtggtggaatgggtctttccaggccaatggtgggctgggtccagagcccaacttcagggcggcaagtgggtttaccagggaatatctggggcctcaaattctatacggggtttccccccataagggcggtgacgccaggggacttttaatttaacccccgtgggattggctatacaactaaataatatctcctcggggtcagtcactgttacttctaaccctgttagtacgctgtatatggtacgccagaaacattttagaggtccgggtcgcgacgaggtgcttcacaactaatgcgtaatccccgaatctttacaatgtggggaaggctcaaccaattcctcttcctatcagggaaaggggacatggccagtgcgtttgggacctaagttcggggagaaggtccgccggccgttgtagtgtttctcccatgggaacgtaacagggatggtaggcatcatttggaaacctccggtggcccggaatgatacccaaagaagtgtctgggaaagcctcggccaagtacatgacccggagcgaaggaaagcaaggcacacgcgggatcaccggaacggttacgtaacaacgggtggaaactcc

SEQ ID NO: 670099 - DNA, 139 bp, Homo sapiens
cctgcctgtttgttgactcttagaggatcccccgctacaaggccccgcagaaaacgcctaactgtctgatgagagaccagtacatataaatgtaaaatgacatggatttaaatcaatatgtttaaaacaacacaaaatg

SEQ ID NO: 670100 - DNA, 215 bp, Homo sapiens
caagataaacacatacaaacacacacacacacacacaacacacacacacacacaggaacatcacagtcacattgctgaaactcaaagagagagagaaaatctaaactcataacagagttgcataacaggcaaacaatgacggacttcaaaagcagccacaataaagtactgacaaacatcaacaaataattgatggcaaggagcaaccacgggca

SEQ ID NO: 670101 - DNA, 141 bp, Homo sapiens
gagcatacactaggattcctgaagcagtttttcaaacaatcccattaggctagatgccaggcttctgcttcaggtggaaggaacctgtagatttttccacccttatagacgaagctcccttcagacacttggcatccagag

SEQ ID NO: 670102 - DNA, 150 bp, Homo sapiens
  misc_feature (12)..(12): n is a, c, g, or t
  misc_feature (106)..(106): n is a, c, g, or t
  misc_feature (111)..(111): n is a, c, g, or t
aaagattgctgnccaccgcacccagccgagttccctgctttcaatcgagatgaaggggacccagaatagcagaaatcaaggaactcggctgggtgcggtggctcangcctngtaatcccagcactttgggaggctgaggcgggcagatca

SEQ ID NO: 670103 - DNA, 126 bp, Homo sapiens
ttatgctgacaaggtaagcgattctcttgctcagcctcctgagtagctgggatacagggtggcagatgccggtaattttgtattgtagtggagacaggatttcaccatgttggtgcaggcatacct

SEQ ID NO: 670104 - DNA, 151 bp, Homo sapiens
agaaggagaaggagcggctggaggcggtttggagtgcgggtgtaacagcacacgagagcggctgctgtctgcgtcttgagggaccgttgagggttcctgtcatggggaatcgtatatgaaaaagttctggaaatatttaagaaatccaaaa

SEQ ID NO: 670105 - DNA, 484 bp, Homo sapiens
atcgctgtattagtcgggacgcaggcaggctttcttcctcctccgctgctcttcctgggcgtcccgcacagcaatccccaagagtaacagccctttgggagggggacatatcgtcttttatcgccaccttcccaaacagcagcagtggatcccagagtgggaggcccgttccccattctgggtgcttgagaagactgcattctcaggccctggtaggggagacttagcagcatggttggttgcctagtgtgggtccaccgaagctgatttgtgggatttgagagttggccaggttagccatttgagttctcatctccttgctcaggtggttgtgaagagctctctctctctctctcacacacacacacacacacacaggtacacacacacagacacactcacacactcaccctctctcaggagtagaactttgccaagatagcaaaggctaggtctgaagccctattctgcatatggctgggga

SEQ ID NO: 670106 - DNA, 118 bp, Homo sapiens
ccgtcaaaaatctctatgtgatgccagagagacctttcgtgaaatctctcctttttactgtgtttaaaaccccccagtgccacccatgaaatacgcaagctgcgtttcacgttcctga

SEQ ID NO: 670107 - DNA, 161 bp, Homo sapiens
gtaggaccactttggttttctttatttgcgtgtggcagttttaagttcattcagtttttaaaatcagtactttttcacatggcaaacaacttgcaccaacaaatttgtccacagcaattttgcagaccacattaacaaacagttacacatgcagcaacaac

SEQ ID NO: 670108 - DNA, 130 bp, Homo sapiens
agaaaaatgatgagcggtacctcatccctccttatgctcatccctccttccttggcctcccaaagtgctgggattacatggccttgcaaaaagttcttatctacagacacgtatagtgtaagcctcctct

SEQ ID NO: 670109 - DNA, 352 bp, Homo sapiens
ttcattcgccaatcttggtgaatgtttcactcttactgtaggatcttgtattatatctaacaattatgaagctacaaagtttttatgcagctgctttcattgtataactataattaacatttgtatttgaaagaaagctgggtcatacaaaaataggatagactcttaggagcccgcaatctgttgaggctcagtatatcttattcgctttgtagtctgctcgtcattcctttcaaagagcacactgcacataaggcatagtattcatctgtcttgttaacctctctaatttagaaatctgttgttcgtttcactggaccaattatcacatactatcatttgcctgattgaa

SEQ ID NO: 670110 - DNA, 171 bp, Homo sapiens
tatcgttaacatctgaaagggtcaggcagcatacttcagaaaaagcatcccgaggaggaagacgaatcgttaaacatacttaggtcagcttctagggtctcgcgaatctgtcttcttcagtggcaaccccgagaagactgatcagttgttcagttctaagacaatggccat

SEQ ID NO: 670111 - DNA, 106 bp, Homo sapiens
gtagcgcggacccagactacgccaaatcatttcactatcatattcatcggcgtaaatctaactttcttcccacaacactttctcggccagtccagaattgccccga

SEQ ID NO: 670112 - DNA, 689 bp, Homo sapiens
ggagactttttggctgcaagcgagccctgataagaaggcctacagttgctgggctctcagaagcctgtgcaggagggcaggcatctgtcagaacctccagtcatgtgctggcagtggtccggctgctgtaacagctggaagaggctgagggcatagaccctcagggtgccatggtcatctgtgagcagctaggggacctcttctccaaggcagggagactttcccatgggcagctgaggcttacctagaagcagctgctgttattgctgatctgcttgtgacagaccgtgtgctgagcgggccatcatccacgtgtccctggacagcacactgggagacatgaaggaccaccacatggggccgtgtcgccactattgaggaggaactgtaggctgcggcagctggcaactgtgctggatgaggccaagacctggctgaacttattgcactgtgcctgcgaggaggccggcgatgccttacgaggctgctggccccgtgcttccagaaagcgctcagctgtgcgtcagcaggcaccagggtcgccagcctgcagagagccaggtctttgggaagcatctaccatacctgtgcagctgaggctgcagccccagtgaatgcccctgtagacggaaactcagactgcgggagccttcagtgtagctgaagatgaagatgacggatggacgcag

SEQ ID NO: 670113 - DNA, 677 bp, Homo sapiens
  misc_feature (677)..(677): n is a, c, g, or t
tgcagttggtggggtctcaataaaagttattttccaccgcaaaaaaaaaaaaaaaaaaaaaaaaaaaaaatttttgggccccccggcccctcgaaaattctcttacacccaattccgttggggccccgcgggccccagagttggggtatagaggggcacagtgtgccaatcaccgtggctcccttaggaacacccgtgccaatgcacaactggcggggattccctaccccaaattaaaaacgcccgcggggaaaccagagcagttcttgtggaaaaaccccagaaagggaacgtgtgggaggcaactacagggggactcattacccacgcgcgacgtccagccgaacgcttccgaacactaaatatttatccccccccttctcgggtttataatgtatcatcaagtctctttcaatacaacattactaactacacatctcattccttcaatcatacttactgtactattcatacacaactaagtaaatcattacatatactcataaatctaatataaaaccatacaatacatattaacaactaatacaacaaacttatatacaactacatctaaaatatttatctctaaaccattaactcatactatataatcatacattatcatcactacatcattcataactatacatacacataatacacatatataacaaccn

SEQ ID NO: 670114 - DNA, 207 bp, Homo sapiens
gaggccttactgcttggtgtctgattgcccagctgagaatgccggtcagggcctctgcatcagcaggcggagccgtctgttaggagcgtccagagctgtatctggacactgccagccccgtggaagcacatgggcatcgagtcccacatgctcccaggcgccggttctctggttggcctggaattaaaggcttgatcgaagttgcca

SEQ ID NO: 670115 - DNA, 617 bp, Homo sapiens
  misc_feature (214)..(214): n is a, c, g, or t
  misc_feature (246)..(246): n is a, c, g, or t
  misc_feature (350)..(350): n is a, c, g, or t
  misc_feature (603)..(603): n is a, c, g, or t
  misc_feature (617)..(617): n is a, c, g, or t
cttatttttagcatctggtgttaatgtgacaatgaaagataacaaaataatgaacaatcaatatgccatataaaaggctgttaatataggccaatgtttatataaaatatcaagttataccagctatcccatgcatgatttctacagatgtcatacttgtaacaccacatatcgaaatgccatatgtgtgaactgcattaataagtgccatcanggacatgatgtagagtttattatacatgatangtttttctgagactgtggtgctagaacactgtctaatccttgtacattagctggtgagcctacacatgatacatatacactatataactctactccacctatanaatctaatacattacatcacaactgaattccttccctaaagaaaaagtcctgccattgtaacatcataacttaaaacactgttgtggaagaagattaaaatattttcccatgctacatgaagagactgtattaaaaatggatacacaaggtcaatttacacttataaactcaactaccaaaaagaaagtgcaatttattgactcaagatctcaaaactaggtgttttaacattacctgtataaatactttaanggacataattaaan

SEQ ID NO: 670116 - DNA, 183 bp, Homo sapiens
cacgaggccgacacaacccgcaagatttgttaaggaaatacagaaccaaacactgccggttgatttccttgcccacctggggtaagggttactgggtcccggcgattcagaatacacctacttttgcaaaggggggaacataattgataaacgacttcaagagcttggagcccggcatttcta

SEQ ID NO: 670117 - DNA, 412 bp, Homo sapiens
ctaatatgctcacattagccgtgagaagcttagcatctatagtagccaacctatcaatcgctaagacctccaactcgtacactaatgatgaaccatgcattggcggatgcaccgatattatcagtcagttccccacagcgattttcatgtgcctagaccaagatggcattatctactactggcactgagccacaacccttgccacccatatcatcgtaggctcctatgtagtctacttatgcgtagtactgatccctgtagcattgctcgatacacgggacatcatacaatgctcactgtgggctatatactgagacccataccttaataagggcctcagatatccactgatttgactgattaccatactaggctcacataccgcttacaatcgatttcctgcccttggccg

SEQ ID NO: 670118 - DNA, 204 bp, Homo sapiens
aatagaaagagcttctgaaaagggacacacatatataagagatggtgaaaggaatttgggatttagccatcccaggctacctttaggttgggtgaatatagccaggtttaggtagaggggtaactgtcacacaactcaccaaaagacctttttcacaaacctccacttgtaaaacgcaaaggcaccttcttagcacgctcgctc

SEQ ID NO: 670119 - DNA, 205 bp, Homo sapiens
aagggagataggagaaaaattaaaggaaaggacgaaaaggaagagggggggggaggtgaagaagaagaagaagatgaggagggtggagaagaagaaggaaggaaaggaatgaaccaaattgtcagagcttggttgaaaaaccctggtgttttgccccttgcttatcaggagtttttggtttgggaatggaacgtgggacatggac

SEQ ID NO: 670120 - DNA, 82 bp, Homo sapiens
atttccttactgcctcttgcttgggaacagcattgggcttttaaatgtctgcagaatctctgcgagtggaaggaaatttgcg

SEQ ID NO: 670121 - DNA, 848 bp, Homo sapiens
ctgaaagggggaccgtttcctagattgacttgtactcttgaaaccgcaattttatattgactgagggagtttgccacagtcttgataaggcaacccgcagcggaactatgtgttggcctagcaggttttaaacacaaggcacttgaaggagtttatttaaagagagcccataaatgagttgttactccttccgtatctgagtactggagagtgaacacctgaggaatgctttagtgtaaagtgggaagaacttttttgtaaatttgaagaacccacttggaaaagttttccaaagatccaaagttcagataaactaggaattggattattggtggttaaaatataacaaaaaaatttgattcaaccataaagtgttccaagactgctctgtcccctccacccatagtgaccaccataaccatgccttgagcaccagattaatagtggttccagtatattatcctttcaccacgttttacacgccaaatataatgcacgggtggatggagaccgggtaggtctgcaagcactcataatgctatttcataaactgggtgtgagctgggtgctggcttctcacgaggataaacaccttttgggagtgtcacatttttaacttaaatgttggatggacacccctttccaaccacaaaactaccactggagtctaattacccgcagtagatttgcaccaatgtttaagattaaacgtgagatcttcagaggaatatctgtttatggcagactgtttctggaccctagaatcacttggtttaccaattccctattttttcataagggatcattttccaaatcttttacccataaatggtgattgaaaggaccca

SEQ ID NO: 670122 - DNA, 448 bp, Homo sapiens
ctgggttatgcgtgagagctacgtacaacgaggcagaggaaggtcatgcaaagaactcatgaatagatggcactatgtgacttctagtaaaaatgatcccccacacagagagtgaggtagacaatgatataagatggtactagtggcatcaccctgaagtagatacctagtcccatttcagaaagatctactctgtattctaagagcaattggaaaccattcctgtgtttcaagtaggaatagtatacatgatcacattgacaatttgaaacatgtacactcaaactctaatgagagggctcagaatggatttaggcaatcctataaaaaatgaaattcagtcccatcaagcatatcctaaaggcaatcactgagactaagcagaagcatatatcttcaagggctccttccaagagagacactgagggcttcatgagcactaggccag

SEQ ID NO: 670123 - DNA, 381 bp, Homo sapiens
ctaggatcagtcgtaaaatgagtcgactggtgcagaacctgtaagcgtatatacataggagaggaaatatattaagccatgatcagctggtactagctttatatcaataattttatcagaaaagcaacctaaaagctaaggcagaggttgcccaaccccattcagggagctctgagtcttagcaaatatttcacgacacccccaggccaaaagaaataggtatgaacaactaacttagtagttatgtccttacaacttagtgtagagcactgtagaactcatcacaccttagaatcaaattggacaataccacactgtcatttcctgtactacatacattttcatgtagtagttgcttcatatcggagcaacctctgaaaa

SEQ ID NO: 670124 - DNA, 411 bp, Homo sapiens
ctgtcgaccaggtatggagtacagtggcgcgatctctgttcactgcaacttccccctccaggcttcaggcaactctgtctcagacctcccgaatagctggactgcaggtgcgagccaccacgcctttttgtatttttagtagagatggggttcaccattttggccaggctggtctcaaactcctgaattcaactgatctgcctggctcagcctcccaaagtgctgggattgcaggcataagccactgtgcccagcctaaaaaattctttataattttttattttacaagagacgggttacactgtgttgtccaggttggagtgcagtgcctttttacaggtgcaatcccactactagatcagcataggacagatgtatcatctgctctatatcgaaacctggtcgacagtc

SEQ ID NO: 670125 - DNA, 243 bp, Homo sapiens
agctccccctgtggttcttctgcggttcgtgtgtgctgtgtcgcgtgtgtgtgctgtgtgtgcctgtgtgtgctgtgtctttgtgtgtgtgctgtgtgctcgtgtgtgtgctgtgtgtgcatgtgtgtgcgtgtgctgtgcgtttgtgtgctgtgtgctcgtgtgtgctgtgtgtgcgtgtgtgctgtcgacaccctcatacacgacacccacggggtacccgcgctcgaacttcgtaactca

SEQ ID NO: 670126 - DNA, 122 bp, Homo sapiens
acggtcagctacttgggaggctgagtcaggaggattgcttgtggccatgatttgagtatagtgcattataattgtgcctgtaagtgatcactgcattctagcctcggcaacatagtgcggtc

SEQ ID NO: 670127 - DNA, 198 bp, Homo sapiens
ctagaggatcggcttatatgctgtctcatgtgtattaggcaaacaatttcagaaaaaaaatgagtcttgggatatgaatctctttttgatttaggatttgtagaaaattgacgaaagagaaaaatttgaaagacggtaactgtgaatctggatagtcataatttttccttatatccaagtacattcaatgaaggatgt

SEQ ID NO: 670128 - DNA, 308 bp, Homo sapiens
  misc_feature (6)..(6): n is a, c, g, or t
  misc_feature (32)..(33): n is a, c, g, or t
  misc_feature (45)..(45): n is a, c, g, or t
  misc_feature (136)..(136): n is a, c, g, or t
  misc_feature (176)..(176): n is a, c, g, or t
  misc_feature (255)..(255): n is a, c, g, or t
  misc_feature (260)..(260): n is a, c, g, or t
ccaggnagaagccagtggcagggacagagccnncagggagaaccntaacaagggtagtgtggaggggaaatttggggttggagttcccacacagcttcccctctggtgtactgcctagtggagtgtgagaagaaanccactgtcctccagattccaggatgatagatctgccaatnacagcttgcactgtacaactggaaaagccacaggcagtcaatgccagcccgtgaaagcagtgacagtggcttaccctgnaaagncccaggggctgagctgcccaaggccttggagcccaccccttcaccagt

SEQ ID NO: 670129 - DNA, 1004 bp, Homo sapiens
agacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttctttctctttaatcgggaatcgtgatggtgtgggattatttcaatgggtgggggttaatatagcatgttatccgtggtcatatcttttaaagaatttcgggtataagaactgtttgagccgagttttataaaattaggtgtaggataactattaacaaagcgagatagagtggcgctagtgttggattcctacaagcgaaatttattcaccagctttttttccattcttaactcttttaagggattcaaacgcaactcaaattctggtgctggactttaaaaaaacaattcaggaccaaattttttcctcagggtgtgtgtttattcctttataggtgtaattgagaagacgtgtttttttccttcaccgatgctccatcctcgtatttcttttccctggtaaatgtaatcagatgccatttcatttgtggacgtatttatagtgggcaaacatattttcctttggtcccttttttctttccttcttttaacttcctttattccttattccttccttttccttttttcttttaaaacatataaatgggggaagtggtggtgtacccagccaatttaagggtcccctacagggaggggcgaagttcaaccttaacttgcactattaaaggtgaactgggaacctttaaaacacacaggacgcggagtcaacgctgggaaaatacccacagtcttgtgtacaccattcacaggcgggggataacgttaaaacagcgagtgataccataatacacggcggggacatacaccgcgagaaaaaccccatactcatactacacatggataatggaaagtatcacgagctacgcccgccatctaacagatgacacactctacaacatctatactcac

SEQ ID NO: 670130 - DNA, 305 bp, Homo sapiens
acaccggacatatctattacactagagcgtatagtgtaccacgcagtactatattctgaagtagagatacgcttttcccgatcagtcaaatgttacctctctcctactcctctgatataacagtattgaatgaatgttcggctacaaaatcaatacttggttgttagatatgaatctcaatatcacaccttatggaaaggttctgctagaaaagccaatactaccagagcttgaaatatggattcaaaaatgtctcttgtctctctggatttctcactcagagctcatagttagcgcgtgcatgt

SEQ ID NO: 670131 - DNA, 449 bp, Homo sapiens
tgcacgatatggtagtgctataggagctagaagtgtatctgggagcaagtagagtagtttgagaggaataggcatcgaataacgagaagactctgtgaaattatatattctgcagtgggataattatgttacctaaccagaatagtaatgacacatgcatttaaagctgataaaaatgacagtcgtgtcaaaaggaaatgacagcccaacttgtcatttccaaatgtttgtctatgccaaacgtgcttaggcatagaactttatatgctctttacaatgactttaataaaaataatacgctaatcaatgcaatcaaactttgaaggtaataacaatatcaattatctatttcgtcccctcgatactccttggctagttttgcatttctgctaacatcattggtcctggatgattctgaaacttcagcctacaataccataaagtcttta

SEQ ID NO: 670132 - DNA, 807 bp, Homo sapiens
cattccttaagtcctaattgggaaaaaaaaaaaaaaaaattgaattatttgaaaacctctggggtgtaaccaattgattgtaccccctaaacattattcaattaagcgtagtaaaagggacgctttcacacagattttcaggtctaattctggccctttctgggggcgccataattataaacattaattgtgtgtcccttggataaaaaaggtcattttccttcaaaagagactacagcgctagctgccctttggtgtaagacgcacgtttctaaattggtaggacttggtgtgcgaacttgtaatatcctatttattggaaaacgtgttttcacaattattaatttctaaatccatacgaacatccagggttgggagctggtatggatattggtccgatccatgaattggtcccacctcttattctaagtgggccaattatttggggaattaaagaggggaaataaagatggcggttcccttgggaattttaagtccttccagcgctgggagattttactgggttcatacaccctttggcctgaattaaaggttttccatggtaggagggactttatatccctttctggattacgaccacgttccatattatcttgaacctcaatatctcagaatctcttctacggtgatactgaatagacatacttacttagacaatgttccgccattcactaaaatatttgtcctattatcttacctttattcaagcttgcctggataacggagagggcgtccgatgctgaatttattcctgaccattgaacaccgttgactccggggagtcca

SEQ ID NO: 670133 - DNA, 662 bp, Homo sapiens
  misc_feature (650)..(650): n is a, c, g, or t
gggttgctgtaagcgattctaggatattgagagatgtgtaacatgtcctggatacgcatgaaacactctggatgcttgcatgatgtgactcgaggtccagatgtgctactaaggcagttcctgcgctatgtacggcccaaatcggtcctgtcaagatgctgtgcaggcatcaaggaaaagccagggacaatatagaagataaagtgatcgtgtcgctggcagtatacctggactctcctgagatcatgcattgtacacctagttaggcgaagaggactggagcagtacacatgcgacatggatatgactgagtagggagggtggtgtactcagattactgcttggatcagaatcctattatagatgtttactaccggagagagaatgtatttgctgacaaccattaaagtcagaagttttacgtccaggattatagcaataaagtataatgttttattaaactgcttcatctgtatgtcaaagcttggactctataagcaaatgcattgtttccgaaaacaaaaagatgtctcaggtctgtaagtgaatggctagggagctttcagtgtcccagaacttagcctttaccgtgtgaagtgtggctacaggcttaatatttccgtagtagatctatatcagatcacatagtngcataccgggat

SEQ ID NO: 670134 - DNA, 163 bp, Homo sapiens
  misc_feature (48)..(48): n is a, c, g, or t
  misc_feature (73)..(73): n is a, c, g, or t
  misc_feature (79)..(79): n is a, c, g, or t
  misc_feature (143)..(143): n is a, c, g, or t
cacatgcccgtgtgtgccgcgtcagtcatgccgaagcacgagttctcngtggacatgacctgtgagggctgtnctgaancgtctccagagtcctcaacaagctgggaggagtggagttcaacattgacctgcccaacaagaangtctgcatcgactctgagca

SEQ ID NO: 670135 - DNA, 94 bp, Homo sapiens
gagagagagagaacatgagttctgccggctctggtctgccattcgccagtgcagggatctggcacggaccagatgtggcgaatggcagcacagc

SEQ ID NO: 670136 - DNA, 382 bp, Homo sapiens
  misc_feature (4)..(4): n is a, c, g, or t
  misc_feature (27)..(27): n is a, c, g, or t
  misc_feature (31)..(31): n is a, c, g, or t
ggtnaattgaataattttctgaatttntatnaattatttattatcatactcatacttgtcaggcctttgggcccaagcttgcatgtatacatcaagatggcctgaaataactgaagaatcacaaaagaagtgaaaatggccagttcctgccttaactggtgacattaccttgtgaaattccttctcctggctcagaagctcccccgctgagcaccttgtgacccccgtccctgcccaccagagaacaaccccctttgactgtaattgtccactacccacccaaatcctataaaacagccccacccctgtctcccttcactgactcctttttcagactcagcctgcctgcacccaggtgaaataaacagccttgttgctcaaa

SEQ ID NO: 670137 - DNA, 236 bp, Homo sapiens
ggtggcatcggtgattcaaggctgttttttccacctttttcagtgcctcatactgtgatacaaaccaaaaccagattcaggaggtacatgtgcaggtatgatgactgggtatactccatgatgctgaggtttgcagtaccaatgatcctgtcacctacgtactgattatagtccccagtagtttttcaacacttgctctcctctctccctcccccaccagtagtccccagtttata

SEQ ID NO: 670138 - DNA, 942 bp, Homo sapiens
agcgggggggggcggaaacccaggtggtcgggacaggctgttgcaggagcgcgcgctcagcgaatcgagtgaggcatctcacatggcgcaaaagtccgaatgctgtagtgagcggacggcgcgcgaggcggcgagttccgaagagacgctcacgcgagggcgaggccgagggctcgtacggctgaagggcctcgagccttgaatgatgctgcgggggacagtggaactggagcgattccgtcccagaccccgatgtcgtcggagtccaatgtgtccctcggtccaaggcagattgaggcgcacgcggcgggcgcccagctcgggcgccgcacggcggtgcggttactcggacagtgagtgctccagactcccaggacgctgggaaacgttcgcagcgccagggcagggatggctgggaagaacctgtgggccccgaaaggcgggaatcagcggaggagcctcggggccatagacgaggagaccttcacggcgacttgtccgatgggcagccttagaggtcccggcgagaagtgcccggagggaaagacttggcggcgagctgcgcagcgccaggagaccggctgacccgccgcggtgcgcgcgactggaaaggcggctacacagtcatgcgcacgtacacgtgccagggggcgcggggcgaccggtgcctggggccggctgtgtactcgcgctgtgggaaagcccctcccgggaagagacacaaaggcctctcggataccggctcggccatgcgcaacgcgtgtccaacgtggcgaacgccccggggggcgccaagtccgggatgcatggttagtcggtaggtaggacccgtgacagaggttaacgacggggaaagggtcgtggtccggcacctgcggttacggggcccgaaggcgaaagtctgtatggaaggtgcacaccacggtgtcgagtggaagggga

SEQ ID NO: 670139 - DNA, 241 bp, Homo sapiens
  misc_feature (15)..(15): n is a, c, g, or t
  misc_feature (22)..(24): n is a, c, g, or t
  misc_feature (154)..(154): n is a, c, g, or t
  misc_feature (209)..(209): n is a, c, g, or t
  misc_feature (220)..(220): n is a, c, g, or t
tgtgactatcaaccnccgacgnnngcaggtgacccaggcgaagctcaagttcaggccgaagtcggacctaactaaaaaggcgattcgagagacaacgactcaaattccccaactggtgattccccgactttcgacgacaacccggctcgtactncagaaaacgcggcaccaaatatccccgaaaacccttcacagcgaccagcacccgngacagcacctnccctaccggatcgcgcaccag

SEQ ID NO: 670140 - DNA, 655 bp, Homo sapiens
ctcgagcttttctctcttccccctttatattcacgctgctgggcaatcacttcttctcctttgacatggccttgttgccactgtcctcctttgccttccttccttcttctacaggcttgaggttcaacagtggagtcacttcagccttgccataaccagcaaaggtgattgcagcggtgccaccttcttcatctatctcctcaatctccgcttcataacactgtccatcttcactccagactgccatacacttgtctcctactttccatgaatgagtagcttgagtagaagctgcgttagttctataacttctctgaaatccttcttcaattttagcaaatcttcactttctccatttccagataatgcagcttcaacttgctggagctgagctttgtagcttggcagctgccttgctaaatcctttgacaccttgtgtggcgctgctgtccgcccggcgctaaggcgccgcgcccaactgacccagcgcatcggtgtccccactacctctctacgcagagcgtgaaactacccggtcatcaggaacgccaccctcgcctgaaaggtatcacctcctcccctgctcatcggcacccgttcctctcttcacatctcccacctatctcgctttcacctgtccatctccctcctcccg

SEQ ID NO: 670141 - DNA, 573 bp, Homo sapiens
tgcggtggctcatgcctgtaatcccagcactctgggaggccgaggtgggcagatcacctgaggtcaggagttcaagaccaccctgggcaacatggcaagaactccgtctccatcaagaaaatacaaaacttagtccgcgtgtggtggcaggcacctgtaatcccagctactcgggaggctgcggcaggagaatcgcttgaacctgggaggcagaggttgcatgtgagccaagatcgcaccactgcactccagcctggcgtgacgaagcaagactccaatctcacaataggaaacatacacaatgttcttgaaccagttggggatagactatgaattttagaaaattggtttaaaggatacattcctaagggaattatagcagttacattctaaatggggaggctatggatgctttgatttcttccggactataattttctacatggttctaaggataaaccggtatggtgtgttaaactttaccaaatttattttttaagaaatgttttttacaacctagaaaacagataaaaaggtaatatattcttaaaagattttctagaaagtggtaat

SEQ ID NO: 670142 - DNA, 720 bp, Homo sapiens
agcggattgtcctgtggcagcaaccgggttgagaggagcgtggtgtctcctctctccgccatggcgtgtgctcgccaactgatatcggatgtactccgcaaaagggggagtcatctggcagaaatgtcacttttgcctgcatgtagtcacaggctcctattcgaccagatattgtgaagcttgtcaacgcgcaattgcgcaaaaatgatcaaacagcccgtatgctgatcagctggaattaccaggatcagtcaccactagtgacctgagtcttggtgagtactggcagatgcgtgtggagctccaattcccagagttcgagggtggtgggactcacctgcatctgcgccagggtgctcttctggaaacatgtgtctctggaagcccgaaatgttggcaaccaagccaataagctggcagccgattgtcacttcgaaagaggtgaaaccagcagactccaaataatacacgataacgaccctttcttgttttcctagctcgcttggggcacggtcattcaagttgcgcgtatcacatcccaggtggggtcgaatagtcctaaaatgcgctcactcggcaagtttgaagaagaaaggttatcccttggagaaagtttccctctttgggaataatggaagaaaggacttcacacctatgacaagaccgttacaatgaagagatccaagtggacagcagcttgtgaggctaccgtaaagtaaa

SEQ ID NO: 670143 - DNA, 1299 bp, Homo sapiens
  misc_feature (382)..(382): n is a, c, g, or t
cctggagtccactgcggatttgtcgaagctggtgcgctggtaagaggcctgctgcgacaccactgctccagtccgatcagtccacttctcgtagtctgaatgagctgctgagtgcggcaggtgagctgagccagggtcccagccatggccgcgagagttattcgcaggatactcagttacccaggtaggagaatcactgttcaaacgtttaaagagccaggcgtcgccatgtgccagggcttacctggaatcggacgtgagtcgatgacctcgtggttgggagtggttagtggtggctctatgtgccttcgctggctctccgttctaccctcaatttttctagcaaattggaggtgcctgggcaattcgcaatggactggcnatagcttccatatggcgtagaagagtggcatcgtccgcgtatgtcggtgtcatccgcgaacgagcaatgccaaccagttgtaggacttaccaggggagcagatcgcatacgcgcatagcgcgtggtagcaacaattccattggagacgccctttaacgcggactattcccaaacgcctatttcgttctgggatcccatatactaaagggcgagatctcgatctttaccgggacttgctagaaaacccttgccgagtagggcaatcagatgagacgtatttgtgacccaaaatggaggtgttacgacatacttagacgtgaagtttccccaggtggatgtaacgagctggaaggggaatgggtggccacgtggttggaaacggaaaggggacgaacttgagggggtactttgcacgttaaacaaagtatcttggagaagttgggaagcggttcactggaaaaattccattttcaaatcgaagggttacatagaaatcttattcggaactccggacagaacgcaactgttgggggcgctcaacgcaaatcatgtgacgctcccaaatgcgttggcccccaaattgtcgcccgaagtctcggagcaatgggtttcgcaattttcccaattgtgggggcggataaagcgataaaggttacaccacgcacccaattttttgggtatgtcccccaaaacaaacaagtgctgcgggggcacagggagggttaatttattcaataccaccgagtcacattaatggacgaatcaacaaaggagcgcccttactaaactatcgcggcatacaacaaaacaagtgtgtgcaccgcagaatcgacgacagatgctcttggtctcatacagagtgatattggcccccatcgtgtaagtagtagacgccacgtcactataaatatatcaca

SEQ ID NO: 670144 - DNA, 928 bp, Homo sapiens
ggccaggttatgctcgcaggagtggagaagcggaggcgcgaggaggagggggaatatagacgagaggtggaggatcctggctaccactctgaatccgataccgctgtcttcttcagacacctcagcggacagaaaaaggggaacggtgtgtctcaatccccctttccatcctctccatccactgtacctagagccattcagcaccattggtcgcagtgccagggcgcgtgggcctgagcaggagaaccgacaactcggagacgaagctgtgttacccgttcggaggagaccaggagccctcggaaggcaacctgtgcagcacatatataccaatcaacatcgcattgctgtgcaacacacaggcatacgcccgagcacgaaacaaacaaggtcacgtaattggggacgcaaagtagaactaagcttgatgagcacctacattgcaaccacaaatggggagcacgggcacagacatcatatctcgcaacattgcctagcttagttaatttatcagttgaaggcacagacacatctgggagacccattttgggctgccagcaggcatccacacagtgcacaagatcgcatcggcaagcgccagtgcacaggcacaggcgagagtgctgggagtagagaagacaacatcagcagcgaaagcagatggatgaggtgcagcatggggagccgacaccgcggcaacacgacgggcaacgcgcggcgcgagttcagataggccaaatgcaccgggttaaggaggaacactccggaaaggaggcaacacatatgacaagtgagcagcagaggcagcaagatcaccgccacacaacactgtagaggcgatgagggcagcacacatgccagccacgcggacatccacggaaagagagagacacgcaacacatggcgcacgcgagccacacacctgcac

SEQ ID NO: 670145 - DNA, 431 bp, Homo sapiens
tgaaaaaaaaaaaaaaaaaaaataataaaaaaaaaaaaaatttaaaaaaaaaaaaaaaaaaaaaaaaaaaaaaaaaaaaaaaaaaaaaaaaaatttaaaaaaaaaaaaaaaaaaaaaaaaaaaaaccttgtggcccccttggccccatccgcttttggcttgggccaggtttttcctgggggcccaatttggggttccttgggccatttccccttttggggggccgtttcccattacatggcccggggtttaccaccttgggactgggaaaaccctggggttccccaatttaaatcccttggaagaaaatccccttttccccggtgggggtaattccaaagggccccgacccgttggcctttccaaaaattggcccacccggatgggcaatgggaatttggaggcttaatttttggtttcgggtttttggt

SEQ ID NO: 670146 - DNA, 261 bp, Homo sapiens
  misc_feature (66)..(66): n is a, c, g, or t
  misc_feature (74)..(74): n is a, c, g, or t
  misc_feature (85)..(85): n is a, c, g, or t
aaagaagagggaactcagaggaccagactgcgccctcctccttgggctgtcctgtccgtatacctngtcaccangctggggaacntgctcatcatcctggctgtcacctctgactcccacctccacacccccatgtacttcttcctctccatcctgtccttggctgacatgggcttcacctccaccactgtccccaggatgattgtgaacatccagactcacagcagaatcatctcctatgctggctgcctgacacagatg

SEQ ID NO: 670147 - DNA, 843 bp, Homo sapiens
agcgtctggtccgcgcagtcagggcatcctccgcatcctccacatccttccatggctctgaagaataaattcagttgtttatggatcttgggtctgtgtttggtagccactacatcttccaaaatcccatccatcactgacccacactttatagacaactgcatagaagcccacaacgaatggcgtggcaaagtcaaccctcccgcggccgacatgaaatacatgatttgggataaaggtttagcaaagatggctaaagcatgggcaaaccagtgcaaatttgaacataatgactgtttggataaatcatataaatgctatgcagcttttgaatatgttggagaaaatatctggttaggtggaataaagtcattcacaccaagacatgccattacggcttggtataatgaaacccaattttatgattttgatagtctatcatgctccagagtctgtggccattatacacagttagtttgggccaattcattttatgtcggttgtgcagttgcaatgtgtcctaaccttgggggagcttcaactgcaatatttgtatgcaactacggacctgcaggaaattttgcaaatatgcctccttacgtaagaggagaatcttgctctctctgctcaaaagaagagaaatgtgtaaagaacctctgcaggactccacaacttattatacctaaccaaaatccatttctgaagccaacggggagagcacctcagcagacagcctttaatccattcagcttaggttttcttcttctgagaatcttttaatgtcatttatatacaaaagaaattctcaaatgttaaaataaaggaatagtttattgcttaata

SEQ ID NO: 670148 - DNA, 964 bp, Homo sapiens
agcgtctggtccgcgcagtcagggcatcctccgcatcctccacatccttccatggctctgaagaataaattcagttgtttatggatcttgggtctgtgtttggtagccactacatcttccaaaatcccatccatcactgacccacactttatagacaactgcatagaagcccacaacgaatggcgtggcaaagtcaaccctcccgcggccgacatgaaatacatgatttgggataaaggtttagcaaagatggctaaagcatgggcaaaccagtgcaaatttgaacataatgactgtttggataaatcatataaatgctatgcagcttttgaatatgttggagaaaatatctggttaggtggaataaagtcattcacaccaagacatgccattacggcttggtataatgaaacccaattttatgattttgatagtctatcatgctccagagtctgtggccattatacacagttagtttgggccaattcattttatgtcggttgtgcagttgcaatgtgtcctaaccttgggggagcttcaactgcaatatttgtatgcaactacggacctgcaggaaattttgcaaatatgcctccttacgtaagaggagaatcttgctctctctgctcaaaagaagagaaatgtgtaaagaacctctgcaaaaatccatttctgaagccaacggggagagcacctcagcagacagcctttaatccattcagcttaggttttcttcttctgagaatcttttaatgtcatttatatacaaaagaaattctcaaatgttaaaataaaggaatagtttattgcttaatataaattatcatcactttgcttctttactgaatcttctacactcttgcctgatacctaaatttaatgtttgtttttaactcaaaaaatgtactgtagtatggaaaatggatagcagtagaataaagtcttaagattattttttaattac

SEQ ID NO: 670149 - DNA, 484 bp, Homo sapiens
cagctctatatgcatttcttgaatgagtcttttaaaactaattttgttgagggttccctgtagggccactgcatgtcaaaaggggttaaccacccagacattcccactcagtccccagtcacccaaggggcagcttgcagcttgcagtaacaaaatgtcctttctcttcagagctgaggagaaaatccatttctgaagccaacggggagagcacctcagcagacagcctttaatccattcagcttaggttttcttcttctgagaatcttttaatgtcatttatatacaaaagaaattctcaaatgttaaaataaaggaatagtttattgcttaatataaattatcatcactttgcttctttactgaatcttctacactcttgcctgatacctaaatttaatgtttgtttttaactcaaaaaatgtactgtagtatggaaaatggatagcagtagaataaagtcttaagattattttttaattac

SEQ ID NO: 670150 - DNA, 829 bp, Homo sapiens
  misc_feature (656)..(656): n is a, c, g, or t
tgaaaacaaagtctttgctctatcacccaaacgggaccacaggggcttacttcagggctcattgcagcctcaacctcccaggctcaagcaatcctcccacctcagcctccctagttggcgtggctaattttggatattttttggtagagacggggttttcctccatgtgttgcccaggctggctcttgaacctcctgtgggcctcaagtgattctgcccacctcggcctcacaaagtgtgggagagttacagggggtgacgccaccagtgttcagccttaaactctgtgtgggtttttttattttttttttgtatttatttttgagagggagccacgctcccactctctgttgtgcccccccccggtgtgtgtgagagcgcctccggcggtggccaccaccattgtgtgtggcccccacacgtgggcacacaccctctggtgcgctccccccaggggtctacaagaagggtagacctcctccggcgcctcgcaacgcgccccccaatgtgtatacgctcgtggcgacaaacagacgggtgccgctgtgttccacacaacccaacccccccgagataaataaatcttggtggattgtcttaagacataaagaaaagaggggcgtgattagtcgcgccctattgtgtgtagacacccnggggggtggtagtactcctatagctagtgtgttatcaaaacactctctccactatttgttgtacacaacctgtgtgttccaataaactgcgcggttgttttataaacacacatgtgtaacaacacaaacacatagcaaggaaaaaacgccaaccaaaaaagaaacgccgcgaa

SEQ ID NO: 670151 - DNA, 991 bp, Homo sapiens
agcgtctggtccgcgcagtcagggcatcctccgcatcctccacatccttccatggctctgaagaataaattcagttgtttatggatcttgggtctgtgtttggtagccactacatcttccaaaatcccatccatcactgacccacactttatagacaactgcatagaagcccacaacgaatggcgtggcaaagtcaaccctcccgcggccgacatgaaatacatgatttgggataaaggtttagcaaagatggctaaagcatgggcaaaccagtgcaaatttgaacataatgactgtttggataaatcatataaatgctatgcagcttttgaatatgttggagaaaatatctggttaggtggaataaagtcattcacaccaagacatgccattacggcttggtataatgaaacccaattttatgattttgatagtctatcatgctccagagtctgtggccattatacacagttagtttgggccaattcattttatgtcggttgtgcagttgcaatgtgtcctaaccttgggggagcttcaactgcaatatttgtatgcaactacggacctgcaggaaattttgcaaatatgcctccttacgtaagaggagaatcttgctctctctgctcaaaagaagagaaatgtgtaaagaacctctgcaggactccacaacttattatacctaaccaaaatccatttctgaagccaacggggagagcacctcagcagacagcctttaatccattcagcttaggttttcttcttctgagaatcttttaatgtcatttatatacaaaagaaattctcaaatgttaaaataaaggaatagtttattgcttaatataaattatcatcactttgcttctttactgaatcttctacactcttgcctgatacctaaatttaatgtttgtttttaactcaaaaaatgtactgtagtatggaaaatggatagcagtagaataaagtcttaagattattttttaattac

SEQ ID NO: 670152 - DNA, 206 bp, Homo sapiens
ttccctcccccccccggcccccttttttgggaagggttttaggggggttgttagggggaccccccccaaccttttgggttaaaaaggaccccccttttttgggggttttttggggcccattgggaaaaaaaaaaaccaaaagggcccctgtttttatattgaaaatttccaagggttttttttaaaaaaagaacccgtccccccca

SEQ ID NO: 670153 - DNA, 905 bp, Homo sapiens
cgaaaagctgcagagaggattcggcccaaactcagacactggttcccctgagtgagaagcggtggcctctttgcagatcaaccaacttaatctggttgaacgtgctgttcctaatctggcgactcagacccctctgggaaacatcttttaattagcatctcagaaatgcatgggataaggtaaagtgcgatagattcaagtggaaagcaagagaatgaccagtgaccttgcttccattcccccattgagcttctatcatccgcccttccccatgtgcatccacttttcatctcctcatctccttttctagcctgttctttacatggggctcccttcttgattagaacaatagcgtgcgagaatcaggagctcaccttagcaggaccagcatctttggagccatcgggataaacactgacagtgagagttgaacaagtgaacaagccctagaaacttgaaataggtgcctgttcttgtcacggacgaatatgagaaatcgcatttggatccaggacccatgtgggcaccatcagcacgtcttgctatccatgcacctcagtaagaaagtggcatctgccttgggaccctgctccaagtgaggaagcatcgtcgttgccagattcatgctatctgcaactgagttcagatgcgggaagcaatagagagtccgcattcccgtttgactgctcatgagctggcacgggaaacgagaggcgtcacgtgcacacaaaccacgcacagaccaatgagccaaaaccgaggtcaaagacgcctgaagaacggcaaagaccggaggccgaggtgcgaagagaaccaaggtcggccgtgagcggcgagccaggaggagacccggcgagacacgagccaagccatacgcggaagagcgccggggtgggcagccccac

SEQ ID NO: 670154 - DNA, 196 bp, Homo sapiens
tttttttttctcacgtctctctgattatctaaatcaaacttattcgtgccgcatcggtatttattgtttatatatgctcttaatacttcttaatttttgatattcggaaagtgacagagtttggggcacatccgtcaaggcattgattctgagaacatctggattttttgaggtagtcctgtggattcctagcacg

SEQ ID NO: 670155 - DNA, 357 bp, Homo sapiens
  misc_feature (266)..(266): n is a, c, g, or t
ctctgagtttccccgcgcggcgcgcacgggaaaccaatgacaggttcctctggttgcgactggtgttgtgggctgagcgcgacaccccctaccccatgagtacgccgcgttataaaggaacttggtaaggttgactaaggtcttcccacactgaccttaatgctgaggattcggggtgtgggctcgccggtgggccaggacgagggcctctgtgcccgaaggctcaggccacagtctacacacaggatgtgtgactcgctgctatngtctccaaggtgctgttccagactggaagggcttgggcatacacgactgcaccgggtgcacttaaagacgccctcccttgccgcaccgccc

SEQ ID NO: 670156 - DNA, 747 bp, Homo sapiens
  misc_feature (20)..(20): n is a, c, g, or t
  misc_feature (95)..(95): n is a, c, g, or t
  misc_feature (113)..(113): n is a, c, g, or t
  misc_feature (211)..(211): n is a, c, g, or t
  misc_feature (240)..(240): n is a, c, g, or t
  misc_feature (323)..(323): n is a, c, g, or t
  misc_feature (344)..(344): n is a, c, g, or t
  misc_feature (426)..(426): n is a, c, g, or t
  misc_feature (483)..(483): n is a, c, g, or t
  misc_feature (555)..(555): n is a, c, g, or t
  misc_feature (558)..(558): n is a, c, g, or t
gaagtttgatgttgtgtcgnatgaccagaaatatgctgtgaacttaattctttcttatagcagttagcctatgggaaaattggttttgttctacnttattttatttaaagtcntaatttccagatcctatcaactccattaagtgaggacttactgtactgtaccctgaggctcatcttagtcttccctcatcccccctgcctttccttcnagtcagcctgcatggtggtctgaggcctncccccctacagcctctcccctttatctttcacggtaatcacccctcattactcgtacttctaactccatcttgaaagctgctncctggaagatccaaacggacncaaggagggactgaaggattagaaatgagggaagtaacccatgcactgcttatttgagatgggaaccgaggactttggccgntcctacacagagacagatggcagagagacaagtttctcagagatgcgtgagtaactngaatgcttttcctgagacccagaccagcctgctcaagagacactgttgcagctgccctcctggaggaactangangattttattctttacttcccagagaatggaaccaggacacagtagcattaacaaaaaaggatcgcatctcgtcagaacgtatgcattgcttctctcggattacctgaagttactccccttccctcaataataaggcattagaaaaaaatggaattgatcaaagaagtaagagtaacagaggaagactcg

SEQ ID NO: 670157 - DNA, 960 bp, Homo sapiens
gcagagccctggcccggggtgcgattgtgcccgcagcgcccccgtggtctgtccccgtgggacgccagtggcctctacctgctggcctggtgctgcaccctgctggtggccctgtggctcgctggcttgcgcgcagctgagctggggtgtagtgttgtgaatgggccatgggccccctggggcgcaagtgggtggcctggcgccatggaacccccgacctgtcccctcggaaaggagcctgtctctgtcactgcccgggccccgtggagggccaggccaccctgaagcctcccccgcagcacctgtggctggcatgcctcgtgaccccacatccagtaatcacagcaagctgctggtctacatcctgaacatgcagcgtgagcggctgcctgaagctgggagctggcagcctgcaccggcccatagagctgcgccgatgccatggacaccagcgaccggcccggcctgcgcacgacccgcatgtcctggccctcgtccttccatggcactggcaccggcagcggcggcgcgggcggaggcagcagcaggcgcttcgaggcagagaatgggccgacaccatctcctggccgcagccccctggactcgcaggcgagcccaggactcgtgctgcacgccggggcggcaccagccagcgccgggagtccttcctgtaccgctcaagacagcgactatgacatgttcacccaagacatgtccggaactcatcggtcaccagcgaaggcacgctgaaaacctcatcgtaacagccattggtcacggtgctggcaagctccggagcgtccggaaccaaattcatacctccttgaacaatgttcccgatcccaggtacaagcgagcccggtgggctgaccaccctgttttgcaggcacagacggtaaaaaaaagggtaacgattgacagagaaacaggaagaatgaagatcctatagaacaagaaaca

SEQ ID NO: 670158 - DNA, 866 bp, Homo sapiens
gctttgtctaagtacaacgaccccttagctcgttagaacctataatgagaaaaaacgcggatggtgtgcaaccacctctacaccgtgttgtgaaggcgtgttgtggctcgcagcccgcaaacgaagcaaccagcctttcccctcctttttggccgggaagtgtccccaccactatgtcctcttgaagtatagccgccgcgcatccccacctcgtggggggcaccctcggcgagcgatataaaacgagaagatcccgtgttcacccgcgactatggttttgtctccccttgatggcctgcatatgacgctcccctcccttataagataacgtatttactacacacttcggctttatgtttacacaaagcggtttaaattacctctccgccccacccccttcggacccacgccgcagtttttcctctatcccaacacacgtctttggtgataacaaaacttgcctcacaactagggaacacacttttctttcgtcgcaaaataccatgtttcctgtagttcaagtaaaagaaacactctcccagactcaagtaagaggccatatgtggcgcatgccctccgacgtgcaacacacaggaggtagattaaaactccacaccacgtgctgtactggataaggttcattggtaccacaacacgccgccacacaaggagtgtaggtgcaccacccgggagacccctctgtcataccctcgtctgaattggagacagacacctcctcctgtagggctagtggtagctgctcagtgccccccttcggcctatagtatgatcctgtaacacagatccattataacaattagaacagtccccaaaaaaaaaaaattcctgaaagacaaacaaagaca

SEQ ID NO: 670159 - DNA, 921 bp, Homo sapiens
  misc_feature (35)..(35): n is a, c, g, or t
  misc_feature (43)..(43): n is a, c, g, or t
  misc_feature (105)..(105): n is a, c, g, or t
  misc_feature (130)..(130): n is a, c, g, or t
  misc_feature (176)..(176): n is a, c, g, or t
  misc_feature (179)..(180): n is a, c, g, or t
  misc_feature (225)..(225): n is a, c, g, or t
  misc_feature (236)..(237): n is a, c, g, or t
  misc_feature (239)..(239): n is a, c, g, or t
  misc_feature (308)..(308): n is a, c, g, or t
  misc_feature (318)..(318): n is a, c, g, or t
  misc_feature (329)..(329): n is a, c, g, or t
  misc_feature (361)..(361): n is a, c, g, or t
  misc_feature (379)..(379): n is a, c, g, or t
  misc_feature (416)..(416): n is a, c, g, or t
  misc_feature (425)..(425): n is a, c, g, or t
  misc_feature (437)..(437): n is a, c, g, or t
  misc_feature (440)..(440): n is a, c, g, or t
  misc_feature (446)..(446): n is a, c, g, or t
  misc_feature (473)..(473): n is a, c, g, or t
  misc_feature (488)..(488): n is a, c, g, or t
  misc_feature (510)..(510): n is a, c, g, or t
  misc_feature (513)..(513): n is a, c, g, or t
  misc_feature (547)..(547): n is a, c, g, or t
  misc_feature (853)..(853): n is a, c, g, or t
  misc_feature (908)..(908): n is a, c, g, or t
ggacgggggcgcgggggcgcggcgtgcggcacgtnggagggcngaagcggcggcggcggtggggacatgcacgtagcccggcgctcggcatggctctcctggtgntcggtgctaggtgagcatggacgcntctttcgtggcgagtgaagtggtctggattcctctagtgatgatgnganngaattaactccatcaaatttcaaccgagaagttattcagagtganagtttgtggcnngnagaattctatgctccatggtgtggtcactgtcaaagattaacaccagaatggaagaaagcagcaactgnattaaaagangtggtaaaagngggtgcagttgatgcagataagcatcattccntaggaggtgcagtatggngttcagggatttcctgaccattaagatttttggatcnaacaaaaanagaccagaagantancaaggnggcagaactggtgaagccattgtagangcggcgctgagtgcnctgcgccagctcgtgaaggatngcntcgggggagcgaagcggaggatacagtgctgganaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtgaaagagcagacgaaaggaagagtgaactggcagctgtggatgctacagtcaatcaggttctggcctcccgatacgggattagaggattcctacaatcaagatatttcagaaaggcgagtctcctgtggattangacggtgggcggacaagatccgacatcgtgtcccgggcccttgatttgttttctnataacgcccacct

SEQ ID NO: 670160 - DNA, 417 bp, Homo sapiens
  misc_feature (96)..(96): n is a, c, g, or t
  misc_feature (120)..(120): n is a, c, g, or t
  misc_feature (148)..(148): n is a, c, g, or t
  misc_feature (196)..(197): n is a, c, g, or t
  misc_feature (259)..(259): n is a, c, g, or t
  misc_feature (261)..(262): n is a, c, g, or t
  misc_feature (273)..(273): n is a, c, g, or t
  misc_feature (278)..(278): n is a, c, g, or t
  misc_feature (334)..(334): n is a, c, g, or t
cttttggggaaaaaacgggggggatttccccccaatttttcccacacgttgggggtttttgtggaaattccccccaagggcattttcccccccctnaatttccattttgggggagccccnttttttttgggggacccccggccacaantttttttccccggaaaaaccaaccccttttgggccctccttagggaanngggggggcggttccgcctttttttaaaaaaaccttttgggctaaaaaaacccgttttggaantnntgggggaaaanggggnttttttttttttgccattttaagcccaaaatttgccctgggcccttaacaaattanaaaaatttttccccctttaaaaacccctttttttaaaagggttttttccctttaaaaaaaatttttacccatttttggaatta

SEQ ID NO: 670161 - DNA, 269 bp, Homo sapiens
acctagaggatctaaacgacccgaaggacatcatcagggctaaagaggagtcttcgtgtgtactacgtacctccttgtacatctgctatacccaaattcagttattcagcattgttaggagttttaccttttaccatctcataatggatacctcatgtcttctgtattaaggtattttcaatgataggctgtagcttgtttcgtagttattggtgatggtgttatatccatacttttatctctaatgaaatgtagttgggttctgcctg

SEQ ID NO: 670162 - DNA, 2628 bp, Homo sapiens
  misc_feature (77)..(77): n is a, c, g, or t
ggggacttctctttcggtaaccagctcccttgcggatagtctatgttctccatataaacccagcacttcccttaatngagatacgtgggacttcactccgtccccagcccggaaccacaagtgagggcactgcgtttcctgattgacctctttggcgattacttccgcccaggggcctggaatactggaggcccttcgacggagaacaacaagaaaggcacttccggtgtctgttgccaggcgcgggcccagtgggccgtaggggcgacattgttgccgtcgtctttccccccccagtcccggggatggagatgtcgggactcagcttttcagagatggagggctgccgtaacctacttggcctactggacaacgacgagatcatggccctatgcgacaccgtcaccaaccgcctggtgcagcctcaggaccgccaagatgctgttcatgcaatattagcatacagtcaaagtgcagaagaacttctgaggcgtagaaaagtccaccgagaagttatatttaagtacttggcaacacaggggattgttatacctccagctactgaaaaacacaatcttattcagcatgcaaaagattactggcaaaagcaaccacaactgaaattgaaggaaacgccagagccagttacaaagacagaggacatccacctatttcaacagcaggtgaaagaagataaaaaagctgaaaaagttgattttcgtcgcctaggagaagaattctgtcattggttctttggacttcttaattctcagaatccttttctaggaccacctcaagatgaatggggaccacagcacttctggcatgatgtgaagcttaggttttattacaacacatcagaacaaaatgttatggactaccatggagcagaaatcgtgagccttcgtttgctgtcactagtaaaagaagaatttctttttctcagccccaactagattcacatggactgaaatgtgcatcttctcctcatgggctggttatggttggagttgctgggactgtccatcgaggaaacaccttgtttgggcatttttgaacaaatttttggactcatccgctgcccttttgtggagaatacttggaaaatcaaatttatcaacctgaaaattatgggagagagttcccttgctcctggaacattaccgaaaccatctgttaaatttgaacaaagtgatctagaggccttttataatgtaatcactgtatgtggtaccaatgaagtacgacataatgtaaagcaggcttcggatagtggaactggggaccaagtttgaggtagtggaaatgagacattgctgaacaaaagagaactgggtttacctgaccctctaaagcgctaagtactgtcagcctgaaaaaaatcttctatacagaaactcttccaaatactatatcagtaatgtctgaatgatttcagatgtgaaaattgacatattttagttgaaatacctttctggactacagacttacatatcatgtgaatacttacctatttctacccgagttgcagcaagtattctgaaagcttaatgcaaataaatcccactttagatcttacagctaactgtgtgccttagaaaccaggtaatattttccttttacttagtgaatattctgctaatatctgcacttttcatgtgggaaaggattaataatggtccaggcttcccctctttaagtttcatgtttacttttgtctaactctggataattgtattttacaaatgcatctcactgtagtatatttttaaaactattaaatattttagagatgtttaacgtaaactcaaagttctcattttagaaaatttaaataacattctttttgcaaaaaagtccaataatttaacagttgaagaaaaacttactacctctttaaatatttgagaaacatttttcaaagttatcagctgtagtccaagctaaatatcttttgtaatctgcaacattttccttactgtttttgggcagtgataaatgctgttctcgaaatagactttattcttacctaggcttcagccaacagttttatagagcagttactgtaatacaatataaaggaaatatgctgttgaaattttaaaggtatgcccagttcctaacttttaaacgaattaccgttcttcctcttggctgatcttggcagagatgacaaaaaaaaaccccaaaacaacccatgcatgtataatgtgtgtatacacatatacataagtatacatatactcccacattataacttagaatatttagttttttacctgttactaggtttgagttacatggttgagttgccaaattatttacatgctttgtttaaattcttcatcacctagcaactgtttgctgatcatggatttacttagttactttaatttataaaattaccatttggaaaagaactcaattgggaaatgtgatgacgtattgtacatgttactttttcctttgctataatcatctagggagactgataagaattttggaaatgggagcctggaaactcatctttgtttttttaatgctatgcctcttacgaggaatacgaattggtatgtcctaaaataagaacttaataaaggagggaaatcccttttgtctgctataaaa

SEQ ID NO: 670163 - DNA, 135 bp, Homo sapiens
acccagtttacttatgtctggaagctttgtgaagtatctgacactaaatgtatgctggcatgcagtcagaacctctgtaaaatggtgtcctcaggtcttcggaatctgctcctgacctgcctggtgaaatctggt

SEQ ID NO: 670164 - DNA, 1804 bp, Homo sapiens
  misc_feature (77)..(77): n is a, c, g, or t
ggggacttctctttcggtaaccagctcccttgcggatagtctatgttctccatataaacccagcacttcccttaatngagatacgtgggacttcactccgtccccagcccggaaccacaagtgagggcactgcgtttcctgattgacctctttggcgattacttccgcccaggggcctggaatactggaggcccttcgacggagaacaacaagaaaggcacttccggtgtctgttgccaggcgcgggcccagtgggccgtaggggcgacattgttgccgtcgtctttccccccccagtcccggggatggagatgtcgggactcagcttttcagagatggagggctgccgtaacctacttggcctactggacaacgacgagatcatggccctatgcgacaccgtcaccaaccgcctggtgcagcctcaggaccgccaagatgctgttcatgcaatattagcatacagtcaaagtgcagaagaacttctgaggcgtagaaaagtccaccgagaagttatatttaagtacttggcaacacaggggattgttatacctccagctactgaaaaacacaatcttattcagcatgcaaaagattactggcaaaagcaaccacaactgaaattgaaggaaacgccagagccagttacaaagacagaggacatccacctatttcaacagcaggtgaaagaagataaaaaagctgaaaaagttgattttcgtcgcctaggagaagaattctgtcattggttctttggacttcttaattctcagaatccttttctaggaccacctcaagatgaatggggaccacagcacttctggcatgatgtgaagcttaggttttattacaacacatcagaacaaaatgttatggactaccatggagcagaaatcgtgagccttcgtttgctgtcactagtaaaagaagaatttctttttctcagccccaactagattcacatggactgaaatgtgcatcttctcctcatgggctggttatggttggagttgctgggactgtccatcgaggaaacaccttgtttgggcatttttgaacaaatttttggactcatccgctgcccttttgtggagaatacttggaaaatcaaatttatcaacctgaaaattatgggagagagttcccttgctcctggaacattaccgaaaccatctgttaaatttgaacaaagtgatctagaggccttttataatgtaatcactgtatgtggtaccaatgaagtacgacataatgtaaagcaggcttcggatagtggaactggggaccaagtttgaggtagtggaaatgagacattgctgaacaaaagagaactgggtttacctgaccctctaaagcgctaagtactgtcagcctgaaaaaaatcttctatacagaaactcttccaaatactatatcagtaatgtctgaatgatttcagatgtgaaaattgacatattttagttgaaatacctttctggactacagacttacatatcatgtgaatacttacctatttctacccgagttgcagcaagtattctgaaagcttaatgcaaataaatcccactttagatcttacagctaactgtgtgccttagaaaccaggtaatattttccttttacttagtgaatattctgctaatatctgcacttttcatgtgggaaaggattaataatggtccaggcttcccctctttaagtttcatgtttacttttgtctaactctggataattgtattttacaaatgcatctcactgtagtatatttttaaaactattaaatattttagagatgtttaacgta

SEQ ID NO: 670165 - DNA, 183 bp, Homo sapiens
gatgccacatgcacgagaagagtaagcttgggagtctctatttttaacaccccaggtgattttgtgtatgctaaatgtacctaaccccttgcttccgttcattcttccaggcataattattgagtgcctgctagtgcaaaggattctctaggcacggaaaacagcagtgacaaaactgacaaa

SEQ ID NO: 670166 - DNA, 732 bp, Homo sapiens
  misc_feature (640)..(640): n is a, c, g, or t
  misc_feature (676)..(676): n is a, c, g, or t
  misc_feature (686)..(687): n is a, c, g, or t
  misc_feature (690)..(690): n is a, c, g, or t
  misc_feature (700)..(700): n is a, c, g, or t
ggggggggggagaatttgcttccccccaagcccttcaaaaaataagccccgcggccgggcccctggggtaactttggggggggagaaaaaaaaccccggcgggctcaaagggggggggcctttattggggggggggaaagagagccctttttgtggtgggtccaaaaaaaaataaaaaccggcgggtctctcggggggttctcccaggggatttttttttcttttttaaaaaaagtgtgtcccccaaaaaaaggggggtgggcccctttttttttccccccccgcggcgggtgggcccccccaaaggaaaatcttgggggcgcccgtgtgggggaaaaaagaaaaaaaccccctttgttttccccaaaaaggggggggaaaaaaaattttttttttttgggggggccccctgggcggcccttaaaaaaggggggggcccctcgcgcggggaagggtttcccctcttaaaaccccgttccaaaaaagggtgggcccaggggagcgtttttacccccttgtatggagattcaaaaaaggttgggaaaattttgggggagtcccccaaagttttcaagctttgcccaggttttgcagggaagggttcccaggttccggaaggctttgctctttgaccttgcanggcccttttcatcgttttcctgaatgtcacgcttcncgatgagtgnnagnatgtcgatgnaggcctcccggtcggtgctgagcagagactgg

SEQ ID NO: 670167 - DNA, 314 bp, Homo sapiens
gggaccaaatttgtttatttgaaggaatggttcaaatcaaagaacttaagtggatgttttgggccaactttttgaaaagggaaaggaaacccctacatgcatgccctgccttggggaccagggaagtcaccccacgggtatggggaaattagcccgaggcttaactttcattattactggctcccagggggggcttgccaaaaaaaaatttcgccaaaccaaatttgggcgctcccattttgcgcaagttggttacgtggtcacccaattttttgagggctttcacctggttatttagggaaggggtttaaaag

SEQ ID NO: 670168 - DNA, 228 bp, Homo sapiens
gagagtgcgctgtgtaacaccagtccgtgaattccgttctgcgaagcaatggtcgccggcaccccttgcttcctccctctgttgtctgcctgtgtgacacacaatcaataggcaataacttacttccaactcctacgcagaagtgggagaggccggcagccttgcaccgagagggcctatcctactctcttgcttcttccgcatacgtttctgtttgaggctagcaga

SEQ ID NO: 670169 - DNA, 300 bp, Homo sapiens
cagttgccccgcgttccccccttcggagaccgatggcggggaccttagtagctgctcggcgagccgccccagcaccggctcgggggccagaggcattcactccagactgggaaagccgagaagcttccactgggaccactatcatggccgcgcagttcgacgggggcgcggctctggcggcggactccagaacaaccactgggtcctacatcgccaaccgagcgactgaccagctgacacctatccacgaccgcattccctgctgccgctcaggctcagctgctgatacccaggcagtag

SEQ ID NO: 670170 - DNA, 952 bp, Homo sapiens
gggcggagaggaagagaaagaagagaaaaagagaaacaaacaaagacgaactgactcaacgcagtgaaatcgagatggtccgccagtgtgggacccgcggttggcaaccgggtcgggggaaaaccattcgggaatggaagcacccgggtccaagcagggcaatggccccgtcctagaccatagaggccgcatttcagcccaagggccgtgcccattgcgccccccggcggcctcccaaaccagactcccgggagttcgatcagcccatttccaggcagcagaaattgggcgttctcaccagagccttcaattcttgagtatctctgtggaccttccgcaacttttctcccaaaccccgtgcaggttaaagtggcttagaaaattcactagaagggctttgccccgccgggcatccatactgtacatttcgccccagatttcacaattctaactgcggtggatgatcttacttcgccccatagaaaatttttcacacgtctctcccaatagcaggaagcgtcattgagaaaagacccatgaggcaagagagactgaatgtctcaccacccggtggcgagcacatgatgctgaagttccaacacgggagatcccctctgatgtctaaaacactcttcaacaaatccacgggtctcatgtaaaaatcagttgcttatgacagtacttttcacataaaacaagacatgtttgtctacaaacaatttctgtatctacccccgccaactctcgccaaaaactcctcgctctcgccccgctgtattcagtactcattccctgcatctcccggacatctatcaggaccccgattcattcacaaccgtacaaatatcagtccaaaccaaacacatcttcttgcaacaccaactcaaaggacatagtgacaacacaaatttgaaggacaaacaaaaatttcttggcccctcccttcatgaca

SEQ ID NO: 670171 - DNA, 136 bp, Homo sapiens
ccatgtttctggcacatcatggggttctgatatattttacggattagtgcatgttctccgttaagttatatacagacaatgcagtctgagactgctcaatgatgtctcacacagcttcttgactctaatagatcca

SEQ ID NO: 670172 - DNA, 196 bp, Homo sapiens
atcacaccactgcacacctgcctgggctacaaagcgctaaccctgtcaaaaaaaaaaaaaaaaaaaactcccaatgaggaaaattttttattgattactctcctaattttcctttagaaatttataaaaaagcgtagggaaaataactttggtatccttgaaattttcacccccaaattggtctcaccgcaatttg

SEQ ID NO: 670173 - DNA, 420 bp, Homo sapiens
tttagctgattcactaagtattataagccttcacccggtcatgcagatgcggagggtgggggcgcgggctgtgatatggctggggtcctctgtcgtcagaaaacatgagctcatgccaagatttccgcaggtcaccggagatagcaccggctctctggagacaggcgtgacccccaggtcagctccttgtcattgaactaagtgggctcagtgtcagcttgaacgttagtggtgataagggccggataatggtagccaaactcccacggcctctttaggcctcccctggggacctgaggccagcaagaagggcaggtcagggaggggccaggaggaggagcaggcaggaaaggctgctggtgcctttggctcagccagtggggctctcagccctctgtagtgtgccctagggaccagttt

SEQ ID NO: 670174 - DNA, 907 bp, Homo sapiens
ggcgaacccactccagcttactcatcagacgagccttagccaaaccatgtagccaaataaagtataggcgattagaaattgaaacctggcgcaatagatatagtaccgcaagggaaagatgagacatctatacaccaagcataaatatagcgataggattaaccccgtatactcttctgctataagtgagattaactgtagcacaatacgactttgcaaggcagagcctcatagctaagactccccgatagcaagtactagcttaccttaatgtacagtctaatatgagcatagccggtctatgtaggcaaatatatgtggaggaacgactttatagagtatgatggcagattcaaaacctcaacagaattatgtgctagaatacgttcggatatgattctaagtactatatatccttaaatttcaaacattcttaaattcttacgctacaccgagactacttcataccattctctacctattgtggattttcttacagctcgttgaagaatcgcgaaaattaagggaactctaagtcattcctctttgcgtatcgcctccagtgaaagatatagaactctcttatcgaacccaagaaggtaggaatcaaactcttacaacacgcccaaatacgattagcagaacttcaaaacaccctttaattccaaaaccacagatttatacggaaacaagactgttttccgaaagttatccaaattcccatgcgccacattatacccctaattgaattttttccccccttaacaattttctacacatgtacaaatttactgatcacccaacccacacaaaatatgttagacccccacatttttcttaatctccaacgccattaattatcccacaaggaacacctttcaacctgctctaaacgtttaatctttag

SEQ ID NO: 670175 - DNA, 179 bp, Homo sapiens
ccactgctcttgtctaaagccttctgtctcctagggttatcctgctcatggtggtctgtgctcgagcacctgtgctcctgccagtttcatgtgtgccccttggagacgagcttcaacgtcatcaactcacactcctctccctgtcttccggctcctttcagcacgtgtgggctgtggac

SEQ ID NO: 670176 - DNA, 137 bp, Homo sapiens
atgtcaggtgagtatggtgtaaatgagtgaggaggagtcgaggcaggttagttgtggccataaaaatgattaaggatatagtataagagatcaggttcgtacttatacttgttgtagtataggctatacatttgtat

SEQ ID NO: 670177 - DNA, 910 bp, Homo sapiens
aagtgaatacaactgaagcattctgttattgtataagaaatgtaagaaaaaaaatatagaacgaagaggataggattctcgtttattgtatggatggaccctggtataaaatcactttggcgctttccattcatttggtttagcacagcagtgagcttctcgtactttcttctctttttttattcatctgcggattacagagcctcgctggctctgtacacccaggctagagtgcaggtagcacagatctggcgtcactgcacacactgccttccggggttcaagtgattctcatgcctcagcctcctgagtcgcggggataatggaccaattgccaccaccacccggctactactttttcttttattgggtttttcttagaaagaccgaccagacgctactggccgatcgaggaccacagggcgtgcgccgatgaacaccaccggggccatcacttatgactacaccctatgccattcggcgcataccacaaaagcccgggagaaactaacacgacacgtgaaccacaaccagatgtcggcacctagccagtcacgacaacaatggtgacccccagggtgataacacaccccgtaaaaccaggaaccccgggccgacaccagcagagacatggcaaccagaggtaacgctaaaccgggacaattgcagctccaaaacagtcgccacaaaaacccatttcccagccgcgcactatcaactcgacaccagaacgcgaccttcagccccactcacgggcacctcacagagagcactcccgcggtaccctccgactctagcaggcccatcaccgtcgacctatctcccaaccgcagcattgtaaccagcccatacgccacacccccgcgccccccacgacacatcccagagtggcacactcgcacacgcccca

SEQ ID NO: 670178 - DNA, 604 bp, Homo sapiens
actgatctagagttccccccgatggccatgacactgcagcccatggagatagagcagcgtgttgctcaactccacctttccctcatatcgacccttcccagcccgatgggcagatcatacacatgccccctgagtctctctgctatcacctgtagtttgtacgatgcttctgcaaatcctaccagaactctcatctccttcactgggctgcacaccatgaagcacactccctctgtacaacagaccctaggcttacctgcgtctctcagttgtgcaggaagcacagggaagggaaggggacagtaggcctaaataaagtaggctaggctgggaacaaggggatccaataagatctggtcctcactggcttttggtttctctccataggcacatcccctacactcagcttaaatcatttctgaccccccgtcccgatcgtgcccatgtggcccagtaaggtgggtccatgcaggaagctgagggaggtggcaagcccgtgcggctcgagcgcttctgcctgccctagtcggggcctagccggacgccggagaagacgctatagagccctggatgcccatcatgtcgtagtaatcttgacagccag

SEQ ID NO: 670179 - DNA, 111 bp, Homo sapiens
tagaggatccctgtttattgcccaacacggctcccaaagtgctgggattacacacatgtagccaacacgcccgggcgaaggttaagctttttcaagggttcagtaagatgc

SEQ ID NO: 670180 - DNA, 988 bp, Homo sapiens
  misc_feature (309)..(309): n is a, c, g, or t
tatacccttgccccccccttttttgggccaccccccccgggggtttaacacaccccccccggggaagggaggggaagggggggtaccccggggtaaggcccccttgtggggggaagagaacgtggtggcctggggtaatataacaaacgtgttgcgtccccggaggacccggtcgctctttgcccccccggaaacgtccttgtggtgcacccctcggagttgaacctgggccatagaggcgcgtttgcaaaagtctcgtgacctgtgggcacccaccctgtgtgggtgtaaactgtgcgtgctcctccnaatttttcgtgcgcgctctcacttgtggcggcgccatttttgaaggggagcaaccgcgccgccccgtggtggtatcactgggcggcgtattttccctagagaaaagaaagcgcggggaccccaccccttctttttttatagcgccgcggtgtgttctctccagcgtgcgagacgcaaccgcacgcgtattgtttgtgggcgaggctccacttatgtgttgagggaccccgcggagaagggtggggggctctcaccactcaagggcgcgtggtagaagagggtctccccccgaatgttggcgttatcacgagcggagacggcaggaagatagagcgacgcactctcctctcgcgacacaacggtgttagacgacacatgagaaagaagtggcggctcactcacaaaggtgagtgggccacccccactcaaaaggatggcgcacttctactaaaaaaacaggcgggggggtacacacagtattctctccccaccaaagcgcgacccccccacagaatagtgggtctttttgggctttaccccaggaagtgtagaccgagagaccccccaaaaaatagtagaaggggtctctgcaggcacacgagttgtcctcaaaaagttggggccccgggactacaccttctgctttgaagtgtgtaccaccacgggaggaactatagcc

SEQ ID NO: 670181 - DNA, 426 bp, Homo sapiens
  misc_feature (15)..(15): n is a, c, g, or t
  misc_feature (60)..(60): n is a, c, g, or t
  misc_feature (66)..(66): n is a, c, g, or t
  misc_feature (233)..(233): n is a, c, g, or t
  misc_feature (237)..(237): n is a, c, g, or t
  misc_feature (293)..(295): n is a, c, g, or t
  misc_feature (384)..(384): n is a, c, g, or t
  misc_feature (405)..(405): n is a, c, g, or t
tttacacagaaccanatggaccctcccaggctagtccatccaagtctcctgtccactcanccagcnctggggcaactcgggtttcaagcatagtatactctgtcacttccacccaatacacagggacaagggcactgccatgattccccctcctgggccctctctttgcatgacaaggcagttgtggtctgagacctggaggtcccgcaaagccagttctaggagggcctgancccnaaactcctccccatccccgcagttctccccctgacctcccagcacctcaccttccnnnggtggctggccagggagggaggccctggagaagcaggcagatgaggtcctgggtgacctctcaggtgacagggaggcacattgtactgntgtgaccgggcccactggccncctcagtgacttacgtgtcag

SEQ ID NO: 670182 - DNA, 604 bp, Homo sapiens
ggcagcttcattttccgccctccgggccattttcaacttgtccgtatcaaacccggtggccacacagggctaatcgagcccggtggcgcgcccctctttcagttgccccccgttgttctctgttcacgagccttgtcccaaccacaaaggttatccccaccccgaggtgcccccacggagaagttctccaaccccggctgttatccccgggagcaatgtggccccccccgcccagtctattgtcgagctcggggcacccaccccactggcagtgtggtgggctccagcggagcaggcccatgtgacccgtcttgctgccactatgtccccctggagaacaccaggtgactcctgttttcttccaaactaccggctttcttttggcacttagcacacacttgtctggtctgtttaccccctgttgagagccacactgggcttttctattcaatggaggggcctacatcaacacggtctttacccagagctcgcagtggtaccagcgggggacccaccgcccgtggttatgtagaaactcccccccctttttcgggctgggggtgtttcagctttacccctgaaccccacccgttctttcataaca

SEQ ID NO: 670183 - DNA, 365 bp, Homo sapiens
cactgaaacccgcatttatctaagactgggtggtgcaccatgaaacatgcatgtacgtcccaaaccatgcataagtgggcagcttcctattacgcagcaattcttccctctatggaacattgttcaactcagaatgtcaatctatggagctcaaatttttcctttcttaacctctctttatgagagacaggtcttgctctgtagcccaggttgcagtacaggaggtgtgatcatagctcactgcagcctcaacctccttggctcgagaaatcttcccagttcaacctcctgagtagctgggactaactggcatataccacctcacctggctaatttgggaatcttgtgtaagagagggtccccca

SEQ ID NO: 670184 - DNA, 304 bp, Homo sapiens
tatctaagtactctagaggatcgctttcactgcttcggatcatgcccccactgtttatggctaaccttattgtgggatagaggcttaatgataattgattacattctggaattcttggtaagaatacaaggggtcttaggagccaggtttataagtaagggggctgctcttggctacttgggacattagccagcagctagtgactggcactggttcccttctgtggctctgggcatgttacagatagaaaatgtgttgagtgatgcaaatggcgtagtggcctgacttctgtaaccaaataatc

SEQ ID NO: 670185 - DNA, 107 bp, Homo sapiens
agtacacggacgactctacataccaactattgtctatatgaaatgtatttttgtatgtttctctagcttgacaaagtatggtatagagaagaagcaggctatttgta

SEQ ID NO: 670186 - DNA, 236 bp, Homo sapiens
ggtaaactgcactgattcagtacatcagcaatttgaggagctcagataagattcttcactcgggcaggatattgccgtaaatcacaagacctccctgaagcaggttaatttggaagcctggcaaatgtgaactgtagattatcaacgcccatagtagtaagatgtattgaaagtgcctgattcgtaatatgcttttctacgcatcaccactcctctttcacacaccaagaatgtgc

SEQ ID NO: 670187 - DNA, 214 bp, Homo sapiens
cctagtaggagggtccgcgtggtcgaccaggctttcgggtgactcaggcccgtgcccgagggcccacggtttcaaccagcatcccgggcgactctggaccgtgctaggtgctgcggtgctgaactgctgtcccagggaactcgtacttggaccgagggcacccggggtcgaccagcggtccgcggcgacaccggtccaggtcaagcacgggtac

SEQ ID NO: 670188 - DNA, 477 bp, Homo sapiens
  misc_feature (189)..(189): n is a, c, g, or t
  misc_feature (219)..(219): n is a, c, g, or t
cccaccgcccaggtgggctcaccaatttgggggggcatcctttggccctccattaagggggttggcttcctcctccctcgttcacaagcccaggagttttgaaatgggcccccttttttggggggccccaaccaattgccccctaaggttggccccccggcccccgggttccccagtttttaacagtcnccttggggaaacccctgcccccatgggggntttttttgggttccctccccaagggtttcccccaaaggggggggtggttccccgttaaccctggggccccccaaaaggggtttttttttttctccctagtcccaggggggggggggggccccccccctccccttacaaaggggtccccttttttttttttgggggccccccgcccccccctcccatgggggaggttttcccccccgctcctttgtgggggccccttttgggttttttaagcccgttttttaatgccca

SEQ ID NO: 670189 - DNA, 359 bp, Homo sapiens
tgcctcaatgaacccagcactggcttaggcactgtgtcagcactctaggattagggtgccacacccatctccttgcccttcatagagattattctctgatgagctttaccactgagtaaagaacaagggtttccacggatcatcctcaccacagggaagactcgggtactgcttgtatcataagctggcccagccgagccggtgaccgcttaggattatcggatcccagtgctggaggggatcttgaaggtcccttggctaccaccctttctgccaactgtgcagccccgcgggctccccccttctgctctatcacttgctgtgccctgtcattactttcctctctggctaacagtctt

SEQ ID NO: 670190 - DNA, 878 bp, Homo sapiens
catgtcgctgcgcccggacagtgccccccgtgtgtccacatgtcgatcacctttcctgtctggaggccagagtgaggaggaggcgtccatctaacctcaatgtcgcatttaacaatgtgccccctgttgaacccctgggccctgtaccattcgtcctacggcccgatgcccgtgtagagccgtcatgtcacactgaatgcccatgagagtgcagggacagcacagggaggaaccgttacaggtgctgccgcagcgaggacgtagttgtcaatctcgaaggcccctggtaacgagagtaggtccgggagtggtcgtcgcagtgggcgctggtctctggggctagggatcgtttcaccttcggcggggacaagacgctcccgttctccacgtctcacgccgcttcgtcgccttggcgatatagagccctagagcgaggaccttttggccgctcgttcaacacggagaaggtgccgccgtccgggatggcggggtcccgtcgccgtggtggggccttggctttgtctcggatggcaggaagatcgcgcaatccgttttcgggatcataccttgattcgcaaactggcccctttagatttaagggggctgtgtcacggggttgcgttgcccccccacggagggttttgggcccctctgcggcgagatgcgaggcgtcgcacgggggcgcgccttggtgcgccgacatgcgccatacctcctttgcaatcaatcgaaggcgcccggactctcccgtcgggggagcgttccaccgggccatggtgcgtttgtccctgaggcatcgtttttcattctcgctgtcgtgtgcccatcggtgcgctgagtggtgtggcttgttccagcgtcctggttggagttgccta

SEQ ID NO: 670191 - DNA, 381 bp, Homo sapiens
gagctaattaaggttaaatgaagtcctaatgtgataggaccaacagttttcatgtgtctgctgcacagttaacagacccatgatgctcagacagcagggtttgcagcagagaaagagtttaacaaggcccaggtgaggaggtgaaaggagacgtctcctcaaatacatctccctcaggagttctgagctaaggtttttaaggggatcatggaaggtgaggggctggaaaatgggggtcgctgactggccagggtaaggaggatgattcactagaatgtggaaactgcattccttgctgagtcagctcctgtggggtccttcagagcagctggcatcagtactttcactggcgcccttcccccgccaacgccgccccttccc

SEQ ID NO: 670192 - DNA, 340 bp, Homo sapiens
  misc_feature (173)..(173): n is a, c, g, or t
cttggtgctttgaaaattaactgtcacaaacaaggagtatatggcttcttttttctttctttttaaaaaatctttctttagagctagattcaatcaggtgtctgaaatgtgagttaaacattactttatcctttggtgtagttcttattattttccatttattgtgcctctgnagcaagtgttccctttgaaaggcccatcccagagctcaggccctgcggggtcagcgctgctggttcttatcacttgctgccccccagatgctgtttccggtcctttattctacgtctctagttgagatagggccccactcagtaagtccgggctgggcctcaaaacc

SEQ ID NO: 670193 - DNA, 136 bp, Homo sapiens
ctggctggtgaacaggcctgaaggcagaatccctacccaatgaagaagtctgtaaccgatgttttcctgtgtctaataaactgtagtgacctttatccattgagataaggctcaagagagcaatgtgagatggaaa

SEQ ID NO: 670194 - DNA, 203 bp, Homo sapiens
aagcgaacattcggcctacctagagctgccaggaattcatgacatcctgggagccgccacagctggacactgatggagacctggatgggggccgatgcaaaatcctgctccttctcaccggcctgcagctgcaccagcacctggtggagctgatggggagagcgtcagcacccaccgtgtctgccccccgcagtgttcgcttg

SEQ ID NO: 670195 - DNA, 1017 bp, Homo sapiens
gggtctacgaggacgctagtttcccctatcatagaaagagctgatcgacgttttcatgatcacgccctcataatcattctccttgtctgtggtcctattcctgttatgaccgcttctatccttgaaccatgtcgagcacaccatgatagctaggactacaataacttaacctagtctgcgagcaccgcatcaggagaattcagaacacctccgtgcattgaagcattaatgcgcctgtcccgggccacttctactacctcatgtccctgcatgcggccccttcccatcactccgtacggcatgcagtgtataccataagcgagagcgaggtacaatgaatgccgctcccgttaccagtgcaaatcgaaattggccaacaaagggtagctgaagccgtacgagatagcaccgacatacggcggcatgtagagtgctgtcaactccgtatataattcgcccatgattccctgaggaaccagagcgaacactgtcgcactgccattgcaaggtctgactgatcgcatgtagataactcaccgattggaatagcgccccattgcgtaagtgaatgaatttacatgcgagcactcacggtcttgtcattcgatgacagtcctggtccccaagattagggctttaaacatacccaagatgccaatgtcccgggacgtcttaaaacccaatgccgattatcagcgatacaagtaacgggggctataactacggtcgaatggctacctggaacagtctgtggcagacacacacgcaacagctgggcagggcccatcgtatctcagaaaattaattgccccttagaaaaatgctgccgaaatgagagggcgccgcaattttgagcctcattagcatcgcaactcgaatccccctatgagagcccgaaacccaatgggagaaccagtggtttgaaactgggaagcttccgaatgggcctgaaaacaaatagccgggattttcaagcccaggggagaaggatgccaaagactccttgaaccctggaaa

SEQ ID NO: 670196 - DNA, 276 bp, Homo sapiens
gcccccccttttttttaaaatttgggggctgattataccccccgggaagtagaaggtagggggtttggggaaaaactagaatctcccccgcctcccttcttggttaagggtttcccccgtttgggtccattataaccctttggcccttttctatgttattttttttttggatgaaacccttaccccccctttttttttttgttcccttttttccttttgtttttttgttttgcctttccccccccctttttaaaaaaagggtttttgggcctttta

SEQ ID NO: 670197 - DNA, 928 bp, Homo sapiens
tggccaaaaacaaattaaagcagggcctatgtaaaaacagggcactctcaaaactcctggtacacggtttcacaaaatcaaaggggcccaaaattacgggaccacctaaagacaattgacaaaaagtgtgctggacgccagaggccaccctttcgtgcatagaatgagcgcacgcgacagtgtgactctcgcattttcttatcttgattaaggagacagaaaagaggctcttttcgaacagatttgaaaacaccaagggcggggtgctcttaaaaaaaacagcattgggttctcaaagaaaacactatagggaagcaccccacagagcgtgatataatttcttaaggacacaaatatcattcctattatgccaccgggggatatttggacccattattcctaaaatatcctataaagtatatgggacactcccattctttctttccaggataaacttggggaagagtgcgtgtccacacagtctgtgtttcttcatataaatttacatccttccacaagtgagttctgggcgcgcaaaataagtcctttctctttaattctttggggggcccctaaggggaggagggacacacagggtttctcctccgccattttttttctacactgtggggctcaccaaacacgaacttcctttttttgtatagctgtgccatctcaagaaaagcacaaaaaggcccccatttttactacctttgtagtatacccgaggactaactccttttagccacacaacacaattttttaccccgaaaatataaaggcttatattgggcccgaaatcagaaactttttggaaagcacccggtggggcgcccagataacgaatattattgggttccccgcgcaagggggcaacaaagcggtctgcaacaacattttttatttactccgaagggataatataatt

SEQ ID NO: 670198 - DNA, 1002 bp, Homo sapiens
cagaacaagagcgggttggtggatgtactgaagtcggacacatggactttctagctgaacagtcagacttcatccacgtccaggacagcgtgagcgtctaggatggtgtctcaccctgttgcccaggctgggaatacagtggcacgatcctggctcactgcatatctccatctcccgggttcaagcgattctcctgcctcagcctctcaagtagctgggattacagggctgcagaagctgagtggcatagcttagtgcagaggggtgaatgactgctgacgtgcattgccatacgagaccctgaggacaattagggacgaagtgctgctgcaatacttcttagagcaatgacatagtatgattaagcacgttccaagggcacagggggatagagcgtccatacagatgacgacctggaaacacggggatcaggcctggcagtgcgaccagggcgaccaagacgacatggcgtcatcgcctggtgaccggcgaagctggacatgctccccttgagcatggagacgtggcccaggtaccacggacaaggtatagcacacagcttgaattgctgcagcgctcaagggatgtccactgtgatgaggctgcggactagcaagtcctctcaagggaggttactgaaagcacgtcacattagggctttctagcgcttcaagactcgaccctagggtcgttccaacccataactttacatcgcgcgcttggaattcggcaagcggaacccccaaaagtggtcccactccgaatcagcagagtggaggacacatccccacccataagagaaacataccaaggaaacccaactaggcggatacacacaaggcggggctcaggaacgcaccaaccacacggatgcatgtacaaccgcctgcacccacgctacggaagtgacccacagggacacaccactcacctcggggcccaacgcggacgcaacgagttaagagaggcaagaacccttggcaccgacatacaaggggaaca

SEQ ID NO: 670199 - DNA, 228 bp, Homo sapiens
atgacctgtactgtgctatgtcgtgtacaatggctttatgttctatgtactgttcaggggtgtggtaggtttgttggtatcctatgtgggtcggggtggctttggagttgcagctgatgtgtgatagttgcgggttggttgctgtacttgcttgatacgcatgaggggggggggtttgatatggatagggttttactgtcctacaggtggtcaagtggtccgagcgga

SEQ ID NO: 670200 - DNA, 112 bp, Homo sapiens
gtaaagccagcgtccttcatagagaatatggtaaaatcgaacagaaagccattaaagaaagtttatataccatggagcacatatatgtgcagaaaatgtcacattatcttcg

SEQ ID NO: 670201 - DNA, 460 bp, Homo sapiens
cttcctgagcgcctggacccatcctctgcctccagcctctgccccagaactcacacctgtgccggagcccctttctccctcccacactcgccatctcccaggccgtttcgtctgtgcagggctggtttgttctggctttttttgtttgtttgtttctttgtctgtttgcttggtgtttgtttgcttgttttctgggggaaaaagccatatcgctaaaattctatagaggttgagatctttctcagtgtcaagtcctgaatgggctgggtttgctgcctctgggacccactgctaggaaagggccccagtactcctccacggatctggtttcctgcccagccctgggtaaacttagccggaagccttaggtcccattgtcggcgctgaggtgtctggcctgaggtcaatggtgcaaggagccgccaccgggttcgccagcctggagtgctgggctgtgtta

SEQ ID NO: 670202 - DNA, 205 bp, Homo sapiens
  misc_feature (25)..(25): n is a, c, g, or t
  misc_feature (87)..(87): n is a, c, g, or t
  misc_feature (135)..(137): n is a, c, g, or t
ttaaattcaaaactataaaactacnaatataacataggagaaaatcctaggtgactttgctttggtgatgacattttagatgcaacnccaaagacataattcatgaaataagtaattgataagtagattacattnnnattattattattattattattattgcaaaagccaatgccaagacaatgagtacacaagccatagccca

SEQ ID NO: 670203 - DNA, 293 bp, Homo sapiens
  misc_feature (171)..(171): n is a, c, g, or t
  misc_feature (181)..(181): n is a, c, g, or t
  misc_feature (192)..(193): n is a, c, g, or t
  misc_feature (254)..(254): n is a, c, g, or t
  misc_feature (256)..(256): n is a, c, g, or t
cttagcaggaagagagaactggaactgcaatgctagggcaggggtctcaaagtgtggttgctagaacagcagcatcagcatcacctgggaacctgttagaaatgcaaattttcaggtccacccagatctactgggagctctgggcatgaggccagcagtctgggttttacnagagccatcntaggagattcnntgatgtatgttagacgtttgagaacccttcgtgacccaaggaagcggtggctgtttcaagncnagtggaaacctccaaagaagaaaatcgacataaacat

SEQ ID NO: 670204 - DNA, 457 bp, Homo sapiens
  misc_feature (66)..(66): n is a, c, g, or t
acgccccggcagatattcacaatctcctcggagaagagagatgtgagaagagaacacgcccctcgngaggaaatatatttgtgcgaattgaggaccacccacctcgtattgttttggctctcaccaaccacgcccttctcttgaccccttaaacttttccacggccacggagtttcttataatgagaaaaatgaaggtaccacggactgagagagagaaaaacccacgaaaatttggcctctttctgtgggccactcaccttgggccagtccactccccactgacacacccacgatccaagccttgaaaatgagattccttagccctggatttccttctaacacactgttatccaatctgggtatctttcccggcttccctgacctgctttagatttttaagatttgtgtttttctttttccccaccaggaataaatgagagggaatcgacctgtta

SEQ ID NO: 670205 - DNA, 826 bp, Homo sapiens
acactactagtatcatattacttgtacaagcgatctatccgagactgcgacaacagactggatacactactacggatgatcacacatggtcaagcatcataacattatctaccctcagctggcaaacctgccctgtcccaccgcttctcactgaccgcttaaaccgtatgctcacagaagctaccattaagccatgacaaagcctctttaccaccacgagctgcgctcagctggatggctctatcaccctactactactataccagatactaaccattcgacacaccacgaacttaatacccgtgcatactgcaccaaagtgtcccataaacaactacaaagagaaagtgctatataagcactagcgcatcctagacgatcactcattgtgcaacaaggccaacacacgttcctatctaaagaaaaaacaggtaccgatatcacaacgagtagctacgctgcaccatccatatccctggaataaagattacgataactactctacaatcatcacacaaaaaaactaaaccccacgcactaagcggccaaccacgtcaaaccataagaaagattgaacacgacacgctacccacataagcatcctagaatcaagaaacaacaccccaccattcaatcacccaacacacaagataatactagtactgggcaatacaccattgcaccgcatgataagccataaccatataggcccataacctatcaaatacaagtaaccaacaagaagacgcttagacgtacaaatacgcacaactacacagtattccacgaagaaaacctacaggcacaaactaacctccaagtatgg

SEQ ID NO: 670206 - DNA, 273 bp, Homo sapiens
gatagctcggtccactctgggcgagctgcactcagaggcgagctgccttcctgaaaaacttctgctcattcgagacgagcctggccaacatggtgaaaccccatctactaaaaatacaaaaaactagtcaggcatggtggcacatgcctgtaatcccagctactcacaaggctgaggcaggaggatcgcttgaacctgggagttgaaggttgcagtgagctgagatagtgccgttgcaccccaccctgggcaacaagagcaaaagtctgtctc

SEQ ID NO: 670207 - DNA, 130 bp, Homo sapiens
  misc_feature (45)..(45): n is a, c, g, or t
ggatcccggaaggctgagatagaggcaggcgatgtcacttttaanccaatgcatggcatgatgtgctgcaatgagccgagatctgtaccactgcactccatgcctggtaacatgagtgagactctgtctc

SEQ ID NO: 670208 - DNA, 1322 bp, Homo sapiens
ggacgcgtgggtcgacccacgcgtccggcaacgttgaaatgcttaaacaggctgtgaaggatcataatgtaggttcacctcctaaatccccaacacatgcctctccccagcacacacaaacagagaaggactacccatctgaaagggacatgcagaacaccttcagatattatctcaacaatcaacagctaagctaatgtctagattctgattgtggtctagacatcgcagatacacaatatataccaggtctcatacagcggaacactgtcagtactacacacccaaaagcatgattcagctgcaatacaaaaatccctatatcttccacaagaaatgtaagctgactatatagcacttacacagacatatcactatccagaatggaaaggatcaccacattccagtcgtcccaaacgtcctatagcctagctgaaactgcacataccacacacgttacctgctgcgaattgacacacagaacagacaaattcctacatggcgattcaacacacacaaacattactaggcactatggggcatcatcacaccacaccacacgacgctctacaacaccacagatcacacacatgagacacatgtgactacaacgccctcgcacactctgcgcacacaacgtatatccagaaacactccatgcaccgaaagccatcgcactcagaactcgcataccgtacctaaaccacgggcggtcaaccagacgtaaacgagtaatggccacactccgctaacccaacccctgcaccactcccttgccatggtaacataccacggacatccgacgcaaccgatacacccgcactccccaatatcaaaaagcccacctagcaaaaccgcatacgaccaacacaaacataaccaagcggcaagccaggaaccaaacaaaagccgacaacacacacacaccgaaaccaccaacaacacatatagacacgaaacaaatatgacaaccgaccccgaacaactaatcaacacgaccgcacatccaaacactccccgaccataccacaccgaaaccacggagagagaacaacacagaaccagagcagaaacacaccaacccaacaaccaacaaccatccactgacacaaaaaatatcaacaacacagattcaccaacttgacgccaaacaccacatcacccagcacaaaacaacactatacaacaacacaatgccacgccatacagtatcatcaactaatacctacaccaacaacaaataaccataaacatactactacatctcacccaaaataaacagaatacacctcaaacaaacaataacacaaagatactaccta

SEQ ID NO: 670209 - DNA, 418 bp, Homo sapiens
gagtgacttcacactactgaacattgtctatgacactggatcccgggaaagcccttggactgacagtggcctcccctctgctcattgacagacggtggccccacctctgctcattgacagacactggccccgcctctgctcatatgacagacagtggcctcccctctgctcattgatagacactggccccacctccagtcattagacagacacgtggtcccgcctcttttcattggcagacactgagcccgcctctgctcattggcagacactagaccccgcctttgcccatagacagacagtaggactcccctccgctcattgacagacagtggcctcgcctctgctcattgacagacagtgtccccatctctgctcattgacagacactggccccgcctctgctcatagactgacc

SEQ ID NO: 670210 - DNA, 407 bp, Homo sapiens
ttaaagcacagcaaaatacatgggcaatttcagagaggatctattttttcttgtttaatgctgaatgaagaattattccacccacctctcagcagtagtgactgaccaaataagagggtgttacggtttggatatagtttggcctcaccaagttgtaggtcgaaatttgattcccagtgttggaggtggggcctagtgagaggtgttttggtcatgggagtggatccctcatgaatggcttggtggtgtttttgcagtaaagaatgaattatttatctactagttcccatgagagtgcccctgagagttggttgttaaaaagagcctggcaccttccctgtgctcattttgtttgtttttgtttttgagatggaatttcactcttgtcactcaggctggagtgcaat

SEQ ID NO: 670211 - DNA, 507 bp, Homo sapiens
  misc_feature (24)..(24): n is a, c, g, or t
  misc_feature (26)..(26): n is a, c, g, or t
ctccagcctggggtgacgagtagncnaggactgcgtcttctaaaaaaaagaagaaaaatacaaacgatgctcagtctatggctattttgtacttaaattaaactacaacatgacgacactacggatcagctatcagggtctctcttcagttaagttcagctgaacccttttcctgtttagaatattttctaaaagtataaaaaaacttaataaaagaaatggatggctgggcatggtggctcacccctgtaatcccagcactttggtaggctgaggcgggcagatcacctgaggtcaggagttcaagaccagcctggccaacacagtgaaactccatctctactaaaaatacaaaaattagctgggcgtggcgcggccgcctgtaatcccagccacttgggaggctgaggcaggagaatcccttgaacccgggaggcggagattgcaatgagcctattgcgcaactgcactgtagcctgggcgacaagaagggaatccgtccctccc

SEQ ID NO: 670212 - DNA, 349 bp, Homo sapiens
gtgcaagaagcaggcaaggggaagtgcagtctggagacctaagcgcgtggcagagcctggaagcgggagcgtggagggccgggtccaggagcctttgggcgagctctctgggctgcaccactgcccagagggttctgaccattttcagtctttgtcactcacctagggacttggagtccagtgtgagaacagctggctggccgtgcagtgtccggctcccctgcctgggctgagggcgtctccagtcctgcaggctgcgtcccaagaggaaggttcctgccgttggagcagaagggggctgttccagagtaggggcccaggtgctgggtgtgaggaacaatggtgtgtg

SEQ ID NO: 670213 - DNA, 782 bp, Homo sapiens
ctacattgaacagacacggtagaagactcgcccattgttggaatgtgaccgtctgtccttcaggagaggacaccagtgctgggggtgaaggagacactactgcccccacccctgagagccccgcatcgccatggcttccatcttcctgcatcaggctaggcgagtccgtgagaccctccatgttcatgagttatgatcgagaatcatgtgtttcaacaacatacgtaacaaatgaatagaaagaggaacataaaacaaacagaccgccaaaaggaagcatgagcaaaagatggtaacgcaagactgaggcatcctgaagaagacacattccctcaggacgccaactcatgataatttataacgactgattcacaagctgcgaaatccaaagacctatacatacctagcgtggaaaccacttgaactcaggaacaagatagcctccgagaaatggggaacacaaacattacaatgctcatatctgcgctaaccaacagaagacgttgtgagaaggcgtgcactgcacacagacatgcatggcgccaggacgagtacattaaatgtccagacccattccagcaatagactaccaaatggaccgatgcgagtaaatttccaacaccacacccacgttcattataccagcggctacaggaagtacacattggccaccattagcagaacatttatggtccaagcgcattcagttgaggatgtgcggcaccgagaaaacatggttgccacgtaaaagccacccagcgtatgtacagtggaggcaacat

SEQ ID NO: 670214 - DNA, 448 bp, Homo sapiens
cctaagatcctttctgctaccacagcatctgtctacgcatggtcactgaatagttaagccagttgagactactgtaagaaaaggttctttcaaaacattactgttcattgacaacgcaccttgtcacccgagagctctgatggagatgcacaggtagttaatgttgttttcatgccttctaacacagacatgaaacattcattctgcagcccatggatcaagaagtaaatttgactttcaagtgtgcttatttgagaaatacattttgtgaggctataggtgccatagatagtgattcctctgatggatctgggtaaagtaaattgaaaacctcctggaaaggattcaccatcctagatgccattatgaacattcatgattcatgggaggaggtcaaaatatcacaacaggagtttggaagaagctgattccaactctcatggatgac

SEQ ID NO: 670215 - DNA, 904 bp, Homo sapiens
gtgctggcggcggctgctttggcggcggttggtggccgtgcgggcggggagggagggggaggagagaagaggaggtggagaaggcttgggctcgtcgccgtctgacagtcggcttacccgctgggccgtctcctgacaagcgggagggatccgcggtggacccagggaagcggaggagcctggcggccaccccctcttcctcacttccctgtactctcatcgtctctcgtgcctccgatgcacgaagaaggaacgtcaatagtgacgctgatggaacgatctgtttgaaagctttccaagatgagatgggattctcctaagctatggtaacgatgatggcccagaagcaggaggagcgtgtggctgagcctccaagctaactttatcacccctcatgctctacggtttgaggaactactggccaacctactactatgaacatacatcagatagcgaaggaactatttgaacagctgaagatcaagaaaccttcagccatgacagcactaaggatggtagagacaggttaaatcctccagtgtaagcgtagagttcatcagatccctgattctggagccctagcacaaagtgaagagactccagcagcatgcatgcagcagcatgttcagctcttgactacaaatccacctttcttgccatcctgcaaacccaatctcaatccggaggccagtatgcaccaggatatgtcttaagagagctgggaaccgtttgctcaaagctccgatcgcccttcgacatcagtacaacccgaatgtttcagacccttgttccaaccctgtaacttgatgggagctattgcagctgattgtagacttcagcacacattgtcaggcattgactgcgagcctcataaaatgtcaggaagactgccatgaatttcccg

SEQ ID NO: 670216 - DNA, 400 bp, Homo sapiens
  misc_feature (39)..(39): n is a, c, g, or t
  misc_feature (110)..(110): n is a, c, g, or t
  misc_feature (121)..(121): n is a, c, g, or t
  misc_feature (151)..(151): n is a, c, g, or t
gttagggagaggaagggatgatcacttgatacctattanctaaagttctgctaaagatgattaaagttcaggcatccttatctagcgggggggcagagaaaccccaaatnacttgggcaancagttccaaaatgactctcttatttaattngtggagggggaaagaggactcacaggtagccagctgaccatgactgaggtgccagctgtactttttataaacttgaatgataaagaatagggggggggggtactactgggcattagggcaatataacagcgataataaaattctctattaggctgggaatgtatgacatgatgctcggagtgggaaaaagatcattggggaggggggcgaaataatagggcttagccatgggattaaatatgtgggggg

SEQ ID NO: 670217 - DNA, 125 bp, Homo sapiens
atatctaattttaaactagggtttgttttccttcagacaaacttacatttctgctattttatctatctattccttttatttatactcaacatttgcttgaaattgtaagttagtgatgccgctcc

SEQ ID NO: 670218 - DNA, 429 bp, Homo sapiens
acccctaaaaagctttatttggtgctcgattatgtcaacgggggaaagctctttttccacctgcaacgggagcgccggttcctggagccccgggccaggttttacgctgttgaggtggccagggccattggctacctgcactccctcaacatcatttacaggtgaggcctgcctgtgggtcaaagccaggaccaagccctttttgctccaacagctaggggttggggggaccctaaatcctgatgaaatcctgggggacttggtcctttgttttgggggggggtggagtttcctcctccgagggccaagggcccagcctttttggggtttccttttgcatttttggcaacccccatgaatagttttcctgccagggcccccccccgcccaggtttccaactttccccaataaatgggtgagacccccca

SEQ ID NO: 670219 - DNA, 162 bp, Homo sapiens
gaagctttttagtttatttaggtcccatttatttatttttgtttttgttgcatttgcttttgggttcttggtcatgaattctttgcctaagccaatgtctagaagagtttttctggtgttatcttctagaattctcatggtttcagatcttaggtttaagtc

SEQ ID NO: 670220 - DNA, 874 bp, Homo sapiens
aggcggtttgccccccctttggggccgaagggtcgtgttgtgtggggcgccgcgattgttgggggctcccttgtgtgcgccgcggtggttatggtcccttgtgtggccgggagccttcctgcgcgggttttggggagcgggcggccgcgcatttcagttggtctggcccctctgggaaccctgatgcagcgggcgaggggcttgtggaagcacgctgtggtttagggcgactgccctgttgggactcccgtcctcttgcagcagggcgctcttcgagggggtcctctccttgggaggtggattccactcatagggccatccactatggggtgccccgcatctccccctctgtcttgctgttaataccccccccaaaagaaaagtgatcactcctttctttccaccctagtaaaatatttctgtaccccctcacttttgttatgccccaccgctcattccccacaatagctcccaagaaattggcacactcctcctgcacctccttctgaaaatgagatctacaacaacactatatgtcgtaccactattcgctatatatctattgggtacctctaatacccagggcgctcgtataaaataaataggaggaggcagtaccactcacttgtccccccaccaccggggtcgagtcattgaggggcccgctattgcttcagagttaaccagtccctcgcgcccaccgacagcacgaacctgcacgacagtgccactgaatgtatgggggcgatcagctacaaagaaacccccatgttgaggcgcccccagggttattactggataggaaagaggtttgccccacgagggcggaagaaataaattgtaagaggatccagaggaaagcgccccacaaaac

SEQ ID NO: 670221 - DNA, 138 bp, Homo sapiens
ctgtggctccgcctgtgctcccgtgctagctttcgcaggctgtggcatgtggatcatgaggtcaggagatcgagaccatcctgctcaacacggtgaattgcccgtctctgctacaactttgacaaaattcgcctgggg

SEQ ID NO: 670222 - DNA, 332 bp, Homo sapiens
agctcactgttgacggttgggggacaaattttgtgtgtttgctgataattgcgtttctcaggccttctttctgtttgtgatctgtgcaatattttcctcctgctcctccccatggcctcctgccccacagtgtggataaaaaggggaattaccactatctagtaaaatggagggacttaccatatgaccagtccacgtgggaggaagatgaaatgaatatccctgaatacgaagaacataagcaaagctactggagacaccggtgagggaatgagcttgtggattcaagggattctgacgatgagggcatgaaagccaaaactccacgcatc

SEQ ID NO: 670223 - DNA, 464 bp, Homo sapiens
agctcggccccatgaactttgtcacagagcccagcagagtttgatgaagtgcacatgtctggcccactgctgccactgctagcatctgagcaagtcacctgaaggcccaataattggccctccaagacccactaacgctgttgtcagtttaagccactctgtgggccctagcacaggcttattcaacccaccgctgccatcactagggcctgaagactggcccacctagcatcttagttcccagccaaacttcaccacagcctccactaataagtgcaccttaagtcaatgaggaagtcacagataccactgatgttgtatactgccaaataaatcatacaggcatcacactactataggcactcaaaatcaaagccaaagcaccctactcaacaaacaacacgtaaaatcttcaggaaaaaaatcctcccctatgaaagcaatttcaaaaatggaagaagtga

SEQ ID NO: 670224 - DNA, 174 bp, Homo sapiens
actctagggaaacactgacgaatggtcagagctcctatcctgatctttcatcaggcgcctttcctaatatatggtcaactgtgatgtagaggtggggggaggggggagaaaaggaacctctgcgtagaggattagaaaattagtacaatgttcaatacgagctcaaacaaaatt

SEQ ID NO: 670225 - DNA, 339 bp, Homo sapiens
acggtagattacagaccttttaaaatagcatcatgttacaatgaaatacatgagggctgggtgcagtggcttacgcctgtaatcccagtgctttgagaggccgaggcaggcagatcacctgaggtcaggagtttgagaccagcgtggccaacatggtgaaaccccgtctctactaaaaatacaaaaaaaaattagccaagcatggtggtgcatgcctgtaatcccagctactcaggaggctaaggcaggagaatcacttgaatccagaaggctgaggttgcggtgagctgagattgtgccattgcactccagtctgggcaacaagagtgaaactgtctc

SEQ ID NO: 670226 - DNA, 713 bp, Homo sapiens
tggatacagaactgtctagctacttagacagccctaacaaatctggacttctcttttggttgttgctctttgagactggagctttggctctttcgcccaagctggagctgaagctggcgcgacccttggcttcactgcaacagtccacccccaggttcgagcgacttctccttcctcaggctacttgggaagctgacggcaggcagaatcactggaacctgggaggtggaggttgcagtggagccgaagatcacgccattgcacgtccagccctgggccaaccaaaaggagctgacaacttccgttcgtcaaaagacaacaacggtgcagctatctgcggaagtgcttgttgcgacagtgcttctccctccagcgctccactctattctcccgagagccccgtgggttcccctgcgggggtctcggacaggctcaattagtgcgcatacacagtgtcggacaattctccgcaaacacgtctacaatgactcgggaccttccgggcggatattcctatagtcgcgcacaacccgcttacagaggcgtgaattaccacgcgccacggcatacgatcgcaagcgcctgtgttgcgaaaccgtgtgcctaaccaatgcgagaacaactttccacccaaggaatggttcgttgcaaaccgtgttcgtcgataccataggccgcaacacccgttggtccacaagcttccttatacctcc

SEQ ID NO: 670227 - DNA, 699 bp, Homo sapiens
ggtcacatcctgtgaagaagaacgaagggagcatgtagctatacatatgaagaacgatggacgatggagatggagcaggtgtttgagatgaaggtcaagagaaaagagttcaaaatactgaatggatctctgaagactgagagtccagaggcgccatgagcaaatgacgaaagaattgggaaggacagcacaatagtaatcggaggaaaaacgtcgtcagtctccgaggcatgacgaaatgcgacaactggttgaagctcaacaatgtattttagaacaatgagacctcttcaagaactcttggacaagacctcagtaaggtaaagggataccgatcttggaaattctctaatgaccagcgagtaaacgtattagttgccagtatgccagcattgtgacaatcagggttcgttgggatccgttggaccgattggcatcagttgaatccataatgatggcatttaccaagcatgtacacaaaattattccctcattaagggcgtagatggagtattacagatgtccttgattggttctagggatgtgcggagttgaaaggtatgagctctaagtacgttacctaattctctgtttacttacacggatatcttcaggtgaatgcatgagagctttcagtgtggtacaatcatggtctgggggatgacgttcaggattctcacatataacggttctgtgtat

SEQ ID NO: 670228 - DNA, 2454 bp, Homo sapiens
gcttaagcaggaggggccggaaacgaagaaggaagcaccgagcaaaaaaggagaagaagacaaagcggcggaaaaagggggagggagatggggggcaaaagcaagtggaacagaagtcatcagcaactctgcttctgacctggggcctggaggatgtggagcatgtgttctctgaggaggattaccacacgctcaccaactacaaagccttcagccagttcatgaggcccctaattgctaagaagaatcctaagatcccaatgtctaagatgatgaccatccttggggccaaatggagagagttcagtgccaacaaccccttcaaggggtcagcagctgctgtggcggcggcagcggcagcagcagcagcagctgtagctgagcaggtgtcagctgctgtctcgtcggccacccccatagcaccctccggaccccccgcccttccaccaccccctgctgctgatatccagcccccacccatccgaagagccaaaaccaaagagggcaaaggtccaggccataagaggcggagtaagagcccccgagtgcctgatggacgcaagaagcttcggggaaagaaaatggcaccactcaaaataaaactagggcttctgggtggcaagaggaagaaaggaggctcagagcgacgaaggtcctgaaccagaggctgaggaatcagacctggacagtggcagtgtccacagtgcctcaggccggcctgatggccctgtccgcaccaagaaactaaagagaggccggccaggaaggaagaagaagaaggtcctgggctgtcctgcagtggccggggaggaggaggttgatggctacgagacggatcaccaggattactgtgaggtgtgccagcagggtggggaaattattctgtgtgacacctgccctcgtgcctaccacctcgtctgccttgatcctgagcttgaccgggctccagagggcaaatggagctgccctcactgtgagaaggagggggtccagtgggaggccaaggaggaagaagaagaatacgaagaggagggagaggaagaaggggagaaggaggaggaggatgatcacatggagtactgccgcgtatgcaaggacggcggggagctcctgtgctgtgacgcgtgcatctcctcctaccacattcattgtctaaaccctcccctgcctgacattcccaatggtgaatggctgtgtccccgatgcacatgccccgtgctgaagggtcgagtgcagaagatcctacattggcggtggggggagccacctgtagcagtgccagcccctcaacaggcagatggaaatccagatgtcccacccccccgtcctcttcaaggcagatcagagcgagagttctttgtcaagtgggtaggactatcctactggcactgctcctgggccaaggagcttcagctggaaatcttccatttggttatgtatcgaaactaccagcggaagaatgacatggatgagcccccacccctggactatggctccggcgaggatgatgggaagagcgacaagcgtaaagtgaaagacccgcactatgctgagatggaggagaagtactatcgttttggcatcaagccagagtggatgaccgtccaccgcatcatcaaccacagtgtggataaaaaggggaattaccactatctagtaaaatggagggacttaccatatgaccagtccacgtgggaggaagatgaaatgaatatccctgaatacgaagaacataagcaaagctactggagacaccgagaactaattatgggggaagaccctgcccagccccgcaagtataagaagaagaagaaggagctacagggtgatgggcctcccagttctcccactaatgatcctaccgtgaaatatgagactcagccacggtttatcacagccactggaggcaccctgcacatgtatcagttggaagggctgaactggctacgcttctccgggcccaggcactgacaccattctagctgatgagatggggctaggcaagacatacaaaccatcgtcttcctctactcactctacaaggagggccacacaaaaggtcccttcctggtgagtgcccatctctaccatcattaactgggagcgggagttccagatgtgggcacccaaaattctatgctgggatgaccatacaacggggtgacaaggaccagaccggggccatccattcccgtgaagcaatggaaattctccctttggaaggacaacggcatccagaggggggcgcacgaaaagcttacacatgcacaggaacgacacacgaaacgtccacccgacaaccgaccaatcggcatgcaacgcaaccccatgaccaccgacgaggcggatccccccgagggaccgtcgcgccacacagaaggcgccacaccacacaagcgacaacgccagagctcacaggagagccacacacaacggcgacgcacacacaaatgg

SEQ ID NO: 670229 - DNA, 683 bp, Homo sapiens
  misc_feature (683)..(683): n is a, c, g, or t
tctcctgcggtgagcctggtggcactgcatgaagcaagctggatcacacaccagatgaactggacccacccgtgaatattggggcaggggtctagactcttgacgggctggtccaaaccgatgcgctcagatccggacatatgggctcactatgggccgccagggttttcggcagtactcaaaggatctaggtgctattaattcagactaaaagctgttgcttcaaaggattatacgacccatatactcattgaaataccatgataacatttggtatataaaataaacatttgaaaaaaaaaaaaaaaacatgtcggccgcctcatgccagccgcctctagccaggcgaatgtagattcatgcaagcttatgcatgcgtcccgtagtccaagctcacttgtccaatgcgccctataatgagactgatcacaattcaacgaccgcgggtctacaaaaacccgactgggaaaaacctgaagtgacccaacttaaatgccttgtaggacatccgcctttatacagatgaggtaataacgaataggccttcacaagaggcccttcccatgagtggcgaatgcagattggaaacgggaaaatgtaggcaaaaatagtgtgaaaaaattggcaaataagttcatgttgattaccggattgccatgtggacaacatcctgaacaggaccn

SEQ ID NO: 670230 - DNA, 1997 bp, Homo sapiens
tgagctcgtcagattccctttcatccgaagagccaaaaccaaagagggcaaaggtccaggccataagaggcggagtaagagcccccgagtgcctgatggacgcaagaagcttcggggaaagaaaatggcaccactcaaaataaaactagggcttctgggtggcaagaggaagaaaggaggctcagagcgacgaaggtcctgaaccagaggctgaggaatcagacctggacagtggcagtgtccacagtgcctcaggccggcctgatggccctgtccgcaccaagaaactaaagagaggccggccaggaaggaagaagaagaaggtcctgggctgtcctgcagtggccggggaggaggaggttgatggctacgagacggatcaccaggattactgtgaggtgtgccagcagggtggggaaattattctgtgtgacacctgccctcgtgcctaccacctcgtctgccttgatcctgagcttgaccgggctccagagggcaaatggagctgccctcactgtgagaaggagggggtccagtgggaggccaaggaggaagaagaagaatacgaagaggagggagaggaagaaggggagaaggaggaggaggatgatcacatggagtactgccgcgtatgcaaggacggcggggagctcctgtgctgtgacgcgtgcatctcctcctaccacattcattgtctaaaccctcccctgcctgacattcccaatggtgaatggctgtgtccccgatgcacatgccccgtgctgaagggtcgagtgcagaagatcctacattggcggtggggggagccacctgtagcagtgccagcccctcaacaggcagatggaaatccagatgtcccacccccccgtcctcttcaaggcagatcagagcgagagttctttgtcaagtgggtaggactatcctactggcactgctcctgggccaaggagcttcagctggaaatcttccatttggttatgtatcgaaactaccagcggaagaatgacatggatgagcccccacccctggactatggctccggcgaggatgatgggaagagcgacaagcgtaaagtgaaagacccgcactatgctgagatggaggagaagtactatcgttttggcatcaagccagagtggatgaccgtccaccgcatcatcaaccacagtgtggataaaaaggggaattaccactatctagtaaaatggagggacttaccatatgaccagtccacgtgggaggaagatgaaatgaatatccctgaatacgaagaacataagcaaagctactggagacaccgagaactaattatgggggaagaccctgcccagccccgcaagtataagaagaagaagaaggagctacagggtgatgggcctcccagttctcccactaatgatcctaccgtgaaatatgagactcagccacggtttatcacagccactggaggcaccctgcacatgtatcagttggaagggctgaactggctacgcttctccgggcccaggcactgacaccattctagctgatgagatggggctaggcaagacatacaaaccatcgtcttcctctactcactctacaaggagggccacacaaaaggtcccttcctggtgagtgcccatctctaccatcattaactgggagcgggagttccagatgtgggcacccaaaattctatgctgggatgaccatacaacggggtgacaaggaccagaccggggccatccattcccgtgaagcaatggaaattctccctttggaaggacaacggcatccagaggggggcgcacgaaaagcttacacatgcacaggaacgacacacgaaacgtccacccgacaaccgaccaatcggcatgcaacgcaaccccatgaccaccgacgaggcggatccccccgagggaccgtcgcgccacacagaaggcgccacaccacacaagcgacaacgccagagctcacaggagagccacacacaacggcgacgcacacacaaatgg

SEQ ID NO: 670231 - DNA, 101 bp, Homo sapiens
gtcagtcattacccacagctcgttagtacctccttcctctttatctggtgacctttctactgattgcattgtacctctttccctgatgggagcaagatgcg

SEQ ID NO: 670232 - DNA, 2132 bp, Homo sapiens
tgggcaccgctcaaaataaaactagggcttctgggtggcaagaggaagaaaggaggctcgagcgacgaaggtcctgaaccagaggctgaggaatcagacctggacagtggcagtgtccacagtgcctcaggccggcctgatggccctgtccgcacccatccgaagagccaaaaccaaagagggcaaaggtccaggccataagaggcggagtaagagcccccgagtgcctgatggacgcaagaagcttcggggaaagaaaatggcaccactcaaaataaaactagggcttctgggtggcaagaggaagaaaggaggctcagagcgacgaaggtcctgaaccagaggctgaggaatcagacctggacagtggcagtgtccacagtgcctcaggccggcctgatggccctgtccgcaccaagaaactaaagagaggccggccaggaaggaagaagaagaaggtcctgggctgtcctgcagtggccggggaggaggaggttgatggctacgagacggatcaccaggattactgtgaggtgtgccagcagggtggggaaattattctgtgtgacacctgccctcgtgcctaccacctcgtctgccttgatcctgagcttgaccgggctccagagggcaaatggagctgccctcactgtgagaaggagggggtccagtgggaggccaaggaggaagaagaagaatacgaagaggagggagaggaagaaggggagaaggaggaggaggatgatcacatggagtactgccgcgtatgcaaggacggcggggagctcctgtgctgtgacgcgtgcatctcctcctaccacattcattgtctaaaccctcccctgcctgacattcccaatggtgaatggctgtgtccccgatgcacatgccccgtgctgaagggtcgagtgcagaagatcctacattggcggtggggggagccacctgtagcagtgccagcccctcaacaggcagatggaaatccagatgtcccacccccccgtcctcttcaaggcagatcagagcgagagttctttgtcaagtgggtaggactatcctactggcactgctcctgggccaaggagcttcagctggaaatcttccatttggttatgtatcgaaactaccagcggaagaatgacatggatgagcccccacccctggactatggctccggcgaggatgatgggaagagcgacaagcgtaaagtgaaagacccgcactatgctgagatggaggagaagtactatcgttttggcatcaagccagagtggatgaccgtccaccgcatcatcaaccacagtgtggataaaaaggggaattaccactatctagtaaaatggagggacttaccatatgaccagtccacgtgggaggaagatgaaatgaatatccctgaatacgaagaacataagcaaagctactggagacaccgagaactaattatgggggaagaccctgcccagccccgcaagtataagaagaagaagaaggagctacagggtgatgggcctcccagttctcccactaatgatcctaccgtgaaatatgagactcagccacggtttatcacagccactggaggcaccctgcacatgtatcagttggaagggctgaactggctacgcttctccgggcccaggcactgacaccattctagctgatgagatggggctaggcaagacatacaaaccatcgtcttcctctactcactctacaaggagggccacacaaaaggtcccttcctggtgagtgcccatctctaccatcattaactgggagcgggagttccagatgtgggcacccaaaattctatgctgggatgaccatacaacggggtgacaaggaccagaccggggccatccattcccgtgaagcaatggaaattctccctttggaaggacaacggcatccagaggggggcgcacgaaaagcttacacatgcacaggaacgacacacgaaacgtccacccgacaaccgaccaatcggcatgcaacgcaaccccatgaccaccgacgaggcggatccccccgagggaccgtcgcgccacacagaaggcgccacaccacacaagcgacaacgccagagctcacaggagagccacacacaacggcgacgcacacacaaatgg

SEQ ID NO: 670233 - DNA, 889 bp, Homo sapiens
ggagctaaggaaggtggtggagtttcaccatgccagacggtcttcgtttcgtgagacatcgttcgtcgtccagtgggccgatctgatcatctgcaagacccggaggaactcggtcttccaggcagggcatgaagaacaagatcgtgatcttcgggctggttgaggcagccggccctggctgccttcctggtacctactgccccggggatgggacgatggccctggcgcgattgtagcccgtcatcaatgccgcagctggatggattctgtgaccttcgcctacagtttcactcatcttcgtctactgacgacaaatccgcaaagctcattcctgcgtcaggaacccagggcgggttgggatggacgaagggaaaggcatacatacatgatcctcaggacgcacagtcgagaagtcgacccgatcgtcatgtacccccggtgcccccgattaaagggacggcgaggggaagctgcaaccaatagtgagagggacccacaacgcaagataaccgaggtgatacacgtggagaaggcgaaagggaagcaaccctgggatacagaacgtaggaggggccgaccaccccgactctgcaggtggatgctacaccaagacacacaactaagagggggtcgaacagcggacccagtcagaaacaagacacacaaagtaaagaccgtacgacatcggacagagtaacacgcgtaactaagacacgagaacaaacagacaagagacacacacaagacgcagacagcaaagcacaaagcacaaacaaacacacacgacacgcaagcaaaacaacaaagagacaagcaaaccacaagcacaagaacccaaaagcacacaacgcgagcgggggaccgacagagcaaacagcaagcgaacaga

SEQ ID NO: 670234 - DNA, 189 bp, Homo sapiens
  misc_feature (4)..(4): n is a, c, g, or t
  misc_feature (94)..(94): n is a, c, g, or t
  misc_feature (116)..(116): n is a, c, g, or t
  misc_feature (161)..(161): n is a, c, g, or t
  misc_feature (174)..(174): n is a, c, g, or t
cctnagggcagagccctcattgacccaatcacctcttaaaggttccatttctcaatactgccccactgggcattaaatttcaacatgagttttngaggggataaatattcaacccntagtaaactgtaaatgtagatcacaaagctcactttttgattcanctcatcccctggntcagaaggttatatt

SEQ ID NO: 670235 - DNA, 153 bp, Homo sapiens
gaccgcagctctctctgatacggaaggagtggctaccagagcacgaatgatgaaaggtgtaaattctggaacaacgattagaacaaggaatggtattcacagaatatgaaagaattcttaagaggaggcagcagtgaagagggagtgcagcag

SEQ ID NO: 670236 - DNA, 868 bp, Homo sapiens
  misc_feature (868)..(868): n is a, c, g, or t
gcactgaatgatcctggtgtcgtcgcatgggccgcgtcccgccctgttgttaccggtattgtaagaacgaagccgtacccaaagtctcgcttctgccgatggtgtccctgatgccaagattcgcatttttgacctggggcggtaaaaggcaaaagtggatgagtttccgcctttgtggccgacatggatgctcagatgaagtatgagcatgctgtccatctgtaagccctggatgggtgcccgtaatttgtgccaagtaagtacatggtaaacaagttgtgggaaagcatggcttcccgatatccgggtgcggctccaccccttgcacgtcatccgaatcaacaacgatgttgtcctgtgctggggctgacaggctccaaacgaggacattgcgaggatgccctttggaaagcgcccagggacacttgtgaacaggtttcacataggacaaggtgatcatgtccatccagcaccaagctgtagaaccaaggagcatgtgattgaggccctgcagcagtggccgaggttcaagtttcctgggcagccagaagatccacgatctcaatagaagtggggcttcacgcaagttcaatgctgatgacaattctgaaagagcatggctggctgaaaaagacgcgatcaatcccagatgggctgtgagcgtcaaagtacagtcccccagataagtgaggccctcttggaacacaggtggaggggaccattgctctacagtgaagggcatatccaattggtgctagccacacactcgtaaatatgtacacccagataaacttactactataccttgttcaacaaccaagacaagcacagcagacgcctcagaacataaagcaactatcataaagan

SEQ ID NO: 670237 - DNA, 382 bp, Homo sapiens
ggagccccaggcctgttcccctcaaatacctgggattacaggcgcccgccaccacgtttttctaatttttgtatttttaatagagacatgcgtccaccatgttggccaggctggtcttgaactcctgacttcagatgattgcctgacttggtctcccaaagtgctgggattacaggcataagccactgtgcccggcccctccattgccatttgatagccgtagtttgtttacaatttacaggtttgaatgagttcattcaacctgtaatcttgtggagcataccgtgtgccaggcactgagctaggtactggatctgtgaagatgactaaggtatgatttttaccattaaagagctcatgactttgaggggaaaagaccctg

SEQ ID NO: 670238 - DNA, 957 bp, Homo sapiens
ggccgggggagacgcacgcagttgaaattgtttcgtccgcacgatgtaccagaggtctccagagccttctctctcctgtgcaaaatgcaactcttaaggaaaaattcatgtgcaccaggtgtgggaagaagaggcaacaggttccaaacaattaaaggatcacttgtagtgggtgtgtggaccaaggtggggtatggggtggttgataattcaagcatttggtgggaagagtcttcgtggttgatgaactttgtgctctgtgtgggattgttgtggaaagataagggctttaagggggacgacttggattggatcttgcaggcaagtggggacgcttaattttctttacaggaaccttaaaattgtgtggcacgataacgagattaatcctgtggacccggccaatttctaaagatggtccgtgggccacacggcaggaggctccgtaccaccaagaaggggaagcagtccgcctcaactctgtggccacacggacactgggtactgtcctcacaattcataattccctccaagattcgtcacggtacaggtcttgatggcatcatacttgtggtgggttccccaacccaagtgcacatttcttacggtattgttacccttggaccactatggtgcattacccaaaaacaccgcgtgcattgcacaggtggctgtagtcgtggatcctgcaagaataccggtaccttagtgggtggaaaactgtgccattcaatcccaggcagctgccaggatggcattggcgggaacatggcaccccaaggtggggcgggctggcagggcggcaacgtgcaggggtccctcaggatgatcccgacggcactgcatgtatctcacaactgccgccgcgcacaggcggcaagccaaagtcaaccaaagtgaccacggggcgaagagggcgggcaaacagcgaacaccgcctccccaagagggtctcaa

SEQ ID NO: 670239 - DNA, 432 bp, Homo sapiens
ccgtacgcttctgctacgctgagcggagaacaccacacacggagagcatcactttgaggtgagtattgctccccactcaagggctcgccatgcctcaccatccccgtctactctctgatgtgcgtggcttccacgacctccttctccactgggccgctggacccccggctgccttgaattggtctagaatgcacggagaggaaccctacacaccctctgtcagcgccaggggactcagcaccccatcctcagccaggtgcagcaggcctgtgctgatgccaggacccagatcacggacagcacggtagtagcgtatgcagtcaacacgcagcaggctgtcatcctctccaaaaagcaccttggacgattcgggagtgtgaccgtgctggcgggccgcctcgggttggctggcgcgtgacaggggatcctcta

SEQ ID NO: 670240 - DNA, 265 bp, Homo sapiens
  misc_feature (12)..(12): n is a, c, g, or t
tacggaggtggntagtgtctggtcgtatagtctaggtctttaagtccagttagtagtttcttttcgtgtgtggtgttagggagtgtgtaatttcattcttttccatgtggctgtccaggttttcctagcagccacttattgaacaagctgtcctttctccattgtatagtcttgccttcctttgtcatagatgagttggctgtaggtgtgtgggtttaattctgggctttctatcctgttccactgatctatatttctgtctttg

SEQ ID NO: 670241 - DNA, 162 bp, Homo sapiens
atgactcacttggactccatgatctatttctatagaaagactaaacaacgaagtcaagtcctacggagtcgcgaggggtcagagggtttcaccctgataacgtccggcccattttggtcccccgttggggcacgcatccactttcccagtgtatgtgcatgg

SEQ ID NO: 670242 - DNA, 327 bp, Homo sapiens
cgtgatctcccagaagcctgagaccaacgaagacgcgtgtgacgctgccctacggcacaaagagggttctctcctcagccaacagagctgtggttggtgtggtggcaggcaggtggccgaatcgacgatcccttcgtgaagggtggccgggcgatccacaaatataaggcaaagaggaacggctggccacaagatacggggtgtggccataaagtccggtgacgcatcctcttggaggtggcaagcaccagcacatcggcgagccctccatcatccgcagagagttccggtgtcggccgcaaagtgggtgtcagtgctgcccgccgg

SEQ ID NO: 670243 - DNA, 521 bp, Homo sapiens
cgtaacatagcacagcctctacggatctatactactcggatcatccatctccaacctgcctgcagctcctatgcttagccactgagcttcagcgcgtactagagcgctatagctacacgaggacaccacaaggattctctccccaggaaccactggcgctcacctggatcaagttcatagtagaacatgttatgggggaagcgtccgccacacatgcagaagggccagaggccaagagatcaatgagagacctcctggctctactggcagtaatcataagagctcccaaaagtaataaaaactggctctacttttatgaggtagactatcactccaggaggctcacccatatcagggactccaggccgtcctacttccactgagaagccagtcagtcattgcgattccttcccatacgaggatcagttttacaagatcccttctctatcttctgcaaagcttgctccaacctgataatttcacttagtgttctcagacgactagctggagggggccgcgcg

SEQ ID NO: 670244 - DNA, 973 bp, Homo sapiens
  misc_feature (228)..(228): n is a, c, g, or t
aaaaaacatggtgctgtggtttagaaagggatgctgtgttgcaacggttaggtgtagggaaaagaaagacagatcagactgtccctgtgtctatgtagaaagggaagacataagagactccattttgaaaaagacctgtactttaaacaattgcgttgctgagatgtgttaatttgtagcttgccccagccactttgatccaacctggagctcacaaaaacgtgtgtntgtatgaaatcaaggtttaagggatctagggctgtgcaggacgtgctttattaacaaaatgtttacaagcagtatacttggtaaaagtcatcaccattctctagtctcgataaaccagggcacaatgcactgtggaaagccacagggacctctgcccttgaaagcagggtattgtccaaggtttctccccatgtgatagtctgaaatatggcctcgtgggatgagaaagacctgactgtcccccaaactgacacccgtaaagggtctgtgctgaggtggattagtaaaagaggaaagcctcttgcagttgagttagaggaaggcactgtctcctgcctgccctggaaactgaatgtcttggtattaaaaccgattgtacattcagttctgagctaggagaaaaccgcctatggtgggaggtgacgacatgttgcagtaatgctgtctgttattcttttactccactgagcatgttgggtggcgcagaaccattacatctggcttacgtgcaccgtccaatcatagtaccttcctgacttattatagaataatgcttcgcacgtttgtgttgacttctcttaccgtgctctacaactccttcgcgaatatgatctaaaacaggggaaacagcggggggagagcatgggacgggccccgccggttcacacagaacaaacaaaaaaaaacacaacaaacaaggggcactgcgaaacttgaaaacaacaagagtatgtatatccttcac

SEQ ID NO: 670245 - DNA, 223 bp, Homo sapiens
gtccctcacaagaccctggaactcttttaagaagaagcgctcagcctctaatcccaacaccttgggaggccgaggcaggtggatcacgaggtcaggagttcaaggccaacctggccaagatggtgaaaccctgtgtctactaaaaatacaaaaaatttagctgggcgcagtggcggatacctgtagtcccagctactggggatgctgaggcagaagcaggaag

SEQ ID NO: 670246 - DNA, 1053 bp, Homo sapiens
  misc_feature (601)..(601): n is a, c, g, or t
ctaacatggaagaccgcagaatcttagggaatggggttctagaggtgatgcagtgcatatggctcacgaacgagaaaggagtgggtgacaaatgtgtcatgcctggagacaagctccagtcgccagcactctgcgtagagactcgcgtacatgcgcacatgccagacgggctctgggtatcgaggacacgcgttcgaataactttgttaaaggagataccgtaaggacctgctgaagaatgttctcgtgccgcatacatgtggcgatctgaccgcaggggacctatccccagaagtaagaatgctgacgtacatgaagccgagagccttgtggtcctaggggaccacatcaatcacctttctgcaatgcattaactgccaagcctggtgaatatcatatacacatggcagaaagatgctctggctggttcatcatcacctctttactctggagctgtgaagcaaagctagtcttctgccgttagatttacaagtacactcacagagtcagcacatgcgctgggcacaataggttctctagcgtagagggctgcacaggacattcgcagccactgagacaaccagcttggacgggtagacanttcttgacgacactcggtattgcgctcgagtagtaggtacctatgactggatcgactcaggcgaccgactacgatctagtcccaaaagactacttgtctcactgcgaattgcgaggtggcttgtcaccaaggcaaaacaattctagaccggggcattgaatgcgatgcagtgccttgtcacaaatcatttgctaagagcccctgaggtgcaagggggaggaccccccttgacctgtgggcatgccagatgaatccccaaggacccatgttcattgaaaagatttcttttaacgggaagccttatcttcaagaggaccaaaaactcaaggaggacagaggagtaacgggagagcctcaagaaaactccggaagaactgaacccgtatggaagaccagctggggacaaaggggccggttgtccctggctctcagagcacgggtgatggagacca

SEQ ID NO: 670247 - DNA, 313 bp, Homo sapiens
gagcaagactctgtctcaaaaaaatataaataaaaaaataaaataaaattgctgaatgtagtgggttgcagctgtagtctcagttactcaggaggctgtggtgggagaatcatttgagccaggagttcaaggctgcaacgagatatgatcatacaactacacgctagcctgtctgacaaagcaaaagcctgtctttaaaaaaaaaaaaaaggagcttttagaactaataaattagtagggtcagaggacataagatctttagacacaggactaccagcaccaactgaaactaaaaatttttttttttttgaaa

SEQ ID NO: 670248 - DNA, 647 bp, Homo sapiens
tcagccgcccctttgccactgagagccccgggatgtcctcaccggatactttccatagtgaccggtggccacttggctaatagaatatcggctgatattgtccactaatccttttgtaccctgcacctggcgttgtctaattaaactcggacccctttcttgtgaaatcacggtaaataagacttgtctcggtcaccctgtgcccctcgtccacgactcgaggcccgctggtaaccctgcacccgtgctatgtggcttctctttgaggatttttgggttttgtaactaaattcttgctgccctcatactttttatgtattagaatcatattcgtattgcccttttaaaacccttgggaatcctcccaaggcctgccccactgtatttacccgtaatacacggaagcactggcacggcacccactgccaaccccaggatggactggtcccgtccccgtgtccgtggccggtggtttcctgcctggcctggaatcactcatcaccctgattgattggctctgctggtcctgggccgcgtgcctcataggtgtgtggatatgatgacctttctttaaaatgtatgtactttaaccaatacttaattgtattaaggtcatgtacccaggatttgataaagtttaaataatt

SEQ ID NO: 670249 - DNA, 400 bp, Homo sapiens
aactctactcccaggttcaagtgattctccggccgcagagtcccgagtagctgggattgcaggcacctgccaccatgcctggctaattttctggtatttttagtagagatggggtctcaccgatgttggccaggcgtggtctcaaactccatggcctcacgactccaccatgcctcgagcctcccaaatgtgctggtgattacagtgcatgagccaccagtgcccgtgtcacgtagcagcgttttgcaaatgcttatgtccatctacttgactcccgatagtaccgacaactgacgatggtttccatgtggcgtttgccttgatcaccgcaggacaaagctagacgggtctaccctatttaaatacagctgtggtacagtatagacaaggtagagccgag

SEQ ID NO: 670250 - DNA, 190 bp, Homo sapiens
  misc_feature (90)..(90): n is a, c, g, or t
ttttcctctttcgttgttcgcctaaggctgctgctgtagttatcgtcgaagagctcttatgcgtgcatcaatccgctcagtctgattggnccagtcattgtgtgggctctcgtctggtcgcccccccttttggttcccgagcatgctgtttttctctcagccttctctccaaccttaaccaaatcggcag

SEQ ID NO: 670251 - DNA, 631 bp, Homo sapiens
ggagagagagagagagagaactccgcgagcgagtcgtctgacacggagctgccagagaaggagcgcggcggggaacccaaggggcccgaggacagtggtgcgggaggcacgggctgcggcggctgcagacgacccagccaagaagaagaagcagctggcggcaacgtacgcacttcacaagccagcagttgcaagagctacgggcccgtcagaggacgtacccgatgacatgagggaggagatcgcgtgtggaccaactcaccgagccgcgcgtgcgggtctggttcagaaccgggagccaagtggcgtaagcgcgagcgtaaccagcagctggacctgtgcaagggtggctacgtgccgcagttcagcggctatgcagcctacgagacgtgtacgccgcggtactcctacaaaatgggccgcagagcctggcgccagcgccgtctcacaagagcttacttttcaatccatgaccgctgtgtgcagtccatgtctagacccagtcattctcatgacatgcgtcagatgggccagggcgtgctggatgccactcgggctcaaaaatcaaaactcacggtctcgtcatcggctgtgcggggttgccgtacggatccgctgcctacaggttacg

SEQ ID NO: 670252 - DNA, 1324 bp, Homo sapiens
ttttttttttttggggaacccgggttttattttattagaaaggaaacaaccaagcaccccagtgtctctgtgccgcggaattccgcggggggaaactgtgccaaacagcgcggggaatgcgcacccagcccactgtgtcgtggggaggtcctcttctctttctcgaggccacagaaatataaaccggtggtcacttcttttattgtgtgtcacgccacaacatatatcacccagagaaaaaaggtataaacgtgcacgagcccaagagccgaggaacgatgacacgatgttaatgtgatgtcattctccaactatctctccaaaacacctcgagggggacgcccctttattaaaccctttagagaggagggagagcccttttgtgtgcttacccaccaaaagagcccaatctatctcacacagagacccgagggggctatttgtattgtttatgccacacacagagacatattacatatatagcgggggaaaagagggggataccccttatagaaatttatcatgtgttctcactttaaccgcgcctcttcaacagggagaaacagaaaaccccctgtggagaaacccccgtgggtgtgtggctcataagcacatctctatctcgcccacagactatatttgtgttcacaccccctgtgtgtgttgtgggagaacagacatactgtgggggggcggcaacgcccccaagagaaaaaaaggtctctctctcacaaagagggggggctcttgtaacagcagagcgggggagcacacaagatatgtgggcgctcttgacaggggggggaaacgtcttgttgggcagttataccagtgttcgtcggcacacgtttgaggagaacaaagcaggggagaaaagtctctctttcacaagagtccccagtgttggccgctctcgcctactaaaattctctagagatatcacgcaacagaaggcgaagcgcgtatctactaagaagtatatcccctctgcgagaggggggggcccccacagagttttttcaccgggcttttacccccacgggtctctttttttgtggtccccacagggtggtgtgcccctaataaggggggaacagtcgcgattattatataaaacggctaatgagacactggtggcccgggtctcgttttatcacaaccgtgtcggtagatcgtgggcacaacaatcttgtgtgaacctttggggggactccctttggtggcagaaagggcactttatacttttctgggtggggtgttggaacatttatcttgggcacacaattcaccttacagcgaagatttaaaaggcgtttcaaggggg

SEQ ID NO: 670253 - DNA, 811 bp, Homo sapiens
tgcgatggctcaagcctgtaatcccagcactttgggaggccgaggcaggtggatcacctgaagtcgggagttcgagaccagcctgatcaacatggagaaaccctgtctctactaaaattacaaaaaatcagccaggcgtggtggcatgtgcctgtaatcccaggtacttgggaggctgaggcaggagaattgcttgaacctgggaggcagaggttgcagtgagctgagattgcaccattgcactccagcctgagtaacaagagtgaaactccatctcaaaaaaaaaaaaaaaaaaaggggccacgggacaagtatacagccttttataaaaggccccagaagaaacacccttctcgataccttgaccttgggactttctagcctccagaaggttgtgacgggaaataaatctcgtgtggttaaagccactttggagccttgggcaacttggggttagggcagcccccaaaacttaatactttaaacaattctcatctcgggtccatacttacatcttttcgtgcccaccttctttaacacttgggtatccctcaggagctctacaggggcccctccttttcgcccggtgaccataacgtcctccccgggggactaacgacaggcgggctctacaattaacggacttgggaatttcacgaagtggcttcagccctaccaatcttaaacaagcgtggccgtttaagtttcccccaaattctacatttcgaacttctcccttgcgcgggtcattacacacaagcacacctacgcacacgccgaccaactacttttcggcgcgcagcgagaccag

SEQ ID NO: 670254 - DNA, 503 bp, Homo sapiens
catcaggtttcatctacgtcctcgtgctcaactagtatgcagctaatatatcttccatcaggacgatgaagcgctgatttgtcatagtgatttccttgcatgcgccgtggtttgccgcccttcaaacatgtagataccatactggaatgcagcctggggcaaagcttctttgttgttcatatactcgcgtgatattcttcactggcgctatcaaagtcccagagcgggctacagggccccttcttgtgaccctggtccattttgctatgatccatcgtcctcatcacgtatccaaaggcaagtcatccatcgtggctgggtagcacgctgcataactgttggacatgccaaagaaatctcccagctgctttttgtcttctggcttcttcagcgattctgtgccttcccagccagcagacccagcaaacttttcattgatggacttgatcaactccttggtagacccaggtcctttgtcaacgtccatgggctcatcatctact

SEQ ID NO: 670255 - DNA, 153 bp, Homo sapiens
taaaaaaagacccagaaagaaattgtcaaaaaccaataaatgaaatcccccaactccccagaaacaaagcatacatcattattttggccgggactacacccccgaccaataaaatgaaaacccatcgttgtatttcaactccaagccccccca

SEQ ID NO: 670256 - DNA, 1326 bp, Homo sapiens
  misc_feature (375)..(375): n is a, c, g, or t
  misc_feature (466)..(466): n is a, c, g, or t
  misc_feature (496)..(496): n is a, c, g, or t
tattctaagggggaaggccccttttaataaaactgggtacattttaactttctcctttcttttcagaaatgtgcttaattaaaaaaactttgtgtggttatatacttataaaaaaccattaaatctcagcacaaacaaagagaaagcgattccaacactcactctcgtggtgagtgagaaaaaggaggcaagtggcaattctcaacattagagccaagagaaaaacttcttacgcgtgggaggaacagagaaaattcggactcaggcggaggcaaaacaaccgcgggggcgtggcgtgccgagacactgggcgagggccagggcggagggagggagccctcctataagaaggattttcccaagagccacacaccncaattccgcgtggccgagaaccgaggagaagcccagcccgcggtctcttacactctccgcgagagagaaaaagcgagaaaccctttagagngccctatagatgtggaatccactttcaaanatctcgcggagtctacaaactcgcctttctattttttctacaaaaaaagaggcctcaccacattatgctcctccccttccctttcccacagttccctcgtgtggcggaccggcgggcgggcgccccggggacccattttgtgtttgttctcctttcaccccaagcgtggcccccgtggttcatcctcgcgagaagcctccaagaagggggtgccgcccggggcagcggtctcccttgggttccccctccgggtggcgcacccccggggactcaggggtttcagaacccctgtggggggtgtctcccccaatgaacacacatggcgtatcaaccccatattcaccggaaaaaaggcccccctggcataaaaaaaacacacccacactttttggatcccccaaggggggcagggggggaaggaaatccccccgtggaggaggcagaaaaacacggggagacacaagtagggggggcccccccaaagaggggcgacacgcggtcatataggccccggaggcgccccacaaagaaccaaacttgcgcgcaagattccccgacggaaaagaccccgggggaaagatgtacagaaacgcacagacggtaggggggagcactactacaaaaaacaaacaccgacagcggggcaaaaaaccccacttcgagcccgtacaacaaaacaccaactacaggaggcagcacgcccgacttacatggcatgacgaaacccgaatatataagatgtcaacacaacacacaagacaagcaaccacactagacactgcccacagaaggatcccaccacaagcactctagcaccccgcggacgacag

SEQ ID NO: 670257 - DNA, 199 bp, Homo sapiens
  misc_feature (12)..(12): n is a, c, g, or t
attcgcggccgnggtcgaagcatagtgtcacgcacctgtgatcccagctacttaggaggttgaggctgggaggatcacttgagcccaggagtctgaggctttagtgatctaagatcatgccactgcactccagcctgggcaacagagtgagaccctgtttctaaaaaaaaataaagttagctaaattatctgtcgacgc

SEQ ID NO: 670258 - DNA, 309 bp, Homo sapiens
agggggggggggggggggggggggggggttttttttacccgggtttttttttttcccccccctttccccggggggcccccccccccttttttttccccccttttaagccccggggggggcccccccccccggttttttttttgggggggggggggggtattttttttccccgggggcccctttttccccttgggccctttttggggcccccttaaaaccattttttttccaaaaagggggggggggcggggcgggttttcccggggtttttttcccccccggggcggttttttttttttttccccccca

SEQ ID NO: 670259 - DNA, 1129 bp, Homo sapiens
atcagttgtgtcctccgcctttatttagtttattcgacttattgtgtttccgcaggctctaactgaatttttgggcaaccttttggccacgaataagagagcaactaaggcgaaaatactcaaagtcgccagcgatgttatgtttccagctgcaaaatacctttgcagtgggcccaaaaattcgttatacggcacttggaattgcgggcacgtggtttgaggagtggcctcgtgggttatattccctttcttcagcaaacggggacaagaggcttcgggacgtgtatttgctgtggctgaattattgtgtacattcttctccttgcctcaagaaaattaaaagccggtgctctccaattacctcccagttcgcgttagccagtgtgagatctccagaacttccaaacgtgtctcagtgcgggcaattatctcagcttttcgctttatagctttctccgcccacagacttcccaaagcggcatagagtcgcgtgacagacggtacaattcggccgaaagaagaaagaaagataaaccgagttccccggttagtgtggccacccgaaggaaggcttgtgaatctcagggtgcctcgacaagttgtgctcgctcggaaaagcctcttgtgcaccggctttggctctaagtgtgctcatttgaaagaaagctctaggaattctcgctcatcgtgtgactctcgccatgtggatatagaacagtgggtatccctcgccttgaagaaacaccaaagcgggcctcctttgctggggctcatagattggattcccaggttgttgtccaccgacgtggaccacatttggccgacaaggtctcctccagttgggcacgtttctgggtccccatgtcctcattatcccacgcagtgttggccatggtttggtggaatgggacaaccactttgctgtgccggtcaggaagtggcatccaatcggtgtcgtccacacgccgaaaaatcctgggccaaggtgcacagccccaagaccagggctataaaaaccacgcgatactatggtgcagcaatttgggctgggaatctgagacgggagttgacccgtgcgaattcggccgaatcccgcaaagtgcgatattcgatgcggtccctatggacg

SEQ ID NO: 670260 - DNA, 1495 bp, Homo sapiens
  misc_feature (13)..(13): n is a, c, g, or t
  misc_feature (815)..(815): n is a, c, g, or t
caagctttggtgncacacgacacttctctgtttgacacgcttgttggtgtgactaccacgaggaagtggctgcttcaaagatctagcccccctgttttctcggcgaagggtgtttataccacaaggggggaccacctgtgttctcactaatgtggagagaccctgtatgtaagagaccacgtttgtgccgccagacgacccagcaagaagggtgtgagcgccccgcccctttagtgcctcgtgtcgcccacaggtggtttgttggggaacccaacaaaagtgggaaggcctgactcggatggataacacaaagaagagtgttgtccactgggaggaaaaaagagggttgtaatcaaccaggagatattttctccccacaggaccacttatatacccctctcctcttcttttatagaaaacagaatgtccccccggaattttactcccccccccgaaagctcaaaacgggtgtcccaccccaccagctgcgtatatttatgtgtacactcttatattataccacgcccgcctctttggggagaccccccccccacttttggtccccttcccccaccccctcctgcgccccctgtaaagccttgggggttctcacgaaaaaatctcctgggtgccaaacccactttgcataaacaaaattcttgccaactcgcatgtcacaagacccactaggcacacttttgtgttaccacaacgcttctctcttggaaacaaccaccacctttgggggatataccgcaccccccaccgcgcacgaaatttgtattgttgcctcaaattgtgcccctctgataagngaccacaatagcccgccccccttctctttggaggaccccacagcgtgcacacagacacacaccccacatgtgcgctgtgaaaacaccctcggcgcccacacacacgtgtgtagagggcgaacactctgtggcccacgcccacttgaaatgtaaccggcgagttgaaagcaaagctctcgtgggaaaaaggtgaggcgcaccacattgtgggcgaagtctgtgaagcaacacacgcgggtgttatatacccctcaaaccccctcggtggagaactctcgtcggtttaaccacgcgcttaacacatatagggtttgtcccgccttacactattaacacttctaagcactccccactcccacatcttgacaccctcgggggccaagggtttctttcttgacaagttggggtcttaataacccctccccctcgagtgaaaacacacagacgctggtaagctaaggggttggttaatcacatcacgaaagagtggtctcccctcacggccctgggggaataaaggaacctgggcccacagccaccaatgcccaactcacatgtcccaatatctgctttgcctggtgttggggaagagattgggtcttgtccccccaccccccttctgtggctgactgtaatactgtaccaccgtttctgaccccttaaaagctgttgtactctga

SEQ ID NO: 670261 - DNA, 938 bp, Homo sapiens
tggacgcgtggtctaaacctatccgtccgagccgcccatgcgtatatgtgcctcagctcacctcggtatatcttgcgatccgtaattttgacctcgatagtaatgagactatcgtctactggccagaacagttatatgagcagttcgcgttactggagcttgatgcatctctagtgtaatcttcgttagggaagcgtactcctgtgagtcgccgtcttacgagaaggcttcgtacctagcagatgcataaaaatcgtctatggcttatattagtagatatttagggtcgcatatggttgttaatacatagaccgtcctctgtcattgtcaaggacgaagaattatttgctatacctgaaggtctggattcttatgagccattttcatccgacctggagactctgactacagaagaattaatggtgtttaggatacacggtcctttatgacctttatcatagttagaagatgaggaattgggcgcaggggctcacgcctgtaatcccagcactttgggatgctgaggcgggcagatgacgaggtcaggagttcgagaacagcctgaccaacatggtgaaaccctgtctctactaaaaatacaaaaagtagccagacgtggtggcacatgcctgtgcatgtgctgggattacccagctactcaggaggctgaggcaggaggattgcttgaacctgggagggcagaggttgcagtgagtcgagatcacgccactgtactccagctgggtggacagagcgagatttccgttcacacacaaacaaaaacaaaacgcgcgggtacaggggcccccactatattcccacctttggagccgcgcggctgccccggtccccgaataccctctgtccccacggaaccccctggctaaaaaacattccggtcgggccaccgaacacaacaccgcgcagcgaacgtacca

SEQ ID NO: 670262 - DNA, 398 bp, Homo sapiens
cacaccacctgagtcatgtgttgccttacaatgttacaacacctacaatgttgctaggcaacaggaattctttagctcgattataatcatatgggaccaccactgtatacgtgatccatcactgaccaaaatgttgttatacgctatacgactgtatattttaaggctatcaaaatcaaaacagcatggtactagcataaaaatagacacactgaccaatggaacaggacagaaatcccagaagcccacacattaatagtcaactgatgtttttttttacaaaggtgccaagaacacacaatgggaaatggacaccctctttaataaatggtgctggaaaaaatgaacatccacatgcagaagaatgaaactgcatcttcatctcacaccatatataa

SEQ ID NO: 670263 - DNA, 1607 bp, Homo sapiens
cgggggtctccatcctggaccaggacctggactacctgtccgaaggcctcgaaggccgatcccaaagccccgtggccctgctctttgatgcccttctacgcccagacacagactttgggggaaacatgaagtcggtcctcacctggaagcaccggaaggagcacgccatcccccacgtggttctgggccggaacctccccgggggagcctggcactccatcgaaggctccatggtgatcctgagccaaggccagtggatggggctcccggacctggaggtcaaggactggatgcagaagaagcgaagaggtcttcgcaacagccgggccactgccggggacatcgcccactactacagggactacgtggtcaagaagggtctggggcataactttgtgtccggtgctgtagtcacagccgtggagtgggggacccccgatcccagcagctgtggggcccaggactccagccccctcttccaggtgagcggcttcctgaccaggaaccaggcccagcagcccttctcgctgtgggcccgcaacgtggtcctcgccacaggcacgttcgacagcccggcccggctgggcatccccggggaggccctgcccttcatccaccatgagctgtctgccctggaggccgccacaagggtgggtgcggtgaccccggcctcagaccctgtcctcatcattggcgcggggctgtcagcggccgacgccgtcctctacgcccgccactacaacatcccggtgatccatgccttccgccgggccgtggacgaccctggcctggtgttcaaccagctgcccaagatgctgtaccccgagtaccacaaggtgcaccagatgatgcgggagcagtccatcctgtcgcccagcccctatgagggttaccgcagcctccccaggcaccagctgctgtgcttcaaggaagactgccaggccgtgttccaggacctcgagggtgtcgagaaggtgtttggggtctccctggtgctggtcctcatcggctcccaccccgacctctccttcctgcctggggcagggctgactttgcagtggatcctgaccagccgctgagcgccaagaggaaccccattgacgtggaccccttcacctaccagagcacccgccagagggcctgtacgccatggggccgctggcggggacaacttcgtgaggtttgtgcaggggggcgccttggctgtggccagctccctgctaagaaggagaccaggaagccaccctaacactcggccagacccgctggctcccaggccctgagaggacagagatgaccacatccctgctggatgcaggacccgtccaaagatgccccggggaggggtgtcagcccacgttgctggcctttggggtcaagaggagtagggatcccaggctgccctggacttagaccagtgtgtgaggttggacttagaccagtgtgtgaggtggtaacagcggccgcagcagggggttggcctagacctgggatttgtggggaaagctgctggtgtgaccagctgagcacccagccaggagacctgcagccctgcgccttccagaagcaggtcccaaataaagccagtgcccacctgaaaaaaaaaa

SEQ ID NO: 670264 - DNA, 662 bp, Homo sapiens
  misc_feature (444)..(444): n is a, c, g, or t
gttagaaaaaccacccccccctcttcgaaaaaaaaaaattgtggtgggggggaggagcgtgtttttttattcggggggcgcctttttttataaaaaaaaaacttctttttttaaaaaaaaaaaaaaagggggggcaaaaaaaaaaaaactcccccccccccaaaaaattttttaaaaaaatttttttttaaaaaaaaaaagggcccccccccttttttttttttcaaaaggggggggggggggttttttttttggaaaaaaaaacctttcccccccgttttttccccccaaacccccccccccacatttgttaaaaaaaaaggggcgccgggtaatttttctccaaaaaaaaagaaagaaaaaaatttttttccccacatttttggggggccccaacaaccaaaaacaattttttttttaaaaaaaagaggcttcccccccccntatttttcaattttccccaaagggggccccttaaaaaaatctgagaaaagggcaaccccccgggggtgttttggttttttttttccccaaattttttaaccgggggaccccccctcttttttgtgggctttttgggaaaacccccccctgggaataacccgggctaaaaaaaaaaagaagggaaaataaagggttccccccttccattgcgccaaagg

SEQ ID NO: 670265 - DNA, 836 bp, Homo sapiens
ccacgcgtcggcttccgctccctcacagctcccgtcccgttaccgcctcctggctggctcgctgcctttcacgcggcaccttgcgtcgtgtctgcgcctgggggcctgctcctgccgcgcgcacccccgggggcttcttggctccggcacgggtcgtgcccagtttcctgcacctgagtgcctgccggccagccggccgccatggtgtgcctacctctctccagcccagacacggtgaagtgctccgtgggactggggtctggtgccccgtgccgtgcctgcgtgcccctacctgtgcttctccgccatgcaaggctggggcgtcttccatggagtgatgctcacaactgtattcctgagctggacagtgagacagccattgttttcttgtctacgatgagacatgtgagggggaggcaagttgccttgtactgtgccaaatatcttcctagaatatcatccagaacgatcagaatggcctacatagggaaggcaatgctacaagcaatggcttgtaagaagatgccttctatgtgctatttgacgccaaatttgaccactgaagaagtcattaaagaggctggcacagatatgcatgggcgaaccactgaggatgaagatgacacaacgaaaaacgtagctgatgaacgactgattgtgtgacacatgaggaggctgcaactgcttgcatgaagaggctaccattgactaatttgaagagctgctgacacgctacgggcagaactgtcacaaggggcctccccacaaggaaatctggaggtaggggacaggcgatgaaaccagttgtccagtggctcaatgggggaaggaggact

SEQ ID NO: 670266 - DNA, 151 bp, Homo sapiens
atggcggcaccctatgtacactgttcttctgcctaagcttgccatcctattgtggaataggattatactaaaacatttaaagacctgggtgttacatatgtgttgtgtgaagcttgttaccagttgtatggacaaaatccaccaagatcca

SEQ ID NO: 670267 - DNA, 1185 bp, Homo sapiens
  misc_feature (586)..(586): n is a, c, g, or t
gggcctgagcagggtgctggggggagagcgcgatacctcacgcgggctgccgtcctaatcaacgtgcctatggcgggaccacgctcggagcctgcctcttctgcgactgttactttttctttgcgggatgggggtgggggttccctctccaggtggttgtccaggcccaggtcccgaccctgggtgctcagccagctcggctaggccctgcgcctccctgcgcttcccccttcaggaagggtgtgtgccacctcgttgccacagggactggatcccagtcccgcccctgtccccaagtggctgcttgggggagaggcgtttgcatcactggtgttgtcacctccctgtttctccaccaagggcttgggcctctcggggctggggcctcccaggggatggggacccagaggtgcagtggccgccacatccatggcctaggagctactgggcaggttcccggcacacatctggtgggctgtctgaccaagagtgtgccttttcccccagatggtcttgacgggatcacgtggggctctctgggagttgagggtggccaaattaccgcggaggaacatgggggtcctcnagaagggagaagctgcggcagcgggcgagcgcgcacgcaagcaagggccccccactgtcgcggcagcatgcgggggcccaagccaggccggggtgcctaacatctggcggggctggggacaaggcgcgccaacgcttggcacgaccaacaccagacggcaattcacaacctaccgtggtgtggccaacaacccccccattgttagggaattcggacaggggataggcagcagtaagctagctaggaacgcactagtagtatagtcgacgcacacagtgattgttccgggacgggctgcaccggagaacagcacaatgcagcaagccgcacagctggagaggtcggccgcgcgagaggcgccgagggaccgggcagacgcaccttcgggcaacgcggctgggcggggacgcgcgaccaacccgccgggaagcccgggacgaagggacaccacagaagaaagtgagagggagaaaatgggagaccagaccacaaatacacaaagatgagacgcacgtcgtgaacacaacctggagtacccgatctctggagatcaacgacggggcaatctgcagagaaaaccggtgaacaagacacaccca

SEQ ID NO: 670268 - DNA, 501 bp, Homo sapiens
  misc_feature (249)..(249): n is a, c, g, or t
  misc_feature (431)..(431): n is a, c, g, or t
tgactttggactctctcgggtacttgaagatgacccagaagctgcttacacaaccaggggaggaaagataccaataaggtggacatcaccagaagcaattgcctaccgcaagttcacctcagccagcgatgtatggagttacgggattgttctctgggaagtgatgtcttacggagaaaggccatactgggagatgtccaatcaggatgtaattaaggctgtggatgagggctatcgctgccacctccnatggattgcccagctgccttgtatcagttgatgttggactgctggcagaaagacaggaacaacagacccaagttcgagcagatcgtcagcattctggacaaactcatccgggaatccaggcagtctgaagatcatcaccagcgcggctgcaaggccatcaaaccttcttctggaccaaagcnatgtcgatatcgctaccttccacacaactggtgattggcttaacggcatgaggacagcacctgtaaggaa

SEQ ID NO: 670269 - DNA, 557 bp, Homo sapiens
  misc_feature (16)..(16): n is a, c, g, or t
  misc_feature (515)..(515): n is a, c, g, or t
cctcggaggtccctgnctggactgctgagacgtacaagctctacgtgatcactactgcatcaacatctgactagagcaaactctaatccgcctctacagcctctggtatcatatccgacacacttactaacctacacttcatctttattatagatcaacttaaacactgatctacgcatcaattgtaccatctccattacacattctcatactcttatatacaacctatcactttcacactactcttcatgtctatctaccagcgcgtacacaactctacctcaaccgtactatctacatcaccatccataacctattacgaatgcctacatgtactaccagaatctattaccgctccactccatattcacatacactttactcttattaatctctatcactgccttacttcaccatcctcgcatcacttccttcacttctttctactatcacatccatctctcaatcctctccaccttcacccattctctctttcatccgaccattgctttctncactacactcactcccactacttctcacccatctctccctcc

SEQ ID NO: 670270 - DNA, 207 bp, Homo sapiens
aatctcctgcacttgtgatccgcccgcctcggtctcccaaagtgctgggatcactggcgggagcccccatgcccagcccgtagcatgttacatcctcgagtggctcatcaccggcagacctattgtttctgtagcacagcctggttaaggagttgaaagtggacattgggtttgaaatggtccccaatccggcggatcctctacagt

SEQ ID NO: 670271 - DNA, 166 bp, Homo sapiens
cgcgcgcagcgcgccgcgggcgaggcgatgttgtcctggctgatcccggcgaaaagccacttagcggcgcctggggttggccatccaggcggaatcgttggagtgttgcacgtagtcggtgcgttgcaactggggcaactggtcggccgggaagatacccggctgg

SEQ ID NO: 670272 - DNA, 135 bp, Homo sapiens
tcaagcgtcagcttaccacgggctctggaagaccgactgaggtaaagcgcccggaaggcaagtcgagttcatttcttgaagaggccggcgcgcgtaggctgtgacattgccctgcgactgcttggattacaagga

SEQ ID NO: 670273 - DNA, 403 bp, Homo sapiens
  misc_feature (4)..(4): n is a, c, g, or t
  misc_feature (10)..(10): n is a, c, g, or t
  misc_feature (40)..(40): n is a, c, g, or t
  misc_feature (55)..(55): n is a, c, g, or t
  misc_feature (68)..(68): n is a, c, g, or t
  misc_feature (119)..(119): n is a, c, g, or t
  misc_feature (360)..(360): n is a, c, g, or t
gtgncccccnaccccaaaaatctcatcttgaaattgtacnccccaaaaatccccnacgtgctgtgggnagggacccaagtggaagatgaattgaaatcaatggggggtggttccccccnatactgttctcgtggtagtgaataaatctcactagacttgatggttttacaaaggggaaacccctttcgcttggttctcatgctgtctgttccctgaagccatgtaagatgtgacttgctcctccttgtcttctaccatgattgtgaggccaccccaggcaggtggaactgtgagtccgttaaacctcttcctttacaattcccagtcttgggtatgtctttattagcagcgtagaacagnttaatacagcaaccaatggcccggaacacttccatcctgagtt

SEQ ID NO: 670274 - DNA, 987 bp, Homo sapiens
  misc_feature (386)..(386): n is a, c, g, or t
  misc_feature (389)..(389): n is a, c, g, or t
  misc_feature (391)..(391): n is a, c, g, or t
  misc_feature (521)..(521): n is a, c, g, or t
  misc_feature (545)..(545): n is a, c, g, or t
  misc_feature (551)..(551): n is a, c, g, or t
  misc_feature (702)..(702): n is a, c, g, or t
  misc_feature (987)..(987): n is a, c, g, or t
gcatcgcatagaggaccagcagaaagatgctcgagtgtggaaggtgttgatgcggtactaccctgctgtcgaagctgattccctccggtgcaggccgggaatggctggagcggcgccgggcgatcattcgggcctgtaagcaccttcgtggaccagcgagcgcttctcacggccctcaatctggcgagagctgtgccaggcgcgctcggtacgcaatcgtggagtgactacgcagtagcaagcgtagtgtgcttgctgtgttccgtgggagccttcgatcgctgttacctgtgctgtgtgtgacgctccaccttattgattgcttggatgtgcgctctggtgctgatcgtgttgtctccggacgtccctcgattacactatcatcntantntctgtcggcgagcacatatagggagattcgcgaaagccttttggttgaccgtcttgttgggcacagcgagcacggtcgcagctcaccagcagcagatactaggtaagtggctccttgcgcgtggcgtagngcataattctcccttgttcccgcnttcctntccttgggacgtagcgtcatggggttgtcgggcgcctccagaggccgggtccatctcatagtggtttgccatgggggcaaggcccatggccgtgtgctgggttcaatcggggtcgtccgcaacagtcgtgaccatttcacagcgcgagaanttcgacgcggctgctgccgaccggcgggcacggacgccttgccaggaattgggaagccgcggttgatcgacagggtcgatcatatacatgggggcaaccatagtccggagacccttcaccagagggaccaaagcttggacgcacaacacccgttgcgcacattgaccttggtacatagcagacgtgctcattgacgtgcatcagggcgccacaagacgcacagtccccagtctaccaaagcccaggggcgagggcgaatccccgggctttttgcacaacttacan

SEQ ID NO: 670275 - DNA, 120 bp, Homo sapiens
aggggcagcatgtgatgtaaattagtcactccacctaccatcttcctacttactagcaaagaatcgaggaagtcttgccactctagctgggtaatcagcgtttcactagacgttgatcta

SEQ ID NO: 670276 - DNA, 203 bp, Homo sapiens
ctccgttattgcgctctgaatccggtacgtcgcgttaagaggaacgggcgcgcaacggcgtgatccttgaggatcttgtccgttgcaatcgaggtccactgcgtgtcgtcgaaaccgtcttgttcgttatcgaagtagagcgcgtcgaccgcctcgcccacccactggtcaagctcgtttttcagcgggccattgggcaggga

SEQ ID NO: 670277 - DNA, 1137 bp, Homo sapiens
tcaaaacagccttattaaatcaggccccaaaggacaatgtcgggggtatacagtgcaggtgggattcctccccgggaggtcataccatgacctttctggggtaaaagtggacgtgctggggcggggattgttggggaagcggcctggtgaagacaggctgtcagggttgcagcagtggacgctctgggattgagacgtggggagcacggcgggtcccttgtgggaggtgagacaagtggccctgtgtgtgtggtacactcccgtgtccccccgaccccccagcgggccgctgggctctggcacaaaggaacacactgtgtgaggctgggttccctccagctgtgggtggggggtggcagtggagtgtggggccataaggaagcagctatttaggctccagaggtggcagatcggggaagagtggctcagttgggcagggccctcggggagacattaaaagttcccagaagaaagccgtggccattcccgtggtcctccctcccgagtgttcgtggtccgtggagaagggtggggaaggggtataagggggcacacatgactttctcccctcttccggatctgtgtagagaaccagtttgtaagcgtagaggggccgggctcctgcacctaaggtgggtggcccctgggacccgtgccccaaggcccttacacctttgactttcaatagatactcacgtaaggaatcccggaaaattgcacacagtggtttgggttggcattggtggcttgggggccatggggggtcccttggataggccttagcttgggggggggccctctcaatacttcgcgtgccaaggggtctccccaaggaagggcccgggttttgtggacaagaactcccaaccgggttctggcagcgcaaacacatctcggggggaaatgggagtgaggcagaccaaatccaaaacgagtgttcccccagtggtctctgcacaaagagtgcaaggacacaagaggttcctgaggagaacccctaccacagggggggaaacacacttagcacttggtgcgaccaagtggttcatcctctggagaattcacacaagagaataagcgaacaagaacggaaatatgctgaacacaacgcgagagaagagaacagtagagaacaag

SEQ ID NO: 670278 - DNA, 563 bp, Homo sapiens
  misc_feature (63)..(63): n is a, c, g, or t
  misc_feature (65)..(65): n is a, c, g, or t
  misc_feature (81)..(81): n is a, c, g, or t
gctaggttggagttggaaccgtggagatgcggaaggaaaccccagccgcctagtgcccccggngnccgggagtggaatctncccccaaatgcgcccgctgatggaacggcagttggaggctgcgcggtacggtccgatggggcgcttcatccatcggggcctccagacctgagtgggctgcatgatgggccggatcccgtctggcatttttaaggacccactgtgccgacccgcaacgaaggcattctgcatccgccggagtccaaacggaggctggagtggctgacctcacttgggttggggagagaggtattctagtggacatccggattcaggtgcgtgatagaacttgtgggaaatagatgagaatgagacaagttatggcacaagaaaggttcatgcaaggtatgaggcagtgatgacactgagtcataaagccagtgtattgagcgtactggaaaaaaggatgtcagtggatagaaaagacatcatgaatcaaagggataagggaccttgatcagaaggatgatactgagatgatacagaggtcatgagaggcaggt

SEQ ID NO: 670279 - DNA, 264 bp, Homo sapiens
cgacatttgcaccactgtgtggggatttctccacatcaaaaagcaagtaattggccaaatgtggtggctcacgcctgtaatctcagcactttgggaggccgaggcgggcagatcacctgaggccaggagattgagaccagcctgaccaacatggagaaaccccatctctactaaaaataaaaaggtagccaggtgtggtagtgcatgcctgtaatcccagctactggggaggctgaggcaggagaatcacctgaacccgagagg

SEQ ID NO: 670280 - DNA, 697 bp, Homo sapiens
tacgaggcacgaggctggtgaacagtggtcatctgctactgcggcagcagcaacgatggggcctcggccgggctctccctctcctctggcgtggctaccagaccgagcggggcgttttacggctaccggccgaggaagcccgagagccgctgagccccagggcgccctggagcgccccccagttgatcatggccttgccaaggttggtgacagtatattgtgcagcatggttcataaagctgccaacaatcaagccccgcgtcttcaccggacaagccctgccttgcagaatgttgccttgaaaattccaagccctggtgcagacacttgcaggggacccgttccacacggccacggattattcgcaacattggggaaaggcaagagggcctcattttgagggcacacgtgtttagtctatcttcaagtcaattctacctgtgggcagatttcttatttgcaaaccttccgcatatttatcacgaagccccaaggaatggagcacacacgaacgttgggtttttgggccctaaagccggggattttggaagggaaaacttgcgcagaacatggggtgcgcccggtttttagcgcgacaggaacacggaggccgacaaaccccaattcttggttcggacacacttacattgccttgggacacttcttccagggaaggtttgtggacccaactttttac

SEQ ID NO: 670281 - DNA, 408 bp, Homo sapiens
gcaaacagaaagtaaggatggactggatattaccaagcatccaccatcctggacaaccagatggaaccttcatcttctaccttctcctcttccctccagatcttgagcctaccctcctctcacatctcctcctgcccaagatgtaaggaagcatagtaaggatttcttcccatcgtacccttccccacacataccaccattgttttcttctatatcccaccccgatgctctcccaggtgggtgtgagagagacctcattctctgcaggctccagcgtggccacagctaaggcccatccatttcccacagtgaggaaagtgtctgggcttcttctggggctccaccctgacaagtagggtcacagaggctggatgcacagatttctgcctcattcctctccatgatgcc

SEQ ID NO: 670282 - DNA, 363 bp, Homo sapiens
  misc_feature (246)..(246): n is a, c, g, or t
  misc_feature (288)..(288): n is a, c, g, or t
  misc_feature (299)..(299): n is a, c, g, or t
  misc_feature (334)..(334): n is a, c, g, or t
  misc_feature (363)..(363): n is a, c, g, or t
ccgcacagcttcttcaacaaaagcagcccgagaacttttcttcgtcctagtcctgaagatgaagcaatatatggccctaataccaaaatggtaaggttcaacgaagggagacagcgtgggcctcctggttggctggtggcaatgatgtcggcgatattgtgttgctcgcattcaacgacagggaccctcgtgcggagcaggacgaggccgttcaagaacggagaccagagttctgacaggtgaacnacactaggatttcagacggattaagtgcgggacggatgccgnttctctacctntgttagaaatcccttaaaggtgaacatggtgaccnaattttagctcagaagccgaggccgatgn

SEQ ID NO: 670283 - DNA, 488 bp, Homo sapiens
aaaaaaatgaatagatttttattggtccataaataaaataggacctgcaaagaatagatcttagatttaaataaaaggcggctttgatgttggtaaaacaaaataaaatatgacaaaaaaaatatttttttgttccattcattgtactctagttggaaatcctggttccttttttgagacaggttctctcactcaggctggagtgcagtggcacaatcaagttcactgcaggcttgaactcctgggttcaagtgatcccccttcctcagtcacccagatagctgggactacaggcatgggccaccacacccagctaatttttgtatttttagtagagatggagcttcaccatattgcccaggctggtctcgagctcccgcactcaagcagtctactcacctcagctcccaaagtgctgtgattacaagcatgagcccccacacctggactgagttattttttttgagacagggcaagactcagtctca

SEQ ID NO: 670284 - DNA, 108 bp, Homo sapiens
ctggcagctggaaatcaggagaattctgaaccagaaggcgaaggttgcagtgaaccgagatcatgccattgtactctagcctgggtgacaagagcaagactccgtctc

SEQ ID NO: 670285 - DNA, 201 bp, Homo sapiens
acagtaggtgatggagaggctgatgggcttctacctatttctgtagctcacttatcattctcttctacccataaatatttccccaaatctgttctaccagttgctccttttaaatgctgttaggcctcaatctgagacccccacaggtccattctgtaatcagaatccaggaaaccctttctctttaccattcagcctctg

SEQ ID NO: 670286 - DNA, 369 bp, Homo sapiens
cactgtcgatcaatgccttcctgtcgagctcccctgttctgaggatctgtgatagcatcgaatgttgccccagccccataaatgggcttgtccgcgctaggccgttggcgagctgttttcagtagtcgtgctcatctctctgctcctgtttcaaccagtcgcattgcatccccatttccgatcctcaacatttatatcctgttgaatcactgctccttgagtattcctattgctgaagacatcaccatgtacctactggcatctatagcagttctcttcctcagtggaatcaagagttttgtaatcgtaaaaaaccggatgagagtcatgggttctgcctctaagagaagctgtaataaaggtgcttgg

SEQ ID NO: 670287 - DNA, 119 bp, Homo sapiens
gaaagctccttcaccaggaattcacacacctcacagtaaagcatcagacttatgctcgggacctcgtgcatcttaattgggctactaccagttaccagggcagggatgacattacttgg

SEQ ID NO: 670288 - DNA, 144 bp, Homo sapiens
cgccccaacactttccccaacaggtcagcaatttgtgtgggttttcattccactgcaggtgcactcacatgccagtcatctttcatgttttcaatagcatagggcaagcaacattgcgtccagccggtggggcattcctctcag

SEQ ID NO: 670289 - DNA, 237 bp, Homo sapiens
tagagcggctcaggtgagaactggaggtcttgccccgcaagggctctcttctttccttgacctagtaatttcacatgggcatacattatgactaccataagtctagtaaccatctgacagcatacaaattgatgataatattattgaccatactccttatgccttgtgttatcgcaccttacatttacaagtaaatccccttcatctagacccctcttctttccccctgcaagcacc

SEQ ID NO: 670290 - DNA, 410 bp, Homo sapiens
gcatttccaccggcggcactggttaacccagcaaagctaaagctatgctggaggcgtttacggtcagcggagaggtcccggaccccggggagggctctgcgctcttcagcgttgtggatgaagtggcagcgtggcccgtaggggcaaaagccgatggtgtggaaggtgcggcacagctccgtcttgtacttggggtggcgggtcaggctgcggagctcgtggatgccgtgtgcgaactggcacttgtccccgtacttacaggcaccgttttcctcaaaggggcggcacagctccgtcttgtagcggctggagttgacctggccgcccccgggctgcttctgggtggtcagcagccgctcgcccccttccgagaaggagcggtctcggaagcggctgtctcgcgagctcag

SEQ ID NO: 670291 - DNA, 290 bp, Homo sapiens
cagacaggagcggtgttacgtggtgatggcatagaaaggacgactcacagggagctgagcatgcggacagagcaggtatgccaccgacttgaagattgggagcagccctcccggtggtggagaggttgtgcaggatgctggtggtgcagcgggctgtgtccagggcgctggtattctgcatggtacgcacgacagcggccaccagctgtggcgagcccatcaggtcccgccgtgacgcctccttcttcgacagctggtcacaatcatggccgccttggtcaccaccaccg

SEQ ID NO: 670292 - DNA, 129 bp, Homo sapiens
ccttgcagaatcaaggtaaatcttttcatcacatatgcacactcatgcatgggcacacacactcatcacataattgcgcatgcacacacatgctctgccgggcacttatgcgcagccgagctacgtaga

SEQ ID NO: 670293 - DNA, 857 bp, Homo sapiens
  misc_feature (607)..(607): n is a, c, g, or t
gcttctaccggccgtgtaccagtcaccctggtcagtcttcaccatcgtcagtcgctcatgtacttcgccttgtaccagggatgactctgttccagaagacaacatctgggagaggcatcctctctgttattttgcttctttcggttatcatcagatgtgtcagctttgcccaatggtccgttcactcgacctcatccagcctatatggcgaatggtgttaggactcgagatgtgctctacttcctgttcctggtattcctacgcttcctgaagtttcgaggcgaggttaaatctctagatgtattggctagatccgaaatcttcgatacgccacaagggaagcagatgtcatgggagtatgctgtgaactgccatgtgatcacctgggagaggattatcagccacttggatatttttgcatttggacagttctctggggctgggccactgaaggcacttgtcgtgatccgtagtgacggtctctgctgtgacaactcagtattacctgggagctgagctgagctctgtcttcatgcatctccgtccccaattttgccgagtgctggtgggatcaaagtcgattctggacatccgtgttgtgcaatgngggtggcattttggtggggcatgggtcagtatgacggtttttagagatgagcgacttacactgggcaaagcttcaaggcacattcatagcacacaccgggaagatcaagagagctgttctgaagttcactcctgggtagtggaacctatgtgcgatggtttgagcccaaatattcttttcagagagtacttgaggtaccttttaatgatcatctggggtgattggggtgaaactcttttggaagaaattt

SEQ ID NO: 670294 - DNA, 155 bp, Homo sapiens
gggggaaagttggttgggtgggagggagccagttgggatggagggacgtttacaggaccgcagacagggccaacgtcgaagcacgaattcctggtctcggggcaccaacgtccaatggggccaccttgatgatgggcaggcgggaggtcttggtg

SEQ ID NO: 670295 - DNA, 1233 bp, Homo sapiens
  misc_feature (844)..(844): n is a, c, g, or t
cgagaccaatacttatatcagattcgtcgtagaccgcaaatacataacggcaagaggtgaacgattgccgtacgtttagctggtggtcggtgagtgctaccggtgccactctagcagtgatgctaggctcagactctagacgagagctcgtcagtagagaggacgaacaacagctacttgggtggtacctgagagcccttagaagactattgcgaaaagaggaagtcgactgaggagagaataagactggaagtccaacgggttgtatgcaatcttctaataaggagtcgtctatgtgcaatgtcgtggtcctctaggtgcacatgtatggagcatctctcagtgcacagagcttatctcagagggcttcatacacactctagcaccagattgccaactcaattagtaccaattcgaaacgagtcatgacacacttttcgaatcgccatgcaaagcgtgcctcatattgctgtacaacttagaaaaacccaacattaacaacatgacaattgtcattaatcgagttgtccatagactgtgctcaacgtcccgttgtaaagatgaagatggatcacttcttcttgtggaaatgggcggatgaggtaaactaaggttattctagtcctcgcgagacgagcatattgtcccccaatagggcgggtattaattccaagatgtagggcaacaagggcaccaggtttggcctaaacaaccataacagttggtgccgtcgggctattatgatggcgcgagataaccttttccccatatttcccccgttaatgtagtgttgtccccaagaccgccgttaacctttggcaaatgcaaagaacggtgggcaccnataataaagggggggcgataaaaccatatttattccatagccgacagtacgaggtacaccacggtgagaagcctatacagcgcttggggggcagtttcccccattcatgatgcgggtgttatcaacttaaaacgaaggtaccctacagcgacatgaagaccgttattaaccggttgatcgccattacatactagacacgcgaggcactaaaataggaaaatcactggaagtttagccgcatcatgggcaacgcaagaaagaccgacttaaactcaagcgcaattaaaacctaaatatgcattattaccaggaaccatattattggatcctctgggaacattgtgcgtccctatggagagcacctcatataaatcgttcgcgagacaaac

SEQ ID NO: 670296 - DNA, 724 bp, Homo sapiens
  misc_feature (432)..(432): n is a, c, g, or t
  misc_feature (610)..(610): n is a, c, g, or t
  misc_feature (617)..(617): n is a, c, g, or t
agcgggacggcgccgtgtaactgcgagagtcggggtcggtgcggttcgataagtggtcggttcctggagctgcggtcttctgctagcctgatccgaagcttcagcgctccgcgcgcctccgtcagcaccatcggcggccagccgcgtggcagccagacgccatgtacccagccaggccggacagcggggaccgcgagaagcccgatagagggcggcagggcgacctgatcgcacgcgcgtccgtcgagacgtcggcacgatcggtcacctgggatgacgcccagcgggcctcggcggccgggcgatgcgcctgcgggccactgaagctgtacggagccagcctgcacgggagctaggacgggagacacggcgggcatgatcatggaagccgcagaaaggcagcgggagacccataggcgcggaaggatagtncgcaggcagtgcgcgccggcagagcacgtcggtggcagacaccagtggagtgacaaagggcgctttctgtgcccgaccgcaaagtaggtagtaaagccatgggctcgcgtacttgcgtcgagtacatgtcccattgggacagtctcctttgtgcgcggataggagagaccctaggtgnagaagcnaaacagtgcacggacatggtgtgcaacatgggtctcgttaccattggcagagcaccactgtgtatcgtcacagcaagccacagtttcgcgtgccagtggaaagatgg

SEQ ID NO: 670297 - DNA, 224 bp, Homo sapiens
agaaaagatatacacccgtatgatgaaataatgaaaaacataaaataacaaaatgaatcatcgaagtagattcactatcgcagaggtcacagggttaaagcagagctaacaattgaaaggaggagaacatgcagagagcagaagaaaactgatagtacacgtttatctactatactttcttttccttccttccttccatccttccttatttttctaataactag

SEQ ID NO: 670298 - DNA, 303 bp, Homo sapiens
gcggtgaaggccaagatctcgaccgcccaggcggcgttgcctaagggtgtagaactcaaggcgatctacgaccgcacggagatcgtcgccaaggcgttgaagacggccgagagcgccctggtcgaaggctcggtgctggtcgcgatcgtcctgttcctgttcctgggcgaggtgcgctcggccgtggtggtcatcgtgaccctcccgctggccatgctcatcgccttcctgctgatgaaccagtttggtctttccgccaacctgatgtcactggccgggttggcgatcgggaccggaatgatg

SEQ ID NO: 670299 - DNA, 376 bp, Homo sapiens
gtagtgcagttgtaacaagcttgcttttcaaaaatgatgattttaggtgtgtgtgtgtataaaccaggcagttatttctgaatattaaaaagaaataggttgggtatgtgccccatgcctataatcccagcactttgggagccaaggcagaaggatcgtttgaggacaggaattcaagaccagcccaggtaacatagtgagacctcatctctacaaaagtaaaaagttagggtagggtacagtggctcatgcatgtaattccagcactttaggaagctgaggcaggcggatggcctgagctcaggagtttgacactagccagggcaatacggtgaaaccccgctccagcctgggcgacagagtgagactccagctc

SEQ ID NO: 670300 - DNA, 1132 bp, Homo sapiens
tctcgcagactccgcgagcgtactgacccggcgactgacaggctccaactacccgggactcagtattagccttcgaccatcactggactccatctgcaacaagaggaggcattccggagtagccctcggatgaagaccccagacacacagctatgagtccacttcgtgctgacgtctgcgcagtaaacatgttctgccatgtccaggcatccaaccggacgcaccaaagcaagcacggcacaatgcgcatgtaacccacaggctctatcctgcgacgaacgcaccgaccctgcgctacgacaggttgggcctctcacacgccacacacgcgcgccaaaacccccgcccctcatccccatctcccccagcggccaaacaacacgggcctcacagtgcgtgaaacacccaggcacccctccgctacgggacacaccattggccatcctgaccgctcagagccacgtcgtaccttggcacgccttggcaagctttccattcccttggcgcccttggtcacaaacgcgggctacacacgcacacctcacagacttggcggatataccgcagtcctcacctttggtggcccccactaacgcaggccctttacgatcttgtccgagaaaacctgcccctcgccctctaggcacaccaccgccattggccagcgccaaacagctctaccgattatggaccggtgaaccgccaccttttgctccccctacatcgtgcacagaaaaccgctaacaacgctgcttatcgctgccccacgcgtttggggaccccccaccactgctgcctgcccgccccccccgatacagcgctctcgtcacactcgagtacaccgcgccacacaggcctcgcaacaccatcttcgcctgtgcgacacagcgtattatgggggccacccttctggttcgggccgcacaaccaccctccgcagcaccaccatactcggcggacggaccatcaaagagttttcaccaaaaaaagggagtctggcacgccccgcgccaccccattatgggcggccgagtggcctagcagttttgcaacaccaccgcgaccgcagatatttgctacctcaccccctctccatcgcccctgcgccgcgacgccacgtccagcgtcccca

SEQ ID NO: 670301 - DNA, 214 bp, Homo sapiens
  misc_feature (92)..(92): n is a, c, g, or t
gctatagatatataataataaattataaatataatgagtaaccttccttaaccaaccaatttaagggaattgggccttaattaaattttttnaaaaattaaccaaggaaattaaaccttggtttaacccggaagggaattggttgggaaaggaaacccaaggaaattaacctttggttggaaggtttcccgggtggggaaattggttaaaaatt

SEQ ID NO: 670302 - DNA, 133 bp, Homo sapiens
gggtctgaactgaacaacctgctgtgtagtgatgcatgactatatataatctctagataacttatgatacctaatacaatgtaaatgctaggcaaatagttgccatactgattgtatacggaaataattacag

SEQ ID NO: 670303 - DNA, 400 bp, Homo sapiens
cgacaagcaagtgaacagtacactgcattctcctgcctcagactccgaaggactgggacttttagaggcgagctaccaagcccatcctgtaaccattttaaaatgtacaattcagtggcattaagtacattcagaatgcagtgtactgttgtggagtcttcccgctatctagttccaaaatttcatcaccccaaatggaaatcctttacccattgacagttactccccattctccccttcctctagcccctggcaaccactaatctgctttctatctatggatttgcctattctggacatttcatgtaagtggaatcctacactatgtggccttttgtgtctggtttctttcactcaggatcatgttttcaaggttcatgcatgttgcagtgtgcttccg

SEQ ID NO: 670304 - DNA, 226 bp, Homo sapiens
gcttaagtcctgtagaggagcaagggtaactagagacttacatgggccccaatatcacaagggcatctgctaggaaagggaaagagtgagactgggccttgttgagagcaagaattattagagagggagccagtgagaggctgaagctagatagggcaattggggtggaccataagggcagggctagagggagctaggttcctctgctgggagtgcctctttactt

SEQ ID NO: 670305 - DNA, 349 bp, Homo sapiens
atcacgtgtgtatccagaacaatttgagagaaaattgtacacacacacacaatatgaaaaatataggcctgtatgcggtggcttacgcctgtaatcctagcactttgggaggccgagatgggtgcattgcttgaccccaggagttcgacaccagcccgggcaacatggcaggactcccatctttacaaaaaatacaaagcccagtgtggtggtgggagcttgtagtccttgctactaaatggggagcgctgaggtaggggagtcgcctgagcccaggaagttgaggctgcagtgagccgtgatcgctccattgcactccagactgggcgactggagtgagacctttcct

SEQ ID NO: 670306 - DNA, 179 bp, Homo sapiens
tgcagcctgggtgacatagtgagaccctgtctcaaaaaacaaaaacaaacaaacaatgagaagttagccaggcatgcaggctcacatctataatcccagctacttggaaggcagagttatgaggatcacctgaggccaggagtttgagaccatcctgagcaacataaaaaaaccttgtc

SEQ ID NO: 670307 - DNA, 881 bp, Homo sapiens
gctgcaaggttctgggagctggacacggaccacgacctgctcatcgacgcggacgacctggcgcgggacaatgaccacgccctttctaccaagatgatagagaggatcttctcaggagacaggcactacgaggcagaaaagtgcagacaggaagggaagatcagctatgccgactttgtctggttttgatctctgaggaagacaaaaaaacaccgaccagtcatcgatgtactgggttcctgctgctatggaccttggacggggtacggcgccctgtccagtgttcgaagctcggagtacttctacgaggagcagtgccgaaggcgtggtacgagcatggccatcgaggccctggccttccaggactgcctctgtcagatgctggacctggtcaagccgaggactgaagggacgatcacgcgtgctacggacctgtaagcgctgcaagctggccaacgtcttcttccgagcaccttcttcaatatcgggaagtacctcgaccacgaggcagcaggagcagtatctccctgctcagggatcggtgacatgcgggtggccccagtagctcgtcgtgactggagagaaagtacgcggtccgaggagtactgacattcctgcgttggtccgatggtagaccggcgggagagccctgggtaggacgggttcgaggtccgagttcagccgctgtggcgcggaatgttgggtgtcgctggggccccccggtggcctaggggcccttctttcggggggcctcgaccgtggagtgcgcggcgtgtacgagtacgcatggggggcaggacctggtcgtgtgttccgccgcttgaaccgcgtgggggcggtccctgtgcccacggcccgggcgtgtgctgggggatggggtt

SEQ ID NO: 670308 - DNA, 120 bp, Homo sapiens
gaacgggtgtgcggttggggagcaaatgaggcagaagcagcaacggctgctgaagaacatggatgcccacaaggttcatgctggacctgctgcagatcctttacaaccgcatcacccgtt

SEQ ID NO: 670309 - DNA, 603 bp, Homo sapiens
  misc_feature (465)..(465): n is a, c, g, or t
  misc_feature (596)..(596): n is a, c, g, or t
atccaatccaaggtgtcccaaatcatcccgcacatccacacaacaacaacaacaacaacaacaaacaacaagaaaaccacaaaccaatcccccccaccaaatccacccccaaaaccacaattccacacaacacctcacctcaaccaacacctgacgaccagcttgaggctaatacaagccgaaaaggtccagctatttggttggggcgggacgtcacaggaacccacaacaaatattagcacagtatagtttctacccgatactctaggtatcgggataggagggttcggtaggtcacaaatgggcaacaaagatggctgtagctctcttggaatgaccgggtacctcatcgtctggttgatagcacacgtaggtaagtaggcagagttcccgctatccctgcctgctgtccgacagggccgcgaccggtaaaggcaaacttaacaaggtcgacaaaagggaggngccctatttggacttagctctgatctaacgcaataggagggcgtagagaatatgaggtggataaagaacccccaacacccccccaaatatcccctcagaaaacccaaaacaaaatccaccaaccctacaanccaccgt

SEQ ID NO: 670310 - DNA, 1682 bp, Homo sapiens
  misc_feature (1397)..(1397): n is a, c, g, or t
  misc_feature (1510)..(1510): n is a, c, g, or t
ttggatcctggtaatacctaatttttttaaccttttcttaacacatctaaccaccaaatataaatatacatctgggtatcacccccagcgttctaacacaacattaaacctatatttttgtgttattttttccctatagaggaaacacccacagagggagaaagacacgagaaatattatcagagaaagttctcagagaacactcttggaaagttgaagtaaaacacacaggttctccacacacagaaacaatctcaccgcttattcacaacatatctctccacacaaccctcacttttcatatagagcgcctctctatctcagagatatatattcacgcccacgcgtctcacacagatatatatatctctcacagagacagtcgtctcagagagagtctctctcacactctctgtgtgcgactatatcaactactaccactctctctcacacagcagagtcacagagacacccgggagagtagtctcacacagagcacctctctagagcacacagtgtcatcatcacagtgctgtgagacactgttgtgtgcgccccactaacatatatttctcccgacgagggttttttattatcctcctctatgatgagactgatgacagagacgacgacaacaacagacgcggcccgacgagatgctcgtctactatcactatatcatatcatcatgctgctgagctactcctctcatctcctcatcctcaccgctggtgtgctccactctgttgttgatgaagatgatgctgctccgaccacatatccttcttctactgctgaggcggcactactactataccttcattctttcttcctccctcctcctggtggagaacgaacatcgattgatgattaatcatcaaccccgaacaataaacaatcattccccccttgttctgctggcgggccaccatcacacatgttttttcttttctaataaagatggttgctcttcatcccccaacgctgctctcctcttcttcccagccgcggaaaacaaaaggtgtgtgggtataatctcctctcataattattttcttcctcccacaggctgttgatcgtacacctccctttttcttccgccgaagaaaaaacagatttttttctataaaacagggggtcgtcacaactcgtggggggcagtctttttcagcctaccacacccaacactccttgcatgctgggcggccccactaattttctacaccgcacccaagaaaataattatcgttgcgactcgtggcctactaaacacaccgcctcctgcgggtggggaccttattacaccataatcaagatttgataaagacaatagacgatctcaccctcttcctctttcaacacggccaacacatcctcgatccctactactaattcantacacgcgcccaactattatattgtctgcaagcaagcgccgggcggcaccacaggcgggtggcttgtgctgccctcccccaaccccactcgctgggtggcagcgaacacacanctttactctcctccccacaccaaccacacgcttttcatgactactctctccgagcggagcaaacctagtggggtaactacccccgggcctccacaaactctgtcatgcatatcataccgcctatataaccaacaaaaaacttatctccccgaaaaaagccctcgccactaag

SEQ ID NO: 670311 - DNA, 480 bp, Homo sapiens
aacgagaactcacttgagctctgtggtgagaactaatcaccgaggtgatggtgctaaaccatacatgaaggacctgcacccatgatccagtcatgtccccaggccccagctccaacactggggattacatttcaacatgagatttggagagggcaaacacccaaatcacatgaaacacaaaggttttcaaaggaaacaatgaggaaggttacataattgttttgaaataattatccttggctacgaaaatcaataacaatcgtgatgccagtccatggttggaaggcagtagttactgggcagatatccttacagaaatttttttttgtataacgttgtcacggactttgtgcaaggttgtaatttttgtagaatctttttcatcatcaggcatacacgcctgagaatgctctcttcatgggcttccccagctcgagaaatggtttccccattttggaggaatcccgtatggagaccacg

SEQ ID NO: 670312 - DNA, 883 bp, Homo sapiens
gcaatggctcttaacaactttcgccaaattgcttttcaaaagtctatagccatttcaccactacctctcattatcagtatttaatactttcgtctagtttacttggtgagcaatagcccctgtggcttggatggggccggatgtctatctacttttatttgccgatatatagtgaattgcccattcatgtgcttctgtccattagggtactctatgcagactttctctttctcaacaacactagtcatcatgaacgacagcggtcttggcatgggcacggcgcgctcacgcttgctaatcccagccacctttgcggcaggctgagcgctggcgtggactcgctttagcgtcagcgacgtttgacgaccagcctggccaacggctggtgaaacccccatctctacgcaccactacaaacaaacagttagcctggcgcattggtgatagggcacctgtaatcccagctactacggcacggcctgagtcaggacgaatagcttgaacccaacgaggcacgaggttgagcccagatcatgaccactgcactccaagcctgaggcagaacacgagcagagaacatcacggcaccacaacacacacaaacacataaagggtcccagcgcaaagaagacaacatgtgtacaaacatacacgacgacgcaagacccaacgacgaacactaacacacaccacaaaaccctagggccctcaaagcaggacaccccactggcccctacaccaagaaccaaacggtcgcaaggacacaatcaagtccgtctcagagcgccctgcaccacacaagccacagaaccataccaagggcatacaacagaactaaacgcccactcacgagcctcagacccccagctccattatcagcgca

SEQ ID NO: 670313 - DNA, 334 bp, Homo sapiens
ccgcagccgcattctcccagacctccaatgagcaacattctactctctacctccatgagaaccacgtttttacgctcgcacatatgcatgagaacatgcaatggtatgtcttcctagggctatggcttactttcatttaccatcaatgtactccactatccatccatctagccacaaatgacagactttcattattatggtcatggttgactaatatcccactgccgtatatctaccacattttctttatcccattcatctgttgcatggatacgttattgttagttaaaccagacatagccttgaatctgtaaattgctttgggccgtcatgg

SEQ ID NO: 670314 - DNA, 930 bp, Homo sapiens
caacattttgataatgcatttaatcttttgcatgaaatcacattctaggtcactaaagcatattgatgattttaaaatattatatagcttcccattggtcggcacagggcattggttctaatggattgggagagcccggcaacgttgtcacttcattgaaatactgattcgttacgcttatagcatgagtgcgcagtacaactagaagtatgttcacattgcatgcgaagagtataaattgatagcatttttgtataccgtctctgaaaatacatatgcagtatagcgtcactgttccaaggcgactgaatgaaagtagactcatctagagttcttgatagttactgccagcgaagaagttataactatgtgtagtaacttagcatgcggaaatatcttaattaagaaattcttcaggataacgtctgccattctgggaactgacagtaaaattacgggcaccaaatgtacttgaagtttagtctcagttgtgtgtcgtgaatctttgtaggagtgtactgtctccttaaagatcatatacctgttcttcagctggatacagctatattgtctagaggtcagaatcagtgtaatattaggttcagttggtcccgcttcagttaagacgaaatcatttggtgactatactgaggacatttgcttgtcagatgttaactggtcagaacatgctaccataacaatttattgagactaactagctgtcaggaaacaaagaataacacaaaaagtttccaagtctcaagaagaacttacctggatcacataaccattctaaaggtctctttcctggagcgatacagggttctttggtctactttcctgtagtgataaagtttcttttactctaatgcttcggttgtccctactaagggtcaatccagcaacagtgatagaatggcccaaactgaa

SEQ ID NO: 670315 - DNA, 970 bp, Homo sapiens
gtgacgcgtggggttatagaggtgaatacagattttagctatcggtctccaaatattcaatcatgttcctaatacttgtatctctctctgtgtgtgtatgtaggatagtcattatatgatggtgatacatctgcacacctcactgacacgtatctgtatactctatgtgtgtaaaaagatacagtcgattccattatttgaatatctgattggggaagaggaaactgcacagaagccaccttgatttatgtacaaccgcccacttgaactcctgcttccaagatttatacacttttatacctagagttcacctcagtaactgccttaggggtggattgccaaggtgtttaacggtcttattgacacacacaggttaatttcccctatctctcacctaccctcatgagtctatacacgcagatatcttaaaatacattccaaaactgctgcgggggttaacctctcaacacacagagagcaacgcccgcatcaattacagtccacactctccaagacactaatcacctttcctaacagaaagtgagtgctcaaaggggcaagaaaacaaccacatagccagctggaacacgggataacataaagtctataatacgtgccccaccaccacaagatcccgtctagaacagcgatcaaaaatgctactacacagcaatagaatccagcaccggcttaatatgtaccctacaggacaacaaaagaagatacacacgcgacaatggacgtggccccgaccgtggcggcaaggagaaaagaccaacaacagcaagtaaagacagcctacaaaacgcaacagcacacatcaagcaccactgtcgccagcaccccggcccgaacaagcaaacagcctcgacaaaaaacgcgacgacgcgacgacaggaaacaagagaccacacccacaacaaacaacaaaagcaacaacaaacacaacagagacgaaaccaacagcaga

SEQ ID NO: 670316 - DNA, 1850 bp, Homo sapiens
cacagccaccagcagccagccccctccgatacacctcccggtcctctcctacagacctgacacccctccacctgaatgaaaagcacatctcgtggacgaggaggaccggagcaccatccgtataggctcaatggacatcagcatcccatccacacgcaccaggacccagcacgggcatcaagaagatgagagagaggacagactgcgggacaggcgtagaaaaacagcgaggcagcatctacatgccgaaaatctacacatgtcagccatggagaacacaataagagagccagaacaacacacaataaataaaatcaaacaagaagtaaaacagacatacagagaaacacgacacaccaaacacgaaaatgaaaaaaaaaaaacaccacacaaatacgaaaaacaagaacaagaacaaataaacagacataaacagcagagaagaacaagacacaacaaacaacaccacgaacacacacacacaagaaaagagaaaaaacacaaacacacacaccaaccataaaacagcacaacacagacaaataacagaagagaaacacaaaagacaacaccagacaaagagacaacaaaagacaagaatacaacaaagtaccgcaactcacacttgagacgacacaaacatcaacaactaaacgagcaactacaacagaaagaaaacaacgccacataaaggaatataaaaaaaaacaaattgcacaaagacaaaccaaatacagacagagacatgaattatgacaaaagaaacaacaaacacacaaaatagaaaacaaaaggaaagaaacataacaataccgcagaacaacagcacacgaaaaaaggaagaacaacgagccacgcacacacacacgaaaacagacagcaaaacaacaacaacacacagacgatagacaaaaaaatacaacacaaccaacatgattcagacacacgaaagaaatcacatgacagagacacacacaccatacagacaagccaaaaaaaagagagaaaaccaacacaacaaaaaccataaaaaccaaagacgaacacacaacagatacacatccatagaccaacacacacgaacacagagcaacaaccacacaaagagataaaaaagaaacaacgaaaacagaaccgaacacaaacacaaagaaaaaaggaaagcgaaagcaaaaacagacagaagcgaacacacagcagagaacatgaacaaagacaacaagacagacaacaaccacacgaagaagcagaacaaaaaccacacgaagagagcacaaacaacaacaacagaaaccagacagacagaagaccagacaaccgaaaccaaatccaccatataacacgaacacgaactactgaacagatgagaataaaaggaattcaacacgcgaaaagacaacaacacaaaacccaacgacaacaaacaacaaaggcgaaaaaaaacagaaccacagacaacagcaacacaaacagaacaacacaacgacaaaaacagaaagctcagacaacacacacaaaaaacacacaaccgcaccagagagcagaacaaataaaaaaaaagtccaaacaagcacaacgacgaaaaaacaaagcaacaaacaacagagaacacccaagcaaagcacaccagacaggagactagaaaacagcaagaaaccaacaccaccacccagctcaaaccaaacgaagatacaacggacatgcagcaccacacaaggagaacgcaccgacaacacgaccaacaacaacaagaacaaaaaaaaaacgaccagaggacaacaacacgatacacacaaaacaaaagacaacccaccggacgtagtaaacaagcaagtacaaaccgagagaac

SEQ ID NO: 670317 - DNA, 337 bp, Homo sapiens
tggttgggcgcaaaaccccttaaaaagggtttaaacccgccccttcagtcgtgtccccccccccctttggggctgcctgtggtttttttgccctctttttggggggcaggccctttttggggttttttccccttttttggggccccggggggggtggttcccttttccgggccccccccccctttaaaaatgggttaggggggtttccccccttgggcccccccccttggtgttttgcccccccccccccagccctgtttctgcccccccttttttggggggtttgtggatgtttttcccttggccccccatccatttatttttttcccccccccca

SEQ ID NO: 670318 - DNA, 294 bp, Homo sapiens
attaccggaacagtagtcagagggcgtgagccgttacgggcagggcggtaacacaggcctgaacacccttctcctcagcccagtgcagctcatcagggtctgggcctgcttcagcttctgccagtgaggacctggacacttgtcttgctgagatgggacatggcaactgggctgggcttggggtcccctggggcatgctgccaccatcacagccgcaggtgcaccatggccctcttccacggcattgctgcaggcttgcagctcagtggtgtagtccaccctgccagcccacac

SEQ ID NO: 670319 - DNA, 1296 bp, Homo sapiens
  misc_feature (1296)..(1296): n is a, c, g, or t
tggtgaaaaagcttttaagtagctaaatatggccgccatgtttcccaagggcaatataaattccagttatgcaaaacatcctgacgggctgaggtaaaacgcacgtgctctccgtgcctctcagcgttcaccatgtgaggggaaacccacattatgtgtcttttaaaaaacattcgtggctttataaaaaaacattccccttaaaagaggccctccaaagaaggggcgtggtgaggcttcaccctctccggcgggggcccaggagaagagatcccggcgggcctcagccagtgggcgccctcccatgtgtgggaggcccatgtgggggtggcggccttcccccctatatgggcctgtgccacagggggcctctgtgttccagggtgtgtgctctctaaagatggggtgtgtacagaaagaaatagtccgggagggttacacaagagaatgtgggctcctgttcacaggtctataccacctatttggcgtaagaagcgcccgagagatatgtgccacgccccacgccaacgtgtcctcttgggggtcatataggggctccacatctttctccacaccctgttctctcccagggacaccatctctttctctccccccaagtctactctgtgggggggacaaactctgggtatggacaggtttgtggggtatcccccctatccgcagtgtttttcccccccgcgggtgggctcccagggggcccacttgtggtcccccgtgtgccactcaagatctttgtctgggcgcgaaaatatgagggaagttatagagagagcacaagagtgagagcgcccggaggcccccctcttcttgaggtagtggcgtccccccgaaaatattgttgcagacaaggagataaaaacgaggcccccccaatatgatcacgccgcggccactatctaaggacctacaaaatcaactgcagattttaccccccaattaaccgggaggggactcaccctccataggatgacacaacagcaagcaccttaaactacaaggggcccccacagtgtatggatgaccccgacaacaaccccccatcggagtgccccaaaagaacatcgctctttgagcaacgagacaccaactctctcgcgcagcgaacataacgtctcgtaggaagagcggccccccacataaatagtgcgccccccagcaacgaaacagttgatagacgacccaagtgtgagcccccaactgagtacgttcaaaaagagagcgccgagggggcaaactcacgagcactcactatccttgcgtgccgacacaccgccn

SEQ ID NO: 670320 - DNA, 304 bp, Homo sapiens
taggctggagtgagtggtgcgatgtctgctcacttcactctggctccttggttcatgtgattgtccggcctcagccttgtgagtagctgggactacaggcatgtgccaccaggtcgggctgattttgtattttaatgaatagtaggatggggttataacatgttggtcaggctggtctcgaactcctgacctcaagtgatccgtccacctcgccctcccaaagagttgggattacaggcatgagccaccgccctggccctcaaaaaaacgctttcatctgaccttgatataggcgatcaagctt

SEQ ID NO: 670321 - DNA, 197 bp, Homo sapiens
gagaggcacatcatcacggtcgaaatagaagcccagagtagaggtaggtgtatgatgtctgcggttacgaattgatcaggctgttgatagatagctccacgttggtggaataattctgacgaatctgggagctcatggttgagttggccgaaggatctagtcacataaccggaacgtggcaatgggtaccgagctcg

SEQ ID NO: 670322 - DNA, 104 bp, Homo sapiens
acatggacagaccctaacaatatagtacaaaaatctaaacatgtaaataaaaaatacaaaacaaataacctataaaaaagtactatataggaaaaaacagcagg

SEQ ID NO: 670323 - DNA, 315 bp, Homo sapiens
gttcctcccaccacgactcatggaccagtcattacaatagcctgccaaaccaacccacctttcaaaaccccactccagggcccctgcttcaggactcgcagatctactctccctgctcagatatcctgcagtttcccaccaatcatggcactcccaagccgttacgggcaatgcacacagcagctgagaaagatccagtacagtgtccacagccgctggcctcagtgaacatggcaaaactgaggctccgaagagtggggagctggcctaaggtcttgaagccagagacagccagagcttggggactcaagccaa

SEQ ID NO: 670324 - DNA, 758 bp, Homo sapiens
tactttgttaaatttggggagtagtgtgattgagggtggagtaaattaggcgtaggtaaaattagaggttaaggagggtgatggtggctatgatggtggggatgatgaggctattgttttttggtgaattcttcgataatgcgcccattggggcaaaaacgccggttagctggggcgcaggcccttcctagggagaggagcgtgtggatggaattaagggtgttagtcatgttacgcttgtttcaggtgcgagatagtagtagggtcgaggtgctggagttataagttgagtagtaggaatgcggaagtagttaggatatatataaatagttaacttaagaatggtctatgttagggttgtacggtaacaactgctattattcattcctatgtgggtaattgaggcagtatgctcaagaatttggcgtagcctgggttcgggttctaatcccacctcaactgcctgctatgatggataagatctgagcagacgtgaggaaaaaggctaacgtccagtgacgggagagatggcgatatgacttgacatggggcgctagttctgtgtcttgtgagaaatgcacgcctgcccggattgtccaggtgtgccttgggtcactctctgggactccaacggttcacagggctattcccagttaatgctatagcctttgatttttcccgtgacgctcgctggggactggattggacatccgcgttttgttcaggtccctacggtatgtccggttagaattatggtc

SEQ ID NO: 670325 - DNA, 178 bp, Homo sapiens
tgtcttgatgtcacttcattcaatcctcgataatcaacaaccatccttaatgacatccttcttttctactagaagcactggcgatccccaaggtgaagaacttgggcaaatatagcctttatccagtaactccttaatctgtttcttaatttcttccaaagcttttgcgggcatcctg

SEQ ID NO: 670326 - DNA, 1036 bp, Homo sapiens
gtagatataatcatcagattgatcacactactagaagcggacttcttcagtaaaagtgaaagccaatgttctacaggtgcacatatcatgatgtgagtagcgagtaaggtagacgtgtagaaagaaatagcagctaaacacgcgatagaccaaagaaaatcccatcagtagtatggacatagcttgatgtgtcattgacagttatcgtggtactcaagatcaaggctagattgtcacaaggttcctgctgaaaaaatgggatgatgtaagaaaagtccatcgtgagatttaaagagctggaaataggtttgaatagaacatatggagggatgaaatcggaaggcctcctcaagatgatataagtacaggcatataagacactgttctatcataattgagtttcataagatagaaatcaaatatcgcaggaaggttgagtactggaggatagggagtaagagtgacgatggtaaaagggactagacatataacgtagaagatcaacctaaattttgaagattaaggaaccaagtaatcaaggatgaatgatagtggagagtaatatgaaaaagaattgagtaaaggtgagatggaaggttgggtgaacgcgtgatattgtaatgaaaataaagtagaaaaaaagtgtggaaaagtgttgtgtgattcaagataaagtgattaaatgcacaaagatgaattgggaatcaggcaaaaagaatcatgaaaaaacaaacacgtgtttggcattgatataaaacaggtgtttgaggataggtgaataaatagagtatggcaaaagaacaagttacaacaatgaagtaactacgaataaatgatggaaaaaggaataagaaaagacaaatacaagttgaaaaaacataaaaatagaaatgcataagagaaaaaaaaagaggtaaaaaataaaaaaggaggatgaagaaaatgagacaataaaaagtaagataaaaataataagaaacaaaagagaagaaaagaagataaagaaaaaatggaaaataaaaaagtagatatatta

SEQ ID NO: 670327 - DNA, 1255 bp, Homo sapiens
gtatgttgtttttgtttttttatgtatgttgtgttgttttatttgtttttatttattatctggtgttttgttttttctttgtatgaagagaaagaaaaatgaaaaaaaaaaactaaaacgagacgttagaggagagaggaggcggggggtggtgctgctgaggatgtcttgacttgaggtatggttgctgtcctatcttgatatttgccgggtgtcgtccgcgtggctgtgtgttttgtcatgtcgttagcagagtgtggtggaccgacgactgggggcaccacatatggcgctcgtgctgggtggttcgcttgtctgctcctgcgcaggtggtgtcttccgcggtgctccctccgccggtttttgttccgcccgtgtgtgccccccctgggtggtggggttgcgcgcgcgcggtcaccatgtagtcgttaattgttgctggtgtcgttgagagaaaaacagcctgtgtggtgcgccccccgcttcttgtggtgggagactttgtgggtgtgccccccccccggattttctctaggtgtggctgttcgtggcgggccgcccctcgttgtgtgtttttatgcgtctcctgtgccgaggaccccccgggtggggctagggctctttttctgtgtcgggctcccgctcctgtgggggggtgccgcatgctttcgtttggtgaacctttgcacccacgccggcgtactcggtcaggggctacgcagcaagatgcagccggggagcaaaaaagacgcggtcagtgcaggttgtctcagatggaccctccctcatgtggtccctcggggacattccacatagatggtttccacatgagttgttttacccgcttttgccggagtcccccccctctgttagataataccgcatggtggagaagacagcgtttatccgaatacccgtgtgttcattcacaatggcgcgcacttctagggcattatgtggtataggaagaaccgggttggacgagtggtgcacacaaggcgtccgtttctacacactttctctacaagtgaataacgagaatatattcttatgtgcggccgccacttgagtgagtattcatgtattgggtccgaggttaggtcgcctgttatctatggttcagtatctactttgatacccacgaccgacttattgattgagtaccgagtctggcgccccataacattctctcgcgcagaattatggggtacccctctacagacaaatgtaaacagggaaacattagtcagagaaa

SEQ ID NO: 670328 - DNA, 386 bp, Homo sapiens
attgtgggcactccagcctgggtgacagggtgagactgtttcaagaaaaaaaaaaaaaaaaaaaaaaaaaaaaaaaaaaaaaaaaagacacaaggctgggtgcagtggcccatgcctgtaatcccagcatttgggaggccaaggcaggaggatctcttgagccagcttgagcaacatagggagaccctatctctacaaaaaaaattaaaaaatttgccaagaatggtggcatgtggaggcaaatggaggctgaggcagtaggatcacttgagcctggaaggccaaggctgcagtgagccctgattgtgccattgtcctccagcctgggtgacagagtgcatactgtttctaaaaagaaaaaagaaaggaaatatataatcagagga

SEQ ID NO: 670329 - DNA, 599 bp, Homo sapiens
  misc_feature (7)..(7): n is a, c, g, or t
tcccccnacggtggcatttgtaggcccatggttgagaaatgatatttcccattaaggagtgtaacagctgaggtctcttaagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaaaagctggtgtctgattgttaagtttaaatatttccttaaactgtgtggactgtgatgccacccagagtggtctttttggaaaggttataggtcactcctggggcctcttgggtcccccacgtgacagggcctgggaatgtattattttgcagcatgacctgtgaccagcactgtttcagtttcactttcacatagatggcccctttttggccagttatcccttccttttagcctagttcatccaatcccccctggggggggtgagggcccctcctggaccctgaaaatttatatttccccatttttatttatatttttggaattttaaataaaaggggtccataaaatgtgatttttttgatga

SEQ ID NO: 670330 - DNA, 246 bp, Homo sapiens
ctaggggataaggactgaatgacgaacggcgtaggacaacgcaggacaacagtagtcttaataattttcactacactttacccggcactagtgatcgataaactcttctgaccctcaccatcaccgtgtgagatggggagggtggtaatctacccaggtcccacaggcgaggcaacagatgctcagagaacttaaagacttggccggggtgcagtggatcatgcctgataatcgcaagtctgggag

SEQ ID NO: 670331 - DNA, 171 bp, Homo sapiens
gctgtgctattctgtttgcgcgactttctgtttgcggcctatgccttcatcgcgacatctcttctttgatccttcgacttcccgtctcttcctatcgatttgacgcactcttcatccccgtcttaggattgttcaccctcctactactgtgagacgtatatgcctgtgtta

SEQ ID NO: 670332 - DNA, 194 bp, Homo sapiens
tagagtatctgagcattgtgtcgaggtcgtcacactgaagatccagctggagtgatctgggcatgtgtgtctgaggcatagtctccactggaacggccagccggtcttttgctttgacgtgagcacgcaatgtgccgtccttcacgccttttcccgttttctatttcagaaccaatccctgacagagatagact

SEQ ID NO: 670333 - DNA, 277 bp, Homo sapiens
ctagggccttgtggtgtgtgcccgtagtcccagccactcgtgaggccgaggcggaaggatcgcctgggcccagaagcttgagactgcagagagccgagattgtgccactgcactccctcctaagcaactgaacaagaccctttaaaaaaaaaaaaaaaggcaaaaaaggaaaaggccaccttttcagtcccccaaaaggttaaacattgatctcgtacattacattggcccagaaatattcggaccctaggtttatcctccaaagacctgaaagcag

SEQ ID NO: 670334 - DNA, 298 bp, Homo sapiens
aaggatcccatgccataacctcctacatacgtgactgatacagcgctatcgcgggcaagcccgctcccacatttattggttcgtgttgattcagtcccagctcaacgcgccgccggtctgatactcgatcacacgggtctcgaagaagttcttctctttcttcaagtccatgatctcgctcatccacgggaacgggttagtcgtgcctgggtactcttccttcaagccgatctgcgacaggcgacggttagcgatgaacttgaggtaatcctccatcatcgccggaggttattggcat

SEQ ID NO: 670335 - DNA, 175 bp, Homo sapiens
gaggatcttcagcatgatcaggaaacacttcagtgttatgtgatggctgctcagtgcactggcctgccacctgtctggctcttctcatttggtgacccttgtggtgacaggttcgagagagacacccgggtctcgctcttcgagggcccttgtgcacatgcatgcacccagtggt

SEQ ID NO: 670336 - DNA, 360 bp, Homo sapiens
gatgtaacgcagtgcacatctcgtcatcatatggtctcctcaatcgggggaggtttgggttgtaatctttgtgtggcaaacagcatccatttctggcaggttggtgttgtgcacagcagtcagccatttaacaataggtttccagaagagttgctaaggtgcatactttgtctccattaagggaatatacggttgcatcatcggttagggtcacaggttcttcaatgggactttgctgaagagcctgagctaagacagctcagctccggggctatgaaattctcttctcccaaatctctaataggatgagaaacctcgctgttgtgggcatcgtgaagacaccctcccgtagaatgagct

SEQ ID NO: 670337 - DNA, 522 bp, Homo sapiens
cgcggtggctcacgcctgtaatcccagctctcagggaggctaagaggcgggaggatagcttgagcccaggagttcgagacctgcctgggcaatatagcgagaaccccgttctccagaaaaacggaacaaaaaaaaaccaaaggttcaaaaaaaaaaaaaaaaaaaaaaaaaaaaaactgtgtggggggcgcgccggggcccgggaaaaggctttataaaaccatgcgggtgggggcgcgggggcccagatagggccagcgtggaaccgtgggcccaagagcgggttcccaagagggaaaccggggccagggaacagagggccggggattccccaccaatatataaaaaacgcgccgggggggaacccgcgaggcggtttcgtgagagacaaattctcacgaatggggggagattccaggagggcgacataacacgggggggactctttcacaccacgggggggcccaaggcggagaggccgcggatatttcaatattaacgcccagaaaccggggggggaag

SEQ ID NO: 670338 - DNA, 223 bp, Homo sapiens
agaagctagaggatccccgaacgagcttctttgactcaaaaggaattggaactagaaacacctttagcatctaagtgagggggggctattacctaccgtcaacgcatgggtcataaatgctaaagcagcaatgttacacgtggggaaccgcgtaaaaaagaattggaataactggaactttaactacaccttgaagaaagagacatagctgaattacagaaca

SEQ ID NO: 670339 - DNA, 358 bp, Homo sapiens
  misc_feature (165)..(165): n is a, c, g, or t
  misc_feature (245)..(245): n is a, c, g, or t
gtgtctcgtgctgtcacccaggctggagtacagtagcgcaatctcaaatcactgcaacctccgcctcccgggttcaagcaattctcctgcctcagcctcccgagtagctggaattataggcgtataccaccatgtccggctaatttttcaccatgtttgccaggntggtctcgaactcctgacctcaagtgatccacccaccctgccctcccaaagtgttgggactataggcatgagcaccatgnccagccaacattaataaggttttagaaggctgattgttaaccctcatggatgactttgaggggttcaagacttcagtggaggagtaactgcagatgtggtagaaatagcaaga

SEQ ID NO: 670340 - DNA, 103 bp, Homo sapiens
cctgcgcagccaggtaggaggctctcttgtgccacataatcgtgtctgtgtcacaaataatcattaaattagctattttcatgctaaaaaaaaaaataacaca

SEQ ID NO: 670341 - DNA, 336 bp, Homo sapiens
  misc_feature (38)..(39): n is a, c, g, or t
  misc_feature (246)..(246): n is a, c, g, or t
caagagactcttggtacccaggattttaaagtaacatnncctggttaagggtagcggccggccgtggtggctcacacctataatctcagcactttgggaggccgaggtgggcagataacttgaggtcaagagtttgagatcagcctggccaacgtggtgaagccctgtctctactaaaaatacaaaaattagccaggcatggtggtgcacacctgtattcccagctgcttgggaggctgaggcatnagaatcgcttgagccctggaggtggaggttgtggtgagccgagattgtgccactgcactccagcctgggtgacagagcgagactccatct

SEQ ID NO: 670342 - DNA, 378 bp, Homo sapiens
tcagcggaaacgggagtaccggcgctgacagtaaagcgatgagcattaaagtaggtttgaatagaggcctttaaagtatgctagagcacgtgtaccctagggaacctatgtcaaaacaattttggtcttactccaaacagaaaaaatggtacacactttagacaaaagcaaaacttcattgtaagatctgtactgtacagctacttgctatagcccatatattcaggtttgttcaacaatctcactcatgacagaaaaagtcagcaaataagacttgggacaaaattatttactatcagtctccacatggaaagaccacagctttaatgaattatacaactccttaagattcactccttggtcagtgccggtttcccg

SEQ ID NO: 670343 - DNA, 282 bp, Homo sapiens
accgccagattctcccttaaggaattgacttcaccaggggtggcggctcccagacccagggcagtgtggtgggagggctctcccaaagagaaggcctggtcagcagagctgccccgcgtccccccagctgctcgaggcacactcgagggccgaatcctttctagtcagcccccgcccctctgttccgccgcaaaggtgcacactcatcgcggccagcatcggccctctgagcaactgtgcagcaccccctcacccccaatctaaacccagaaccactaaaaa

SEQ ID NO: 670344 - DNA, 143 bp, Homo sapiens
tgaagtcttagcatgtacgctcggaggttagggttctagcatccgaggtcgccccaaccgacattttttaatgcagagtttggtcgtttcggacctgtgggtttgttcggtactagtatgcatataatacattaccagctcca

SEQ ID NO: 670345 - DNA, 782 bp, Homo sapiens
aagaggctatttttgctgtcgcgtatgataaatagtgtgtgtggtggagcacacaaaacatttcttgccccctccgtggtgggttttaaagacacgacaagaaatcaaactccgtgtgggggccaaccctcccccctaacacacaatatttttttctcctttcttaaagaggcgtctttagatacactactcgtgcgctcaccactcaccaaacatttccaccacggggcccctctttttggtggaaaatataaggggcgctctctatctttctttctttcacaagagggtgttgaaaacaacacatgggcgccagatatgtgggtcggctggttgaaaacacatattatgtgagcgcccgcgtggagagagagttaaatttctcacacatgtaggagaccgcgtctctccacacaaaagtggtctccccccctaaattttctataggcgcttctcccctattctttatgtcgcgcccctactatgggggctcacacatgtggagagtacaccaaaatttccacaggtccacatagggggttgtggagaagatgggaatttttggggcccgtggcctataggctccccattggtagtggccacaaagaagtttataacattttttttcccacattttttctccctttccaccttttttattggatttagtgcggcacacgaccctttttaaagggattcctctcccggcctcttccaacacccctttcccccaccattttgtggaacttcaagggactttataaaaatggtgtttttattga

SEQ ID NO: 670346 - DNA, 771 bp, Homo sapiens
  misc_feature (23)..(23): n is a, c, g, or t
  misc_feature (78)..(78): n is a, c, g, or t
  misc_feature (116)..(116): n is a, c, g, or t
  misc_feature (124)..(124): n is a, c, g, or t
  misc_feature (134)..(136): n is a, c, g, or t
  misc_feature (140)..(140): n is a, c, g, or t
  misc_feature (142)..(142): n is a, c, g, or t
  misc_feature (155)..(155): n is a, c, g, or t
  misc_feature (163)..(163): n is a, c, g, or t
  misc_feature (174)..(179): n is a, c, g, or t
  misc_feature (189)..(189): n is a, c, g, or t
  misc_feature (200)..(200): n is a, c, g, or t
  misc_feature (203)..(204): n is a, c, g, or t
  misc_feature (206)..(206): n is a, c, g, or t
  misc_feature (211)..(211): n is a, c, g, or t
  misc_feature (214)..(214): n is a, c, g, or t
  misc_feature (219)..(219): n is a, c, g, or t
  misc_feature (221)..(221): n is a, c, g, or t
  misc_feature (224)..(224): n is a, c, g, or t
  misc_feature (232)..(232): n is a, c, g, or t
  misc_feature (235)..(238): n is a, c, g, or t
  misc_feature (255)..(255): n is a, c, g, or t
  misc_feature (257)..(258): n is a, c, g, or t
  misc_feature (262)..(262): n is a, c, g, or t
  misc_feature (266)..(266): n is a, c, g, or t
  misc_feature (270)..(270): n is a, c, g, or t
  misc_feature (280)..(280): n is a, c, g, or t
  misc_feature (282)..(282): n is a, c, g, or t
  misc_feature (287)..(287): n is a, c, g, or t
  misc_feature (291)..(291): n is a, c, g, or t
  misc_feature (293)..(294): n is a, c, g, or t
  misc_feature (310)..(310): n is a, c, g, or t
  misc_feature (313)..(313): n is a, c, g, or t
  misc_feature (328)..(328): n is a, c, g, or t
  misc_feature (330)..(330): n is a, c, g, or t
  misc_feature (338)..(338): n is a, c, g, or t
  misc_feature (345)..(345): n is a, c, g, or t
  misc_feature (347)..(347): n is a, c, g, or t
  misc_feature (353)..(353): n is a, c, g, or t
  misc_feature (356)..(356): n is a, c, g, or t
  misc_feature (358)..(359): n is a, c, g, or t
  misc_feature (383)..(383): n is a, c, g, or t
  misc_feature (387)..(387): n is a, c, g, or t
  misc_feature (389)..(389): n is a, c, g, or t
  misc_feature (400)..(400): n is a, c, g, or t
  misc_feature (407)..(408): n is a, c, g, or t
  misc_feature (422)..(422): n is a, c, g, or t
  misc_feature (437)..(437): n is a, c, g, or t
  misc_feature (439)..(439): n is a, c, g, or t
  misc_feature (461)..(461): n is a, c, g, or t
  misc_feature (463)..(463): n is a, c, g, or t
  misc_feature (472)..(472): n is a, c, g, or t
  misc_feature (477)..(477): n is a, c, g, or t
  misc_feature (485)..(485): n is a, c, g, or t
  misc_feature (488)..(488): n is a, c, g, or t
  misc_feature (491)..(491): n is a, c, g, or t
  misc_feature (493)..(493): n is a, c, g, or t
  misc_feature (499)..(499): n is a, c, g, or t
  misc_feature (518)..(518): n is a, c, g, or t
  misc_feature (522)..(523): n is a, c, g, or t
  misc_feature (525)..(525): n is a, c, g, or t
  misc_feature (541)..(541): n is a, c, g, or t
  misc_feature (556)..(556): n is a, c, g, or t
  misc_feature (574)..(574): n is a, c, g, or t
  misc_feature (593)..(593): n is a, c, g, or t
  misc_feature (649)..(649): n is a, c, g, or t
  misc_feature (660)..(660): n is a, c, g, or t
  misc_feature (666)..(667): n is a, c, g, or t
  misc_feature (729)..(729): n is a, c, g, or t
gggtggagatgtaaaaaaggaangggtgcaccacgctacaaaccactgtcgaaatgaggttgctaagagtcaccttgnggagggagagctgcaggtcccatctcatccagagctgntttgatcngaggtggggnnngggngnggaacgaaagggngggggggngggcgggggannnnnnccccacaaanccaccagggcncanngncaganccngggcntnccnttccacancannnngagggacggaggccagngnngcangagncagngaccaggcangnggccngacngnngggggcaggggggganggngcaagcggacagggngnggggccanggacccngngcaggnaancnngggggaaggggagaggagagaagngggngngggaaagggangagaatnngagaaagccagggnaccaacagggaaccncngagcaggccaggcagggaggancngggaacaancgagnggaagagnggngangnggatcnggaggccagcggggcgganccgnngngccaaggtgaagtgantgcgcaggaactggngcagaagagggaaggtcnttggacagggctgacatcntaggtggggagattgaagccaccctgggaaaatagtacttcaaacccacccctgtntcttcaatacntctttnntcgctgttatcaagactggattgaggccccagaaaaaatccagttacacctgggtgagaganactgtgaaccttatcagctaataatccccgaagtgaagttta

SEQ ID NO: 670347 - DNA, 283 bp, Homo sapiens
tttaattgttgcacgatctgatatctcagagtgtcaaagtctcatcgtagttgatatccgggtgctcagagcagcaccattgcagtccgagaatggcacctaaattttctcgaaggagccaagcaagtacagaatccctgtagggaataaaatctgttgtcttcttctttttactcacctcggccaaggctgagatgactttgcccacagttgtgagagacttattaatatttgctccttcctttaatcgagtccctttggcaccagttgaatcagctcgttc

SEQ ID NO: 670348 - DNA, 191 bp, Homo sapiens
atgtagctagtcaacgagatattccgccaagccagattcgggcgctccacatctagcgcaagtaggtcacgtggtcacccaattctttgatggctattcaactgcatacattcaggtaatgtgtctcaatgaggtcacacaaatgggggtcattttcgtcagtggccagtatagtgcagattccagtagtg

SEQ ID NO: 670349 - DNA, 341 bp, Homo sapiens
ttgcatatggcaaggccaagaggatggatcacttgaggccaggagttcgagaccagcctggccaacatggtgaaacctcatctctattaaagatacaaaaattagctgggtgtagtggtgcgtgcctgtgatcccagccacttgggaggctgaggcggaagaatcgcttggacccagggggcagaggttgcagtgagccgatttcatactactgcactccagtttgggtagcagagcaagactgcgtctcaaaaatatatatatgtgtgtgtgtgcgtgcatacacacacacacacacaatacacatatacgtacgtacaccttggccttgccatatgcaa

SEQ ID NO: 670350 - DNA, 132 bp, Homo sapiens
gatccagaggattacactgtcaggcggattgcacccgttcattgtcagcggattgaaccgtcactgtcaagcggattgcaccgctcactgtcaagcggattgcacgcgtcactgtcaagcggattgaaccgt

SEQ ID NO: 670351 - DNA, 101 bp, Homo sapiens
tgtttggaaatttaaagaaaaaatttatgggaagatctgaaaaacaattcctaaaagatggacttttccagaaatacacccacaataaaaacctgaaaacc

SEQ ID NO: 670352 - DNA, 322 bp, Homo sapiens
tgctgctctgaggacccctcgcgaggtatatcctgagatttgcaattaaaaaaatgaagaatcaaactatattttcttttctgtttttttgaaacagagtctccactctgtcatccaggctggagtacagtggtgtgatctcagctcaacatagcctcaacctcttgggttcaaggaatctcgtgcctcagcctcccaagtagctgggattacaggcatgcaccaccgtgctcggctaattttttcgtatttttagtggagatggggtttcaccatgttggctaggctggtcttgaactcctgaccgcaagtgatccgccca

SEQ ID NO: 670353 - DNA, 1297 bp, Homo sapiens
ggatgacgttcagaccgcgtttctgctggctcgattaacgaagtagtgccgtctcgcgtctgtggtctctcagtgccgcgcgactcgtcgcgccgaggtcgtccgcgaggaccatctcttcagcttccacgcatgacgcctggacagtccaggtgtgaggagcatgatgcggacgactagatgggccgatgttcctccctctgctccagcagtggcaagtggtcaggctggaccgactgtggccttcacggaagcacggatgcaaggatcatcatctctgctacttcgagttcaagcctgacactgggagatctcaacctgcgcaagcaatgagcttgggcgactgtcaggcggtgcagttgcgatgctcctgggtcctgcaggagccgcccgtcctgtaagactccacgtaatgctgatgacctccagactcgtgctgctctgaccgggggctcggctgtccggggatccctgttcaccagcgacaactaacggctagctcctaggcctcgactccgtggcaaggaatcgtggcaaccatccattcggacaagaccatcatttgggagaggaattgcagagggtccttgacagggtggctccttgccagcaaaagggatcatcctggtgaccacccaagatggcacagaccttgggacaagatgcgtgcaaacatgaaaggtatttgacatgccttctcggagcttgccagagaatggcgatgccctcacttaggaccttcgctgtgcttccagtggccaacgccgggaacttcccaggacgcttcaccggctataggcaaacaagacagacaattccaacttgaggtggcctgacacgttccgctgttgcttggtagccaatggcgctggaatggacattcccccattgccaggctggatgggcgcctcaaagcctggcagaaggctgacggtcttgaccatcaagtagaattgcgggaaccctgtgtccgacaattgagtggcgccttcccaatgtgccatcagacgttagcggggaaacattgaggccttgggggcaagcgacgaaacctgggttggaactctggacacggagagagccggtgggtcccacagagaatgaatccaaccccagaaccagaggaatgaagaaaccccgaggcgacccggggaaggatgaacacagtacacgggcaggagggaacaagcgacaaggaaaccagacaaccagcgagacggaagaagcaccaaaggacagaagaaggggagaagaaagaccacgggggtgaaacacagagaaagaagacacagaggag

SEQ ID NO: 670354 - DNA, 452 bp, Homo sapiens
taatttttggtattttttagtagagacggggtttcgccatgttggccaggctggtctcaaaactcctgggctcaagtgatccgcccacctcagcctcccaacatgttgggattataggcataagccaccatgcccagccagttttcatttctttggtctgcatgtaaaggactaaagaatgatatgtagctactacactgcagcaaacaacatttttccagtgtacaaatcagtggagagtaagcaatgtattactctgatgtcggtgaaacacctcaaattataaataatgccaggaacatgtgaaaactccacatgtttaataaatgccagctttcagaaaaagcagagattataggtattcaacaagttaagcaataatctggtagattagtaataatttaacacatgtgtatcttgtatttaaagttaactgaaaattatgtaaaaaa

SEQ ID NO: 670355 - DNA, 518 bp, Homo sapiens
gaatcaggacgctgctttgagatacgacctgacagctgctgccggcatgatggcggcgtgtgagtcgcggatgctcacgggcgcactcagtgcttcacacgggccacaccgcacagactatggtcatgccagcgaagtaacgtgcactgttgctaagactatgttgagtgtcaattactaataagagtattcagagaagattacactgtagttgcataatacaatcaaaaagtaacgtgctgcatagaagagatactgaaatagcgcagcacggaggagaggaaaggctaggatgagaaataggggatgctagggaataatataggaatagggaagagtagagaagaaggaaagaagagtggaagaaaattttccagaggttatacctccaagtcgtctgtgtgtgaaaaacagtataaacctcagaaatgtttgttgggtcttactgatatgcaacctagaaataatttttggtcattacttctgtatggttcacgtcagaatttcggtgcccattt

SEQ ID NO: 670356 - DNA, 167 bp, Homo sapiens
tctagaggatcccatgaaatcccatctttactaaaaacacaaaaaaacatccagggtgtgatggttcatgcctgtagtgccaggctacttgggaggtctgtgacaggagaaatcacctgaacccgggaggcggaggttgcagtgagccaagactgcgccactgcact

SEQ ID NO: 670357 - DNA, 321 bp, Homo sapiens
aggctggtagaaagctccaacacatattctcacataagtagggaataaccccagtatgaattatattatgtgtagtacgggtcgatgactggttaaaggctaagacacataactaacacatacgtaggacgtaactacttttaaaatagaatactactcatgtctacataaggtagtagaggtctggttcaaggcttaagccacaatactatctacatttgtaaggtaacctctccagtatagaatacacaaaagtaaaataaggggttgaagcccagttaaaggctacttccatatgcttacccatctgctagaactaca

SEQ ID NO: 670358 - DNA, 592 bp, Homo sapiens
aatatacagctgaaatacgcctgctttatgggctgaccataatatataaactttgctgaacgagtttgcactaatgtggacccatattggacagggtagaaggaatcttggtttactgaaagctatgcctcacatgttcaatcaaaaacttaactgtcacaaagctcccacatgaacgctatcctgagcactatgcgttcaaactaatggataaatgtcctgattctgacacactatgtgagggcttcgtttaatgttgacaataaccctctgggaaacagttcttttttatacaaagctgcccgaagtaaataggctcgtgcggactatgccatagagcgaactctccagggatcatggagagcactccttccattcaacatttgacacatttgcgtggatcacagtatcttactgaggagagaattccccaatgtgtaatgtgagtggagtcactgatcacatgactgcttattctggacaacgtgttagccgggacaaaaggaagaaattcgcctaataaagtgcatacattgactgcacgcctaaggaaactgtccaatgatgaactatacagttaacacagagactg

SEQ ID NO: 670359 - DNA, 197 bp, Homo sapiens
tttttattaaaaatccaaaaaattttagttgggcatggtggcccccgcctgtatttccagctccttgggaggctggggcatgagaattgcttgaccccagcagccaggggttgcggtgggcctagatggtccccctgccctccagcctgggggtcagggcaagactgtttcaaaaccacccccccccccccccctta

SEQ ID NO: 670360 - DNA, 287 bp, Homo sapiens
gtcttcatatactaccctacctacccttcctgggtactccctgcctctttcgttttgctttcgttttttttttttccagacagagttttactctatcacccatgctgaagtgcagtggtgtgatctcggtcactgcaacctccacctcccgggttcaagtgattctcctgcctcactctactaagtagctaggattacaggcgcccaccaacacgcctggctaattttggaatttttagtagagacggggttccaccatgttggccaggtaggtctaatgaaggacg

SEQ ID NO: 670361 - DNA, 479 bp, Homo sapiens
tcgacaagtctgagcgcgggtctgacggagtccgaaagagatccttgacaactctggcgtgacggcgttgactggtcacatgccattggagccgacgacatggtcggcacgtcatgagggtcagcaaggctggtggttctcacctgatggtcccagcgccgcaccgtaggagagccgatgaggtttcgtaccgctgtcaccctggcactgtttggagcactcattggcggtgctccaggcgcagtcgcagcccccaccgcttctgccacgaccaccacgacctatgtcgattgttcggctcccacgcccggcagggggaccgaaacgagcccgttgaactccctaacccagctcaaaagtgcttttggcccaggcaggaaagtgctgtagcgtcgtgataagtacctgcgttggcactgtcggtcatcaatgcctccggacgcgccggtgccgacattctgctaggttgctacggtgcg

SEQ ID NO: 670362 - DNA, 524 bp, Homo sapiens
  misc_feature (155)..(155): n is a, c, g, or t
  misc_feature (160)..(160): n is a, c, g, or t
  misc_feature (182)..(182): n is a, c, g, or t
  misc_feature (195)..(195): n is a, c, g, or t
caggtctgatttgactagcctgggtcagagtcaggcccatctatatattttaaggctccctaggcgatattaatgtgcccacccaggtttgaaaagccactgtttcagatcatcccagaaaggaagaagagttcaagtaactgaagaggatttancatantagaaactattttagttctgantacatccctgggntaaacagttctcaacttctctgaatttatcatatcactgcgattagtggatggtcttaggattagcaggagcagagaagcaaagatggatcctttatggggaagtaattattgaactagaagaaggaagggtctggtctatcagtaatagactataagttttactggcagtatttctggaggaatattcaaacttcagcaggaatgtcatgagtcaaaagtattatatgcaaataaggccataggggaaaaatatggaagaactccaagtatatttgaaatgaatcaacctctagctgtgctccaggaaaccttttaacatgtttattt

SEQ ID NO: 670363 - DNA, 114 bp, Homo sapiens
ccagctcgcaggaactgcatcaaattgagatcgcgatcttccatgccaggtccgggtgcaacagcgtcgatcaactcgtttacgcgatgcgttttcatctcaatatcgtccaat

SEQ ID NO: 670364 - DNA, 149 bp, Homo sapiens
  misc_feature (75)..(75): n is a, c, g, or t
  misc_feature (127)..(127): n is a, c, g, or t
  misc_feature (144)..(144): n is a, c, g, or t
gatctgtgttagtccctgggatggctccaagggcctgctctaggaaggcagcatgctcagtgggacacagcaagnttcagaatttaaagtagttgcttcatggctctgtggcactcccttttttttncctcggagccttccctnaagct

SEQ ID NO: 670365 - DNA, 107 bp, Homo sapiens
tggaaaccatccttggcctcacaggggcgacgatggggagcctcatctgcttcatctgcccagctctgatctataagaaagcccacaagaacgccccctcagcccag

SEQ ID NO: 670366 - DNA, 288 bp, Homo sapiens
acgtgtctaaaagtcatttcttcagagaagcatccctaatggattggtgtgcctttgttcttcacaatgatcttcctttgtagcagtaatggtaactaattattttataattattattattttattttgagacagagtctcactctgttgctcaggttggagtgcagctcactgcaagctctgtctctggggttcaagagattctcctgcctcaccctcccaagtagccgggactacaggtgtgtgccaccacacccaactaactattttttttttttttttttttag

SEQ ID NO: 670367 - DNA, 113 bp, Homo sapiens
agacaacagtgcctgagacaactacacaagcttcttgtgcttcaaagaagctcttgagtgtgcctgcatctgccagacaccgattgccacgaggatgagtggtctgcagaagt

SEQ ID NO: 670368 - DNA, 676 bp, Homo sapiens
  misc_feature (400)..(400): n is a, c, g, or t
aacaaaatggcaaaaaaaaggctccccccccagggtatcccagggccacagtaaccaaaaatagccaggttgaaggtttggctttccgacccaagaaaaagaaaggtagatgaggcaatattcctcttttaaggaagttataaaagttcttcatttaaaaaaaggtcaggtgcttccaaatgtcaataagaaaaatatttaaagcaagaatcaaatttaaaatgtagagagttctttataaacgtgaacttcaggccaggcccggtggctcatacgtgcaatcccagcattttgggaggcctaggtggcctgatcacgaggtcaggggatcaagaccatcctggcccacatggtgaaaccccgtatctactaaaatacaaaaaatcagccaggagtggtnacgtgtgcctgtagtcccagctactcaggaggctgaggcaggagaatcgcctgaacccaggaggcagaggttgcagtgagccgagatagcgctactgcactccagtctggtgacagagcaagactccatctcaaaaaaaaaaaacaactttttttcatgctgagaagatataatcatcaacacattcttgagcacaactatgcacacaggcacttccgcattcacaagccatgctgtgtgcacacactgatgcccctagattccttttttgaagag

SEQ ID NO: 670369 - DNA, 305 bp, Homo sapiens
gttttatttaaaatccttaatttcaacaggattactcaagaaaaataacgttattggtattaaataatgttgatgtattccctttaattgttgattatttaaaatgtcagtaaaatagtaaatggcactgtacaatgtagtttcatgaagcattctttatagttttcataaaattgatagtctccatggaatattttaagactgaggaagttccatatatcatttgattgtactttcactttattacttgcttgcatgtcataactgatggaaataaaactatgtatatttacaaatatgaaaaa

SEQ ID NO: 670370 - DNA, 984 bp, Homo sapiens
gattcctccgcgcgctgggacaggctgccttcattccgacagaaccgaagcaggtttgcttgctggtcccagactggctgcacccgcatcatcacctgttctgcccatgcgccaggaggtcatgcattcatcggagggaacgtggctcctcaaggttttgaggccaataccactcggtcgggccgcatccgtttcgcacggactcttcgtgggagacatcagtggaggcattcgtctttcgtccccacacgctcggggacgtttactccccatatgtgcgtcgctactaggagacattgtgcaagagcctgcaaaagcatgggcgagcctagaagatttagccatagagggaagtgttaacgttgcgatgggccgcgttctgcaaatagacctaggtgttggaggggacccagtactttgcacgtgcgtaggccaaagggcagtgactcacagtggcgttagcgagaatgttggtgaacaggaggacgctcgagcaagggacagaatgtttgaaccgttgtgttccccgagttcgatcggatgggcataggggaagttccgcgtgacgcttttgcccaatctcctagatttcgcgggccaatagcatggcggattcccaggccaaggcatgaaacgcgactcgaacaagacggggcatattgccctttgatagaacaaggcttccggtgcgtgggatgcggtatcacggatacatattggatccccttggattacaagacaacgcctcgacaggactgggtccgtcattccgcgtcattaaccccccaaagagcttatcacactgtgggcaagggggaaaaccttttttcggattggacagaatttccgtcaaaggggtttacaggtcacttcttgcttcactaccccaggcctggagcacgaccactgaaaacaaaaaggcgtttgcgcgaaccccccaggttgcattcggaaagggattcgggggactagtcggtggatagg

SEQ ID NO: 670371 - DNA, 155 bp, Homo sapiens
ttgaaagactgacccgagctggtaacacttactacaatttgaacccatttgaggttaaacagatagatactgaagttacgatgaagaaataaaaaagaggtatcgcgttatccatctaggtgctcctgacaaaatcagatgatgctgacgagcac

SEQ ID NO: 670372 - DNA, 233 bp, Homo sapiens
cgagccctccgacgcctgcttcaccaccttcttgagtcatcatatttggcaggtttctctagacggcaggtcacggtccaccactgacacgttgtgcagtggggacactggaaggccatgccggtgatcttcccgttcagtctcagggatgaccattgcccacatgccttggtggtcgccagttagaggcagggagttctcctcattgtcgtcggtggatcctcttagtagtc

SEQ ID NO: 670373 - DNA, 658 bp, Homo sapiens
  misc_feature (597)..(597): n is a, c, g, or t
  misc_feature (612)..(612): n is a, c, g, or t
  misc_feature (633)..(633): n is a, c, g, or t
gcctgtgatgccacccaaatgtcatccatgggcgcaggaccatgggctggttgtgagtgggctttagtattgaacagctggatctcaaacctgattcttcctgagccactgattagctggatggttatgaacgagtcatttaacctctatcagcttcaatgtgctcttccctaagacagggataataagagaagttaattcacaggactgttgggaggattaagtgagcttagtactgagcatggcggttggcaaatagcaagtgctcgatgagtattaaccagttaagcactcagcaggtagtagctgtcgctgctgctgctgctgctgttatttgcaagtgggttttgccttctaattcttgccgaattatcttcccgctgcgccacatcaatggcacgatgggtcagggcagccaccttcagtgccccgtaggctcagattcactaacagttagaagcacctgttcctagatgtacccattaatggacaggagagtctgcggcccacccattagggacagagttcccacagccatcctgtcttcccagtcatagcagcaccccttccccagaagcaccctccctcagcagcctnacacctgcctgctangaggtcgtgtggctcatgagncgccccagtctggggccggggttct

SEQ ID NO: 670374 - DNA, 380 bp, Homo sapiens
  misc_feature (370)..(370): n is a, c, g, or t
agaccacatatacccaaatgtatatgtggtatatagctgaatttcttgtttatgatgatgctggtataaacaaactcacgctgactttttttttttgagacggagtctcgctctgttgcccaggctggagtgcagtggcgctatctctgctcactgcaagctccacctcccaggttcatgccattctcctgcctcagccccccaagtagctgggattacaggtgcccgccaccacgcccggctttttgtttttttgtattttcagtagagacggggtttcaccgtgttagccaggatggtctcgatctcatgatctcgtgatctgcctgcctcagcctcccgtgctgggattacaggcatgagccaccgngcccagcctg

SEQ ID NO: 670375 - DNA, 289 bp, Homo sapiens
accaccagtaccagttcttagacggatgcagtgaggaaccagccgcaagctcctgtgctcactggtgaagctgccttgttggacaaacatgcaacattgcagaagagcaccacggaggttcgcagctcactccgccaggtgtctgacgtacagaagcgtgtgcaagtggcatgtccagcatggcatcctgcagcatccattgcacggcagctgcaatcaagcggggcctgtgttgctggtccactgcatgcccagcaaggttgcacttgtggggcccaggtggcagggg

SEQ ID NO: 670376 - DNA, 636 bp, Homo sapiens
  misc_feature (10)..(10): n is a, c, g, or t
cggtcgctgnggcagcggtggcagaatgttggcttccagagcgctgacctgattggcaagagagccatttctacttcggtgtgccttcgagcacatgggagtgttgtgaagagtgaagactatgctttccccacttacgctgatcggcgtgactaccccttgcctgatgtggccccatgtcacgatgctgtctgccagccagaagcgcttgaaggagaaggagaaggccgactggagcagcctttccagggatgagaaagttcagttgtaccgcatccagtttaacgagagcttcgccgagatgaacaggggcaccaatgaatggaagacagttgtgggcatggccatgttcttcattggcttcactgcgctcgttctgatttgggagaagagctatgtgtatggccccatccctcatactttcgatcgtgactgggtggccatgcagaccaagcgaatgctggacatgaaggccaaccccattcagggcttctccgccaagtgggactatgacaagaatgagtggaagaagtgagagccctgctctgccggctccctgcctccctcactccctcggcatgctggaagctgccgtatccaatggtccatgctaataaaagaccagtttacgtggaa

SEQ ID NO: 670377 - DNA, 259 bp, Homo sapiens
gccggaccaggcaatcgaggacaggagaacacctgagctcaggcatcagactctaggataagaaactagttcagcaggaagtgtgcctgtcagcctctttaggcttcatttgctcaaggtgtccaatcccatcgcacattttaatacctcaaatgtcacttgatgcgttgaagactctctagggaactctgagaacagtacccagctgtagtggaaggctcaccttagagcaccttttagttctttctctatccttctt

SEQ ID NO: 670378 - DNA, 357 bp, Homo sapiens
tgatgcacccctgtagttcccagcctactccggaaggctgagtgcaggggcaacttgttcgaccccgggaggtggaaattgcagtgacactgaaaccgcgccactgcactccagccgggtgacagagtgagactctgtctcaaaaaaaacaaaaaagagtttggtgtactaagccattgggggattcaaagattaatagtatatgatctctggacttttaaagaacttagtagagtatacaactaattgtacttggggtggggcaaaaactctgactagaggtgtgtaaacaaagcctgtgtccagaggagggcttattcaatcctgctcaggaaatactgcgttaaagaacggcta

SEQ ID NO: 670379 - DNA, 119 bp, Homo sapiens
gaggaggaatgcgagaggcaggaaggcagttgccgtggcaaggtttctggtcctggcccttcctgctcctgaggccccttcctcatgggtgccagcggaacttctttctagaggtggcc

SEQ ID NO: 670380 - DNA, 310 bp, Homo sapiens
  misc_feature (161)..(161): n is a, c, g, or t
  misc_feature (181)..(181): n is a, c, g, or t
  misc_feature (210)..(210): n is a, c, g, or t
  misc_feature (221)..(221): n is a, c, g, or t
  misc_feature (236)..(237): n is a, c, g, or t
tctgtattgagaagggtcatatttgctttcaaggaggaatgttgtattccctggtagatttgaggagcaggaagctcatgggggcttctgtagcccctctccgaaggagtctttattctgaggatttgaagctgaaacctcgttaaatcttcagaatgatnttaatgaagagggccccaancccccaatggaaaactgtttttagaaaanatgatgatttntgattgcttttgtanntaattctacaggtgttcgagtcttagggaaattaagatttatgacaggaccccacgggggagtaaaaaaaaaa

SEQ ID NO: 670381 - DNA, 302 bp, Homo sapiens
ctcgcaagatatgatggtcacatggataggaagaatgatgagagaaaaggtcatcaggaggtgctcagagcctgcgctgcataggactgagcagaaccactcctccagcttgggtggacctgcacactcctggttccaagtctctcctttcctggcaggtcttaagggaagattgtacccctcagcctttacatacccagaatcatcagtatgtcacttcctaatttctatcagtgtatctcattatttcatactgttttactaatcctgagtctaaacagatttgctcaaaaggagaccat

SEQ ID NO: 670382 - DNA, 238 bp, Homo sapiens
tgagttgtaatgtcgggcggagtagttatgatgggcagtgaggggcgaatatgcatctaggctataatattcggagtatagtagccggtaatgttacaacggtacctctagaatatagtagcatgcgcaatttaaagcgtgatatcgatcgcgcgagatctgtcatgatgatcattgcaatgggatccatatatagggccggggttataattacctcaggtcgacgtcccatggccat

SEQ ID NO: 670383 - DNA, 280 bp, Homo sapiens
tccagaggatcccctgtgtagacaaaagctttttctctgctaactatatgaaaggataaggactgttataattcatgtgcaccccaatgggcaaaagcaaaagactagcttcccctcaagaagaaaaatttcagacctatgaaaagggcaacaatactaataaaaaaaattgtatttacttagaagcattcagaatgtcaacaaaacagctgcaacttttttttttttttcaattacagagtggtattcagttaacagaacaacaattatttcgtataag

SEQ ID NO: 670384 - DNA, 174 bp, Homo sapiens
gacgggggtagggtagaaaatgattggaaagagagaaagaaatttctggggtgatagcaagtgtctgtatctgtggtaaaggtttctgggcacttaggcatatgcatatatcaaaactcatccaacagtgtgccttagattggtgcatttggttatatatagataagcatacac

SEQ ID NO: 670385 - DNA, 787 bp, Homo sapiens
taggacaaaaggtttcactttggggtaaatacattcttcataccaggaccagaggaaacctcagaaaaagtagaaaagggaagtctagtggtgatcaagaaaatcgatagcattgggagtatagagggtgcagataagtgacagaggaatatctagtacttactttaacaaaaaaggatctggacaaagcaaataaagacaaagccaacggatacttttctccaaatttaagggtcagttaaattaaacatttggggggggtggtggactgggtatgctatgtgaggggggttaaattctaggagtacagctgatgaaaaactggctgtgacaagttttaaacttagtgtattatttcgaagcagggtttacgtagcagtaacattgaaagtttctaataaatatacccaatggtacacagggtcaaaaaagcggcattttccctttcctaaattcttgggggttggctgaaatctgggggcaaaggtgcgggagggggctaaatgcacggggatatgaagtaggaatgggagaggaacagaactagatgggaactcagcattggggaatgatccatttggaatgtttaacggttccactcgtgttggcttccaattaattctaaatcccttcaagagggattctttaaaatagacttgatgggtgtcccttctgtgtacactttataagagaccttgtggatattgtaccagtgccctaaaggggcccgtatatttagcaaggggttactcctaaatagatattcacttctccaagattctgggaa

SEQ ID NO: 670386 - DNA, 378 bp, Homo sapiens
tgtcgtggaaggggcggggataggacatggacggggagcgattcggatgcgcatgggcttgaatattagtcatcgtcataactggtgtgagctgtcggcagtcggtgtggcagctgttgtgcgcatagtcccaggtgtggtgaaccggacactctcagtaggattttctgtttgttgggttgatggagcctcgggtgcagtagttgtggctgtgaagtctaccacctctagcacctcaagagctgtagtgaaaacggcatggctaagttcaatcgaagagcgggtggagcggctgctcgagggtgtggtaacgtcacacttaaactcttcgtcgagtagggaaccaagtgggcggagaagtagagggtacggattacg

SEQ ID NO: 670387 - DNA, 406 bp, Homo sapiens
cgttatggcgtgtgtctctgagcgagtcccagtgactattgttgatggacacacttcacttcccagttgcctaggggctcacaccggggagcagtaaagctcacgctcataaacgagtgttagagtcgtgagagtgatacacgcgctgtattagttcttaacgtgttcattctcttcagtccccaattatcactcattactgagtacagactattgttgtgggctcagttgtgtcctccccacattgatcttggacatcccaagcctctgggactgtgagaaaacacatttctgtgtctaagccacccagtttatggtattttgtcatggcagccggggctgaccaagacaactatgtggcaggtactatctaccgtatggccctaaaatgttttaacttcacacg

SEQ ID NO: 670388 - DNA, 637 bp, Homo sapiens
  misc_feature (76)..(76): n is a, c, g, or t
agcgatggcgagcgccgggatttgttgcgcgaggagactgcgagcctcttctctcagtctgccttactaccatgcncgatgctacgagcgcctggggtagtcggcgggcgcagacagacaatgctggtggctactgctgaatcggacacctggggcaggaggcccttttagcgcacaggtgatgcggagtctgcgtgacatgaatacgtgtgctctcagagcattgtattaatgctctatgtgtgactcagcagagagacgctggcgcatgccttaggacactgaccacgagaatctgtacaatggtagtcatgtatcgagatgctagacagaatcttattctcttctctacctatttagaggacatactatccaaacgattacctataattctgaagagtccctcatatccgaggatgaaattcaccccaatgaatggatcctcgggcccgggacgacttatggctggaggtgtaatgcctggaaatttccggtggataatttccacctcgatcaccaatgtcttcaatcctatcgatggaacggaaggaaccaccaatccagctctggggattcggtgtactagaatgattcaggagggataccgatctactcgtagctttgatctaagattatc

SEQ ID NO: 670389 - DNA, 237 bp, Homo sapiens
gtttgacgtggctttctacctatttctttttgaaagaatatttgcaaagtctagctcttggtttcattgtcacagacttagttcagactactcatcatttagttcagaccctcatttctcatactaagtagtaaaactaggtcctaactaggtcttctcaccctagaactcttcctagttttatatacatcctactgcccagatgatttactctaatacccaacatattgatcatgt

SEQ ID NO: 670390 - DNA, 259 bp, Homo sapiens
tcttcccgccagccacgttcagctggcgtcaataagcatctttggggatgtcctgcctcctccaagaccagccatgagtggctcttatgggcaaaggcggtactgcaggccaagcaaacggctctgggctggaatagccctacctgaatgccctgtttgacttcgccactatctgccatgtgagttgggcaaattggtgaccacctctgagccttgaaaaagtaagaaggtactttgttagagcaaaataataaaattt

SEQ ID NO: 670391 - DNA, 335 bp, Homo sapiens
acctaaagcaaacgccgacagtcatgagttgggcctaaatgggtccactgtggagggaggagctatgcctgttgaggctgctggcaggcaggcagaaatttggcctggggcagcgtgccatgatgcaagagctgggcctggaaaaagcccctgggaggcaagagcagggcctgcagagtgctgttctcatgtcatagctgttcctgggcatgccactgggaagcagaaggtgggcctggagagtttgacttgaggaagttttgggcctacattggccgccatgagctggacaggaactgggccaaaaaggctgttgtgaggcagcagttgtgcct

SEQ ID NO: 670392 - DNA, 363 bp, Homo sapiens
  misc_feature (179)..(179): n is a, c, g, or t
  misc_feature (207)..(207): n is a, c, g, or t
  misc_feature (242)..(242): n is a, c, g, or t
  misc_feature (255)..(255): n is a, c, g, or t
  misc_feature (271)..(271): n is a, c, g, or t
  misc_feature (277)..(277): n is a, c, g, or t
  misc_feature (327)..(327): n is a, c, g, or t
  misc_feature (331)..(331): n is a, c, g, or t
  misc_feature (334)..(334): n is a, c, g, or t
  misc_feature (341)..(341): n is a, c, g, or t
caaaatactccaaagatgacttcccctgcctcctactccagtatgacaaaggaggatgtaaggccttagccatgatttgcaggggtttgggagtcaggcccggccaattgcttgggtttctttctatttaaaaatttaagttcacagggttttttattcccccctaagcttttaaaggntcatggccctgtagttaggcctggctcnttttgcccctttccagggaggtggaaggaccctgngccctccttcccnattttttttttcaggntcgccnaggcctaggacctatgttgtaattttactttttatttttaaagttgtagngaanctntcccccntaataaaggttgtgaatgttca

SEQ ID NO: 670393 - DNA, 116 bp, Homo sapiens
  misc_feature (17)..(18): n is a, c, g, or t
  misc_feature (112)..(112): n is a, c, g, or t
gtttaacgtccggcccnnacactatcccgagtctcgacgatcacgggatgggacggttcgccgagagcgcggtaggcggccgcgccttctccgcggcgacctctgccacgtngagg

SEQ ID NO: 670394 - DNA, 111 bp, Homo sapiens
agaaggataagatcagaagagaaagacaaagccttagaacaaaaggatacatgccctgtgaacagaaggacaatgaccctgtgaaccaaaagataaagacttgtgaacaaa

SEQ ID NO: 670395 - DNA, 211 bp, Homo sapiens
ccggtccgcttccgctccacgttccgcgactgggcgggagacttcactgacttcccgcgcgagctgatcgaggccgccctggcccacaccatcggcaatgccgtcgagcgcgcctatcgtcgttccgacgccttcgccaagcgccaaacgctcatgcaggcatgggccggtttctgcctgaagaccgccgccccgctgaagccagcggcgg

SEQ ID NO: 670396 - DNA, 244 bp, Homo sapiens
ccctgtactgcgctgggatatagtaccgtaagggaaagatgacaaattatcacctaagcataattataccatcggactaaccccgtgtaccttctgcataatgaattgaactagaaataactttgcaaggagagcctgcagcaaagtacccccgtataaccacgacgacgctacttatagaacagtctataatgagcacacccgttctactttcgcatacatatgtgcgaagcatttatagtgc

SEQ ID NO: 670397 - DNA, 748 bp, Homo sapiens
ttcgatcagcagcagctcgctaatttctgccggattctggctgtcaccatttcagagactggatacagggaatgatgacaagcacacgcttcttgccaaaaatgctcaagcagcaagaagagcttgagtttggtggccttctgcagcgtgaagaatcaatccaagactgggccctatcgtcagcgagttcctggtcctttgttgaggcggcgtttgcaaactggcgactcgcaataggtgtcaggatgtcaacgggcagcagcccagacttccttcaggcacgttggataggagtgggtacacatggctagacaatgcttgtgggtgctagactgcccctgaatgcagaggtggaccaagtgatgcgtagtcatgcagtcaacaagtcgaagcctctcacttgtgtctccgctcctccagggagctgtctgaggagaatggcctggcctcacacgtcagccagaacccagctgccccagttcaattgaacgattatgcagtgaggatcatgtacatagactagtgcaagtgctcgtatgtcctctgccgtgactgctgatggggcgtcagccgaaaccagtgttcacagaactgattgtcagagttcaggctgtatccctggacttgaataatgtgtgtgacaaacgtgatttggagggcagctattcagcatctggccttgtactccatggtcgacaacagaagtgtgactgtagcccggacatgaccttggagatcacagatgtga

SEQ ID NO: 670398 - DNA, 129 bp, Homo sapiens
tggggatacccgtatcggacatgagtgaatggatgtgccttccatataaaagcacgataattatgtgttctgagtggaggcatgacctccgctgattatactctctctctcagtctcggctggggactc

SEQ ID NO: 670399 - DNA, 474 bp, Homo sapiens
ggtcggggtttcctggcttcaacagtgcttggacggaacccggtgctcgttccccagcccgtgcgggacggccatagccagccctccgtcagctcttcaccgtgtgcctcggactgccgatgggcaaaccgaccgtctcaggctccaggcggccgatgcagtcacaaactgcgcgcgcggacgccgcaccgtactcctatagctcggccagcgcatgacgaccgcgatccacctcgtcaggatgctccagaactacgaccagaactcagagtgccgtcatcaacccgccagaatcaacctctggagcatcttacgctctccttacgattctacacgtgttccagtggtcgtaacgtaacttggaccagcagatgatgatggccttatgaaaggaacgttgtgcgcacagtagcgtatggtcatctcacacgcaagtcagtcgagtagacgggaagggagggacagccaatttga

SEQ ID NO: 670400 - DNA, 482 bp, Homo sapiens
cacagagcacatgtaatcaagaaggagggagtgtaaatggattcagtgctgcatgagctgtcaagaaagaatgaagcttgaccagggactgatgaattaggcagtgagctgtccagtcactagtggcccctaggggagcagattccgaatttgttgctttgaatatagaggctggagttgtaaagagttaagcgaggaagagatggtgggaaggaggaaggctgacagcatgtcgtaaccactttaatgaatttggcacctctactttgagtgttcaatattctttttgaagttagtggtagaatatatattgacctgggtcagcacagatataattaagctgggtcaaaacaatacaaaattagacacatctgtccttaggtattcctgttgcatagatctgatttaaattctcatctgacctttacagtgcattctatatacttctgtattcacatttctctacaaacacttaacatctt

SEQ ID NO: 670401 - DNA, 349 bp, Homo sapiens
ggtcgacctggaagagaaatgaccaatcaaaaacctgaaaactaggagtaagtacagattttaaaaagtcaggccaggtacggtagttcacacctataatccaagcactttgggaggctaaggcaggagcattgcttgagttcaggagtttgagactagcctgggcaacagagtgagactctgtgtctacaaaagaatttaaaaaataatcgggcatggtggcgcacgcggtggtcccagctacttgggaggctgaagtgggaggatcacttgatcccaggagggtgaggctgcagtgagctatgatcatgccactgcactccagcttgggtaacagagatgccatctc

SEQ ID NO: 670402 - DNA, 223 bp, Homo sapiens
gatctactgacagctgcagtctcatcggatttgagcttctgtgcccagctggcccgatcgaagggactaggatagtatctcgtatgactgcgtggtagcttgggcataggggctccacgtcagtgatgcctcaggagacaggaggaggaacttgggtggagtccacaccggcgggcagcgtgtattatcgcgtgaagcaccgggagatgtaggcatgctcgtc

SEQ ID NO: 670403 - DNA, 934 bp, Homo sapiens
ggttacaagatctggcaaaagcgagctggcagaaccaattgccattcgtcctactagtgaaacagtaatgtatcctgcatatgcaaaatgggtacaatcacacagagacctgcccatcaagctcaattcagtggtgcaatgtggtgcgttgggaattcaagcatcctcagccttgcctacgtactcgtgtaatttctttggcaggaagggcgacagtgctttgtgctaccgatggaagaggcagtcggaagaggtcttgcagatacttgatcttatatgctcaggtatatgaagaatcgtcctggcaattgctgtagtaaaaggaagaaagagggaaaaggaaaaatgtgcgtggaggagactatacaaactacaatagaagctaatgtatatctgctagtggaaggagctatccaggtaggaacatcacatcatttgagggcagaattgttccaaaatgtctgaaatcgtttctgaagatccaagagataccaggagagaagcaagtttgcctatcaaaatcgtcctggggcctgacaacgtcgaactattggtgtcatgaccatggttcatggggacaagcatgggtttagtattaccaccccgtgttgcatgtgttcaggtggtgaacttagttccttgtggcgattagcgcaatgcactttctggaagaagacaggaaagcgtgatgccaaatgcgatgattatcgaagcgagtactcaagtgtgaccatccgcgtagagctgattacgagataattattctccggtgtggagtccacctggggcccgggggtcccgttacttgtattggccgtgtttgagacaccggtgtgtgtgcgtcacaaagatattggggaaacgaaggtcgcaaagggacccaatatccatttggggaacagcacacttacaggagaaaaaacacaatcagtgc

SEQ ID NO: 670404 - DNA, 919 bp, Homo sapiens
gctctctcaatggcaccctaatactgtgcccatcattcaccctaggcaaactccttatttacgccctcccaatttgaacacctttccctcttgaaacccctctaaccctgtggaatcccctccccccgactttccataataaatgctgctccctctacaaccccgcatttttgtaaccacaagctttcccccccattactgttacacaattctccacgcaacgctttcctgtcatatacccaagccttcctctgtcatcttcatatctacccttggcagtccccctcttcagtgtccctcttttccagtgcccgtcgcccccccgtgtgctctcttccaattctgccgccgcagtgggtccgtccatctttgtccctccccgtgggcagtcccccctgctctgctggttccccgcccaatgctcggcacgttcttgccacctctcctcgtaggtgtccacctctcgccgcgagccgcctgctgtcattgctgttgtccccccagaaagggttcccccccgtgtgttcagtcccccccttctttagggggggagtttctctccaagccaaccccatggtcaaaattggggcaaccccaaaatactgtcataccactccatgacacatgatcattcgccctgttccacaacatgtaaatatatctccgcgtcacgtcgacccccactaacatggctttccaaagtgtcattcctcccctaatctctctcgaaccccacccaccagaccgtccacctctttctcctgtccgtcgtccacgtcgaccaccacccctttctctatccttccgaagtcttaagaaacaaaaaccatgctccccataaaagtttacttcactggcaccttcccctccccgccggaaaatagaccccatttttaagagggggcaacccacataacaa

SEQ ID NO: 670405 - DNA, 156 bp, Homo sapiens
tctagaggatccctgatgttatcgcccaacagcatgtcggctaattttttatatttttagtagagacagggtttcaccatgttggccaggatggtctcgatctcttgacctcgtgatctgcccgcctggcctcctaaagtgttggggataacatca

SEQ ID NO: 670406 - DNA, 152 bp, Homo sapiens
actctctgggcagacggtgctctaatactggtgatgctagaggtgatgttttcggtaaacaggacggggataacgtattatgacgagattccgttttacttgtttttaatggggatgcgtctagcagtctgacctggatggctagtgctagg

SEQ ID NO: 670407 - DNA, 299 bp, Homo sapiens
cctgctgctgtgggctttctgagggcgcatgggaagtctagttctgagagctgaaggaagctgaagactgggaacaaccgtttctcctcggaaagggccaatgctacgggttctagtaggcaggagtaggagatagcaatggagcaagtccgcttctttgtgtcacctattacgttctagtcttacctctaggtgtgttccctggctggtggagaatgaatggcgaagccgcctgacaaggagaacatgaagtggtgcagcaatctgtaggcccacaatcataaggtttggccgccaaa

SEQ ID NO: 670408 - DNA, 314 bp, Homo sapiens
gaaatataacaattgcatgggaagtcaacattgggaaagctcagatgcttaaaaaatgtaacgcgtaaaaatgtcttctgtctaccctcatgcttgattgataatggggttacatgaagacttggttgaaaatcatttttcttcagacttctgaagattatgctcctttgctttgagctccccagtgttgtctccgaggagtccaatgtccttcctgatttcagatcttgtatatgatacctatggctccacccaagaaactttcatcttcgcttggttcccagtattctgacatatgtcaatgccatccttta

SEQ ID NO: 670409 - DNA, 373 bp, Homo sapiens
ctcctgagagaacgtcatgggattgtccccagggcaaagcctcttttcatccacgtaaataaacttgactttatttctctgcttctcatttagataaccagcgctgttccagagttaggcttcataaagctgcatgaggatattcttgagccagtctctcatccgtagaggaaactgaatcacttcaaagtccgtacaagtaggaatagatttgcaggctccaaaataataccagctggagttagatgccccttataatggtcccctccagtctgcatttagtagcgaatagataacaggaactagcataggtctgattgtcagtgccacaaaaacccttaatcaagttagtggcactgacaatcagaccttg

SEQ ID NO: 670410 - DNA, 1074 bp, Homo sapiens
gatcatggcgtcaatgcagaaaacgactactagaaagaacttgtcggtccttagctaaatctgacctcacctgtcctgggaatgacctttaactgagtaagagtgttcaatatattcaatagttacagcatgtggattgtagcacatggtaagggtgcgaacaggttacctttatatgtacacggggaatagaaattttcaatctatctatattgaatagtatatagctagctcgagtatgcgcgttcttgaaaccgtcatccgtgcaggttacgatgtttctacgtggatgaagagactagttcactggtttcattccatcgactgttataatacgccaagtggctcaatatcctggtattaatcccaatttcttagaccatgaacgactttggtctcgctcagcagctcctcaatggtcgcgaatcacggttatgatcttaggctacttaaatctaggccatgcctattccacgcgtgcataaggaatacaggagactgagccatccgggattacacttctttttctacttgtgcgaaaccggttgtataacacaggaacattccaatacgcaaccaacgaaacactggtgggatactcactgacggggcaaacccaattttttggccgctaatatggcgctagaggcgtggggttcttatggaatacttccctggtgctcactaaagtcgagttcacattcacagctcctcaaaggccatccccccacagaatgcgtgggcagatctaccaggtgctatgaagcccacatcttcgacgagtagcccaaggaaaatcatttattgcactactttgttaggcttggccaagctggttatattcatcgctaccgtagccaggaaagcatagtgtccctatcatggacgaaacaaagttggagcaacctcttaggattccagtatccaagctcctttttggaacgctttttaatcactcttggacttggcgaaatgtggaccctaatatgggcaacgtgacatgaacttacctttccttttttaacttggaatatttaacctccggtggtgacaatatccgggggcaccaatgtg

SEQ ID NO: 670411 - DNA, 465 bp, Homo sapiens
  misc_feature (38)..(39): n is a, c, g, or t
gatccccccgctctgcacccaccccaaggatgcctatnncaatgtgaccctggatgtggagctggctggcgtcgaactgcggacctcaggtgatctgcctgcttcagccttccaaagtgctgggattacaggtgtgaaccaccacacccagcttcactgagctttttaaatgtcattactttgaattctatttctggaatttagtaaatttctttgtcattggaatctgttgctggtgaattgttttgcttcttccaagtttttgaatttgcttttatagacagtgactttttctcaaagatgtacctatgatattggttgggttggcatgttggcattgattcttggcacttgtagtattgtagtctctgtataattcctttggctataaacagtatcactgggctctgatttcctcagtgacttaggatatgggtgttgttggagactggggatcctggcagt

SEQ ID NO: 670412 - DNA, 932 bp, Homo sapiens
  misc_feature (399)..(399): n is a, c, g, or t
  misc_feature (536)..(536): n is a, c, g, or t
  misc_feature (541)..(541): n is a, c, g, or t
  misc_feature (568)..(568): n is a, c, g, or t
  misc_feature (689)..(689): n is a, c, g, or t
tatttccagcagcgagtcctttgccacaacctgacagtcaactttttctcactgttactgatatcgccaaacctccaggggaactacacctgtttagccttgaatcagctcagcaagagacatcgaaaggtgaccaccgagctcctggtctactatccccctccatcagctccccagtgctgggcacagatggcatcaggatcgttcatgttgcagcttacctgtcgctgggatgggggataccctgaccctgacttcctgtggatagaagagccaggaggtgtaatcgtggggaagtcaaagctgggggtggaaatgctgagcgagtcccagctgtcggatggcaagaagttcaagtgtgttacaagccacatagttgggccagagtcgggcgccagntgcatggtgcagatcaggggtccctcccttctctctgagcccatgaagacttgcttcactgggggcaatgtgacgcttacatgccaggtgtctggggcctacccccctgccaagatcctgtggctgaggaaccttanccagnccgaggtgatcatccagcctagcagcngcatctcattacccaggatggcagaactccaacctcactatccacaagtgctcccaggacctggatgagggctactacatctgccgagctgacagccctgtaggggtgagggagatggaantctggctgagtgtgaaagaacctttaaatatcggggggatagtgggaaccattgtgagcctccttctgctgggactggccattatctcaggggcttctgttgcattatagccctgtgttctgctggaaaggtaggaaacacttccagggtgacaaaacatggatgatgtcatggtttcggtggattcagaagaggaagaggaggaggaggaggaggaggaggaagatgctgcagtaggggaac

SEQ ID NO: 670413 - DNA, 355 bp, Homo sapiens
  misc_feature (62)..(62): n is a, c, g, or t
  misc_feature (64)..(64): n is a, c, g, or t
  misc_feature (75)..(75): n is a, c, g, or t
  misc_feature (94)..(94): n is a, c, g, or t
  misc_feature (129)..(130): n is a, c, g, or t
  misc_feature (134)..(134): n is a, c, g, or t
  misc_feature (136)..(136): n is a, c, g, or t
  misc_feature (175)..(175): n is a, c, g, or t
  misc_feature (184)..(185): n is a, c, g, or t
  misc_feature (187)..(187): n is a, c, g, or t
  misc_feature (223)..(223): n is a, c, g, or t
  misc_feature (322)..(322): n is a, c, g, or t
  misc_feature (347)..(347): n is a, c, g, or t
caaagcgcgtcggttaccggctgcatgggttaaggtgtacaaggttatattaaaataaaagngngacgtgcgcgnataagggcggtattagtgnctaagcgacgtatcgtaacagtaccggccacggtnngagntnttcacggtcgttatcgttttcatcatgcaggtcgagttngcacgaccnnanttggcgtgcgtccaacgtttccgagtgtaaatactncgtccttagtcataatgagtaatacagcaatgctaattaatatcaatatcggcagtacagccacgcgacgctcgccaaatatcttcgcaagttagaaangaacgtcagcggccgtggcgggcgnaccagggt

SEQ ID NO: 670414 - DNA, 553 bp, Homo sapiens
aggatccccagatgaattgttagaaaaagtatcagagaattaacttaatctgcttatgagattttggcttgaatctggggtaagaactgttagccctgttgtacagatgaggctgctggtgcctggcaggttcccgcagccagcaaacccttttatcttttttttttttttctagacagagtctcgctctgtcgctcaggctggagtgcaggggcatgatcatagctcactgcagcctcacactccggggcccagcggattctcctgtctcagcctccccgagtagctggaactacaggctcatgccaccatgctcagccaatttaaaaaattatttaagagatgtggtctcactttgttccccaggctggtcttgatctccaaggctcaagcgatccttctgccctggccccccaaagtgctgggattagggcatgagtcaccacccacagccttcacttccaatttttatgttcaataatctatttgttggagatggagtctccctctgtagcccagtctagagtgcagtggcccaatctcagctcactga

SEQ ID NO: 670415 - DNA, 488 bp, Homo sapiens
  misc_feature (391)..(391): n is a, c, g, or t
caacaaaaaagacatgaggcatagagactaaagcagaaaagaaatccttctctcctgctttctttcaaagggggaacaagtaacagggaggctacctcaatttttacctctccagaaaaagacaggaagcaggacacaggctactgtaagtcagggcataattcattgctctgatggttctccaagtgccatccctgagccagcagcattcacatcccccaggagcttgttagaaactcaaattctcgccaggcgcagtggctcacacctgcaatcccagcaccccgggaggccaaggcagacggatcacctaaggtcaggagctcgaggccagcctggccaacacggtgaaaccccgtctctaccaaaaatacaaaaatcagccacgcgntggtggcagacgcctgcaatcccagctaattgggaggctgaggcaggagaatttcctgagcccgggagacaaatgttgcagtgaaccgagatcgtgc

SEQ ID NO: 670416 - DNA, 869 bp, Homo sapiens
ccgcgcttatggttccacgaatccacacttctagggaatgccccagtggggggtcccagaagctccaataggtgcatcggcatatggcgtcataagcctttattagacctgggttagtagtaaagggttaaggtgggccaaggatgggtgtaagtgctctgttccgcttagttagtttcttcaatgcatggtatgttatcatacaatgtagagagttagagttgtaagattaaggtgtagagggaaacttattagaagtagcacagggcggatggtgttgagacgcgtgcggggttgcaggcagaagaggcccaggatatgttgatacgtactttctggagagttctaaggtgcgtctggttagttgtgtgtgtgtgtacactgtgacatctttgtagcagtgcttgtgttgttcaagttcctcgtagtcagtttttgggcttgctctggtattgttgtttgtagtaggtctaggttgttgtaaagaatggcataagtactgcgctagtagtcgtgaatagacggaaagcacgggctgtgttaaggtcagctgagcttagtgagaaaggcaagagcagctggtagcaggttagtgttaagcaggcatacatcaagcaggtgaaaatgataagtccatttagatcgtttaatgctcttggaaatgcgtgtaagcagtagctgcaagtaatcagcagctgctgggaaagaagcaagcgaaactttcccttgtggagaggagggattgttccgtgctcgtagtagtaaggcaagcagtagtttgttagagcattaaaatatatataagttgttgcaggtaagttgttgacttttttaactatagttaagtgttaacctcacaagctgtcaac

SEQ ID NO: 670417 - DNA, 907 bp, Homo sapiens
  misc_feature (374)..(374): n is a, c, g, or t
  misc_feature (511)..(511): n is a, c, g, or t
  misc_feature (516)..(516): n is a, c, g, or t
  misc_feature (543)..(543): n is a, c, g, or t
  misc_feature (664)..(664): n is a, c, g, or t
tatttccagcagcgagtcctttgccacaacctgacagtcaactttttctcactgttactgatatcgccaaacctccaggggaactacacctgtttagccttgaatcagctcagcaagagacatcgaaagatccccctccatcagctccccagtgctgggcacagatggcatcaggatcgttcatgttgcagcttacctgtcgctgggatgggggataccctgaccctgacttcctgtggatagaagagccaggaggtgtaatcgtggggaagtcaaagctgggggtggaaatgctgagcgagtcccagctgtcggatggcaagaagttcaagtgtgttacaagccacatagttgggccagagtcgggcgccagntgcatggtgcagatcaggggtccctcccttctctctgagcccatgaagacttgcttcactgggggcaatgtgacgcttacatgccaggtgtctggggcctacccccctgccaagatcctgtggctgaggaaccttanccagnccgaggtgatcatccagcctagcagcngcatctcattacccaggatggcagaactccaacctcactatccacaagtgctcccaggacctggatgagggctactacatctgccgagctgacagccctgtaggggtgagggagatggaantctggctgagtgtgaaagaacctttaaatatcggggggatagtgggaaccattgtgagcctccttctgctgggactggccattatctcaggggcttctgttgcattatagccctgtgttctgctggaaaggtaggaaacacttccagggtgacaaaacatggatgatgtcatggtttcggtggattcagaagaggaagaggaggaggaggaggaggaggaggaagatgctgcagtaggggaac

SEQ ID NO: 670418 - DNA, 672 bp, Homo sapiens
  misc_feature (207)..(207): n is a, c, g, or t
acgccgcccgcacggactgggacccgcgctcgcaggcagcgctgtcactgcgccacctgccccgtgtgcgcaccacctacggcttctgcgcgctgctcgagagcccgcacacgcgccgcaaggagtcgctcctgctcgggggcccgcccgcgcaccggccccgggcccacagctgcggcggcggcggaggcccggacgcccccctgnggaccctgtgcggcccgcgaggtccgggcccggccacccccgcggcccccggcggtccccgcctgccccaggacgcgctcgctgcggggccccgccgctgccgcctcctgcgcgtccccgacgggctgctgagtcgcgcgctgcgggctggaaggagtcgccgcctggcccgcgtccgctccgtctccagcgggaacgaggacgaggagcgccgcgcgggatccgagtccccggcccgggccccctcctcgagcccgctgtcatccagggccccgcttcctgagcgcctggaggccaagggcaccgtggctctgggccgcgccggcgacgccctgcgcctggctgctgagtactgtccgggaacccggcgtctccgcctccggctgctccgcgcggagagcctggtcggaggcgcccccgggccccgcgccgtccgctgccgcctcagcctcgtcctgcggccgc

SEQ ID NO: 670419 - DNA, 317 bp, Homo sapiens
tagaaggagtcaccccatgggctgcgtccggtgcgttgccagagtcattaaggcagatgagcgccgcgcgggatccgagtccccggcccgggccccctcctcgagcccgctgtcatccagggccccgcttcctgagcgcctggaggccaagggcaccgtggctctgggccgcgccggcgacgccctgcgcctggctgctgagtactgtccgggaacccggcgtctccgcctccggctgctccgcgcggagagcctggtcggaggcgcccccgggccccgcgccgtccgctgccgcctcagcctcgtcctgcggccgc

SEQ ID NO: 670420 - DNA, 205 bp, Homo sapiens
cggcacgagggggaccgccgggggccgcgggggtggccgggcccggacctcgcgggccgcgccggcgacgccctgcgcctggctgctgagtactgtccgggaacccggcgtctccgcctccggctgctccgcgcggagagcctggtcggaggcgcccccgggccccgcgccgtccgctgccgcctcagcctcgtcctgcggccgc

SEQ ID NO: 670421 - DNA, 363 bp, Homo sapiens
atgcgtcatcaactcataaagtctaccatatcctttagcaatactagcaagggcgatgcagcctctgtcatacatctaacacctacattgatacagtacttttgggcattccagatcgtacagcacttcacaatcacagacgttactagctattatcaattcattagtgcagagattctctctgccactcatgagggaagggttctgttttataccctgctgtatccccagcatttagcagagtacctggcatgaggccgggcacggtggctgacacctgtaatcctagcacttagggaagctgaggcaagtgaactgactgagctcaggagttcaagcacagcctgggcacacattatggag

SEQ ID NO: 670422 - DNA, 770 bp, Homo sapiens
agcggctggagtgcagtggcgccatctcagctcactacagcctcggctggccttccgggttcaagcgattctccagtctcagtctcccgagtagctcggattataggcatatgccaccacgccgagctaattttggtatttttagtagaaacagggtttcgccgtgttggcccggctggtcttgaacttctggcctcaggtgatccaccggccttggtctcccaaagtgctgggactacaggcgtgagccaccgcgcccggctgtaatccagattttatatttgtttttgcttttgttttaagtatttagtatttgagacggagtctcgctttgttgcccaggctggagtgcagtggcgcagtcttggctcactgcaacctctgcctcccaagttcaggcaattctcctgcctcagcctcccgagtagctgggattacaggctcatgccaccacaaccggctaattctttgtatttttagtagagagggggtttcaccatgttagccaggatggtctcaatttcctgacctcgtgatccatcctgctcagcctcccaaagtgctgcaactacaggcgtgagccaccgtgcccgggcctagtcttcatattctaagttttctgctttcaggtttgtcctcatggtactaaacatattagaatgaccaccttatacattagcaactttgtttacatatataactatttcccaaggttaaatcctatacattgtattatcagtcacaggatatgaatgtttacaaggcttgtg

SEQ ID NO: 670423 - DNA, 105 bp, Homo sapiens
ttcaagcaggatacccccctcgaaacccagttcactactttcctttccccatatagagtctctatactgttgaagtgaatatactagatttgttatcataagtta

SEQ ID NO: 670424 - DNA, 838 bp, Homo sapiens
  misc_feature (51)..(51): n is a, c, g, or t
  misc_feature (67)..(67): n is a, c, g, or t
  misc_feature (74)..(74): n is a, c, g, or t
  misc_feature (118)..(118): n is a, c, g, or t
  misc_feature (138)..(138): n is a, c, g, or t
  misc_feature (150)..(150): n is a, c, g, or t
  misc_feature (154)..(154): n is a, c, g, or t
  misc_feature (156)..(157): n is a, c, g, or t
  misc_feature (159)..(159): n is a, c, g, or t
  misc_feature (164)..(166): n is a, c, g, or t
  misc_feature (168)..(171): n is a, c, g, or t
  misc_feature (180)..(180): n is a, c, g, or t
  misc_feature (186)..(186): n is a, c, g, or t
  misc_feature (191)..(192): n is a, c, g, or t
  misc_feature (203)..(204): n is a, c, g, or t
  misc_feature (207)..(207): n is a, c, g, or t
  misc_feature (217)..(217): n is a, c, g, or t
  misc_feature (220)..(220): n is a, c, g, or t
  misc_feature (222)..(224): n is a, c, g, or t
  misc_feature (227)..(230): n is a, c, g, or t
  misc_feature (232)..(232): n is a, c, g, or t
  misc_feature (240)..(240): n is a, c, g, or t
  misc_feature (243)..(244): n is a, c, g, or t
  misc_feature (247)..(247): n is a, c, g, or t
  misc_feature (255)..(256): n is a, c, g, or t
  misc_feature (265)..(265): n is a, c, g, or t
  misc_feature (268)..(268): n is a, c, g, or t
  misc_feature (276)..(276): n is a, c, g, or t
  misc_feature (285)..(285): n is a, c, g, or t
  misc_feature (291)..(291): n is a, c, g, or t
  misc_feature (296)..(296): n is a, c, g, or t
  misc_feature (299)..(299): n is a, c, g, or t
  misc_feature (311)..(311): n is a, c, g, or t
  misc_feature (336)..(336): n is a, c, g, or t
  misc_feature (338)..(338): n is a, c, g, or t
  misc_feature (359)..(359): n is a, c, g, or t
  misc_feature (392)..(392): n is a, c, g, or t
  misc_feature (402)..(402): n is a, c, g, or t
  misc_feature (411)..(411): n is a, c, g, or t
  misc_feature (429)..(429): n is a, c, g, or t
  misc_feature (550)..(550): n is a, c, g, or t
  misc_feature (554)..(554): n is a, c, g, or t
  misc_feature (824)..(824): n is a, c, g, or t
cgggtgagggcgctggggccctgggcaacgcgggctcgatgtgtgtcaacnaaatagctggtcccantggagcnggagaaaaaaaaaacgcaaaaaaaaaaagatgtctctctcaaantggcacctggcggtgaagcnggctgaccaacnaatnanncnaaaannnannnntcggttgcnaaaaanaaaanngggagaataanngcnaaggggctanaanannncannnntnaagaaacntanngcnggcaaaanncaaaaatangtnccaaaaantaaactgantaaaanaaaanaanatagtcggaaanaaaaaaagaaaaacacttgaattcnanagcattaaaaatgggtccaangtccatgttctgcaaaaatactggcctgaaccnaataaaaaanaggaacacngtggacaaaatggctgcnatgagagagttccgggtgttgcacactgccctgcacagcagctcctcttacagggaggcggtctttaagatgctcagcaataaggagtctctggatcagatcattgtggccaccccaggcnttancagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaaacaccangtccacaccctcta

SEQ ID NO: 670425 - DNA, 221 bp, Homo sapiens
aggtgcagacaaacatgcaccgggtaatttttgtatatatagtagagacggggttacaacatgtaggtcaggctggtctcgaactcctgacctcatgatccgctcgcctcgagcctcccaaagtgctgagattacaggcatgagccactgcgcctggccagagatctttgtatattggattgttttaaggcaaaccatgatgagaaaccgtcgaattcgag

SEQ ID NO: 670426 - DNA, 135 bp, Homo sapiens
  misc_feature (68)..(68): n is a, c, g, or t
cagcactccccaaaggtgcctgccaaaccccaggcctggcccgcccagtcccgcagtacatcccctgntcctcaacccgcccttcccgccccgctcggtcgccgctccgcgcacgcctggcgccgccgccgccgc

SEQ ID NO: 670427 - DNA, 710 bp, Homo sapiens
tgtggaggctcatgtctgtaatcctagcactttgggaggccgaattgggcagatcacctgaggtcaggagttcgagaacagcccggccaacatggtgaagccccatctctactaaaaatacaaaaattagccgagtatggtggcaagcacctgcaatcccagccactcgagaggctaaggcacaagaatcgcttggacccgggaggcagaggttgcagtgagattagatagcaccactgcactccagcctggaaacagaatgagactccatctatgctagaacaaaggcataagccaggtatggaggaaggagaggaggtttcaaatcaaaatacttgagagtaaatgaactgctcttggtactttactatgtcaattacaaagcttttcacacaagccacacgacatatttaagaatgcatgtgttgggccaggtgcgagggctcacgcctgtaatcccagcactttgggaggccgaggccgctggaaggcaggagatcgagaccatcctgactaacacggcgaacccccgtctgtactaaacctacacacacattagccggccgctgtgccaggcgcctgtagtccaagtactcccagtttttcccttgagctccaattacccggacgcctgcggcaggattgccgtcaccctggcacgcatgactttctcgtgccctgatatacgccaactgcatttcccggttgcg

SEQ ID NO: 670428 - DNA, 478 bp, Homo sapiens
  misc_feature (17)..(17): n is a, c, g, or t
  misc_feature (51)..(51): n is a, c, g, or t
  misc_feature (64)..(64): n is a, c, g, or t
  misc_feature (84)..(84): n is a, c, g, or t
  misc_feature (255)..(255): n is a, c, g, or t
caaccctcccacctttnaaggcacaatggccccaacctctgcttcccatcnattacattactgnacttctctcctcccattgancctccctacgtccctccttaagtatctttgcaattacactgggctcatttgggtaatcctaagataatcctaacatcctcaagatctgtagctcaacccacacactagcagagtcccttttggcatgtaaagtaacacattcataggttctggggatgagggtgtggatanctttgagggatcattattcagcctaccacagatatgttcttgcataccctatctctggaagaaaaaaactgctgagggtagttgcctctggagataggaagctgggggctgacggacaagggtaagacaaaaacgtatgctttactgaatgcccctttgtattttttgagtttgtgtctctgtattctgtcacaaagtgaaatatgctcattgtggatatttt

SEQ ID NO: 670429 - DNA, 1379 bp, Homo sapiens
ggagagaactagctcgagtttttcttaggttcttttctctatacacctattttttaaccagtaacaaggcctacataattcttttatctgtctgtggacccacccagcgggtgcggctcacacgtggcggcctaggtggctcatggaggaggagttcgggacgcctcgagtatacgaagatgcgcccaagaagagtgtgcaagcgatcctctcgtagtggggcccgaaaattacttatatagagcttgtcgtccgagaggtcctatctacggacagtcttgtgatgcgatccgaaagaccatttgagtaatagcgagaccgtgagtcgtgaatactttttaacccgacttcgctattaatcaacatccatctcgtgggaatcgtgttcaccacgagaaatacccacgattcgtgcggacatctcgtgaggatactgtggagcgtgttgagaaaatctcgtcgaaataatacaacgtggggtggacctcaaagaaacggtattcccaacgacatccaattccgctcaagtcgcgaagattttcacttcccgcgagcccccatctttgtgcgtatggaagcgtctaaacacgtgggttctgtaggggtttaatctccctcaaaagtagaactccaacgatgtgtaggaccgacataattctatgtacgggagcaccaaaacaaacccggcctatcatagtagtgacaggcgaagaattgtgcacaaaaggcggcgatattaatttcccccgcacggcgccgcccacactactaggtgtgtgtgtgcgcgtggctggtaaagaacggacacaccctccgaacaaaaaaagatatctggcgcagggaaatcctttttcaacagggggtatctcccccttacaaaagacaaacgatgtgtgactcttggagagaccacaaaatcgcacgaggggagcagattgataggggccctccacgtacctgaggaaaggcattgccaattccaaaaggaacgccccctccggagaggaaataaaaactactcgccacagccacagggggccccagatccaagagaaaacaatccctctggccccgcgggggaacacacccttgggggaacactccacagggtgggacacaaaacccaccacacgggaagagagaagaggtggaaacccgggacacaagcgcgggccccaaaggtgctcgcagaaaatactcgagagccacaaagacagtgcctgcccccaacgagtggcgagagcaaatccaccaacgggggggaaacactacacacaaagaaggactcaacctggaggacaacaccataacgacgaaacaacggtggacaaaaccaacaggcggcgcggctatcccccaggtgggaggcaacaatgctg

SEQ ID NO: 670430 - DNA, 269 bp, Homo sapiens
cgactctagcagcatccccaggcgttgtagtgggacagagtacacttctaacagagtgaccctgccatagcacaactataaccatggacagagtatggaaaacagctccctgaggccctggagcgtggcagatttgggagggaagttttgacttggacgaagcaaccagcacagtttcctgtttttgcatctttgccctgagggcagacacagtccccacatgatagtgtggggtgcctaacgcactgacaacgggggtaccgagctcg

SEQ ID NO: 670431 - DNA, 512 bp, Homo sapiens
  misc_feature (2)..(2): n is a, c, g, or t
  misc_feature (100)..(100): n is a, c, g, or t
  misc_feature (195)..(195): n is a, c, g, or t
  misc_feature (263)..(263): n is a, c, g, or t
  misc_feature (267)..(267): n is a, c, g, or t
  misc_feature (273)..(273): n is a, c, g, or t
  misc_feature (289)..(289): n is a, c, g, or t
  misc_feature (297)..(297): n is a, c, g, or t
  misc_feature (351)..(351): n is a, c, g, or t
  misc_feature (423)..(423): n is a, c, g, or t
  misc_feature (484)..(484): n is a, c, g, or t
  misc_feature (499)..(499): n is a, c, g, or t
tncttttttgttttgcttttttcccccccctttttgaaattatgtgctgctgtttaaaacaacaaacaaaaaaaacaacaaaaacacagcaactgcggantttgtccccggctggagcccagcgccccgcctggaatggatgagcctctccatgagagatccggtcattcctgggacaagcatggcctaccatcngttcctacctcaccgggcgccggacttcgccatgagcgcggtgctgggtcaccagccgccgttcttcncccngctgangctgcctcccagacgngcgtgcgngtctcgctgccgggcgccctgccaagccgatcatggatcaattggtgggggcgncgagaccggcatcccgttctcctccctgggccccaggcgcatctgaggcctctgaacaccatgcgcccgcgntgcgctacagcccctactccatcccggtgccggtcccggacggcagcagtctgctcgaccnacgccctgccctccnatgcggcggtcgc

SEQ ID NO: 670432 - DNA, 443 bp, Homo sapiens
aatggggggcattgaggatgatatcttttcacatgtgtttggtttctgattcaagtgacacgcacaacctgacaaacaacaaacaaaaaaagcaaccctcactttcagggcacctattgctctaaatgcataatataacctgctgccagaaccagatgtgtttcaacaagccaataaaaccaccttttctatagccattaaagcaaactttactgttctaacaaatttgtattttattttgcattgccacacatctgcttatctccaaactacatccctttggtagtaatgtttcaggacaagtcggtattacagcttgatgtttgtgtgttctaattctaagagttctctattccagatcatatcgagtagttaagacaactgtaacagcattttttgcaatacattgtaaaataataaaaggtaacataattaaaatcgaa

SEQ ID NO: 670433 - DNA, 158 bp, Homo sapiens
tatcacagatgaataagacgaactggaaacttaagtacaatcaacgtaggcctcacctcaatcgcaaacttaccaaagttaaacaaacttaagaagcttgaactaagcgataacagagtctcagtgtggcctgtgaagtaatggcagcgaaagtgtcc

SEQ ID NO: 670434 - DNA, 468 bp, Homo sapiens
  misc_feature (406)..(406): n is a, c, g, or t
ggccctgctttttgtggcaaggctgttctgattaataaaggatcgtgaaaaagtagggccttggtggtttcctccgtgggtcccagccctccctcacctccctgggggcagaggcagtggggtgaaggggatgggggccccggggctgagcctcccctcagtgtgtcacctttgggatttgacttcactggtgaccaggcccttcccgagtgtccagccatcctcagatctctatagaatatgatcccactggcttcccagaaagcagagaggcagctacatctcccagatcaggcctgacacaaggctttttggggagtagagtcctctctaggctttcaggggtgccctccagggttcacccaggccttgacgttccccttccctcagtttcccagagggacantttgccaccttccaagggcagttcagaacaaaccaaaggggggacgttccagtttttcccac

SEQ ID NO: 670435 - DNA, 913 bp, Homo sapiens
atccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaggttaaacggggcaggtggtggtgctttttctttttcttccccccttcaacttatttttaaggaactccttagttttcacccttttctccatcccattcatcccaccttattctggtggtgtgcttcccaagaaccttccttcccaagaatagacattctccttacccagggcccttggtgttgaccccaggactcaagtctcagacgtggtgaacagatgtggccatgcccagaagacgccagcctggccaaaagggcatgcctcagtttactatttcatctctccgggatccctccctgaattgccccgggtgtcatcttctcccactcggggtaccagggattctaccaaattaggctttccaaaagccccatttctaagtccccttctctcagggaagcccttaaagaacaggtcccaaaagctttcacaggtggtttaaactctaatacagtgaggtaaggaaactggatagggccagctagtgggggtaagcacttgtttttgcgaccgagccaagaaggtgctatgtgccaccaagaggtgcttcagggccaacaaggcatacagaagagaaggaggcccaaatacctacaaaaagcgactggggcccatgtggacaacctttaacactaaactaaggacgtatatcggacat

SEQ ID NO: 670436 - DNA, 955 bp, Homo sapiens
  misc_feature (284)..(284): n is a, c, g, or t
  misc_feature (949)..(949): n is a, c, g, or t
gtccctggtgtgattccgtcctgcgcggtagttctctggagcgatcgttcttttatctccgtccgccttctctcctacctaaggtgctgtgccgccacccgatggaagattcgatgagactatggacagtgatgcgctcgcacttgaggctcccatgagacatatgctttgtgcggttgtgaagctaataggggcgaacaaagagttcatcacttatagaggtgggataactgatgtaaaagtgatgacatcaggttatactttagagaacggtgcagtttagngggactggtgcaacaggatgagttgcacgatgttgagggcagaaggcaagtgaattacgaaggggagtccaagttagacgtaaatgtggcaactttagtagattgagtgtctgtacagccaaaggtttccgcttgagggctttgaaataactccaccaggggtccttaacggtctgacgtgtggtttcacgggcctcgtgccatattaagtggacagcacgttagtacgctgttgggaggaagatgcttcgagtcagagagaatgactgacgggctcgacggatgtgaacctctctatgtatatctggtaagcggtctgcccctgtgaggtggtcagtaaggttcctcagaagccgagtagaatttgttgctgatgatgatgattggcgctggtgctggagaggggatgatgagaatgtggcggatagatgatgtggatgcgagaagaactgagtgacagggctgtgagaaattttagggatgttcgggcaatgggggggtcatttcgatggtagaatcgaacatggttgcctgtaaagggcaacgtttgaacgggaggtctgtaaccagggtttgtggaagttgtcaggcctacaggtgatgtgttgttaacaagggagagggagttggtgagagaataatgaggagagaagggggggatgagntaggaa

SEQ ID NO: 670437 - DNA, 295 bp, Homo sapiens
catgatttcgtacctcagtggaaaggagtcaagagaaatagattgctgaggaaatgagtggaggagagtggagaggaatgttgtggagttgacaggaaaggaatgtaatggaattgaatggaaaggcatggaatagacaggaaaggaatgaagcggaatggagtggaatggaatgcactggaaaggaataaaatggactggagaggaatggaatggagtggaatggaatggagtggactggagaggagtagagaggagtggagtcgaatggagtgtactgaaatggaagggagtg

SEQ ID NO: 670438 - DNA, 1153 bp, Homo sapiens
ccggcgcggaccccggaggcggcgccggcctccgccgcctcgtgccccgggccccgcgcccccggtctcggctcccgccgcgctgcccttccagcaccgccgcggagaacaaggaccagaccccgcggggacagcaggggggacctggggcatggagcagcatgctggcgggcatcgggacccattggcagagagcgaggaccggggagccagcatgagcggcgatgagaggctggctaccgagtgtcaggcgaggtggcagcggctgcccccggcagggggccatatctaacggggtttaacggtaactgccgagccgcaggcaaacggagacacgtgacagcccgatggatgtccagcaaggcacttagagtgagcaccatctacatagatgcagacttgcgacagattacagcgcacttacgaatcccacgattgcagatgaactgggtataatagctgacacctgtgctaggcctaagaacgccctcagaacccaagcgataatgcagggctcatcctcctaaagctgccccagaacattcatacctcagataatagccaatgaatgccgctaaagcgagctgctacattgacagggcacaggcatccggccaggttcccgagagcacgaagcacgggacgagaaggtaccactctaaccataggagcgactttggaccgtgaccctccctcgagtataggcatcaaagtgaacaaaccccggacacaatcgattcgacattggggccagcgagacccttcaactcgtacaataatttaggacccaatgggtcccaacagcgaggccgtgtgtggcggacataccacggtaattggtacacggcgaaacaacacgaacggctcggacgcaaggagagagggcagacacgccgaggcctggcgagacgccttgttggttactcctgactaggtctatagccgagcggaagatctgttgccgctgtaactgtgcgagagtggggagccggtggcgatcgtcatgaagccccgcagaggcgcgagtcgtaggaaaagagaggggcgcggccgagcgtagggagatctggagtgagaaggacggcagcttggcgtcgcggttgcaggtaggacggagcgggtgcgggagcatacaatgatgggtcaggtgggt

SEQ ID NO: 670439 - DNA, 114 bp, Homo sapiens
tctagaggatcttaaaagatgcgggtttatatacggattttactatgggggatttataatgacggatctttataatggccggtattttataatgatcggatcttactactgagc

SEQ ID NO: 670440 - DNA, 204 bp, Homo sapiens
  misc_feature (156)..(156): n is a, c, g, or t
ggggcgggggcgggaacggaatcttgctccgttgcccaggcgggatggagtacaatggtgcaatctcgactcgcggcaaactccacctcccaggttcaagcgattctctcagtagctgagattacaggcggtgcgccaccacgcccagctaatttncgtattttcagaaaagaggaggttcaccacgttggtcagcctggtctt

SEQ ID NO: 670441 - DNA, 504 bp, Homo sapiens
aaataatgaactaatatagataaatcattactaactcaatgccatactttattcagataacattagtcctaatgttcctttactgctccaggattccatccaggacatcatactacatttagtcatctctctcaggcttcttttagttgtgacagttactcaaacaccgtatttctctcactctggactcatgagtatttattttatactttgatttacattcagatacttcattgttattcccacactgaaaggctttggaatgctttgggcatcggaagcttttcacttggttcctgtatccctttgctatgctcacatcgtgtgtgtgtgtataatagcactttttttttcttttggagacagggtctagcactgtcgcccaggcatgcgtgcactggtgcaatccttggttccatgcaccctctgcctcttgggatcaagtgattctcccacctcagcctcccgagtagctggggctacaggaatgcgccaacatgccca

SEQ ID NO: 670442 - DNA, 831 bp, Homo sapiens
tcgcaccactgcactccagcctgggcaacagagtgagattctgtctcaaaaaaaaaaaaggtccctgtggaataactccgtgaagggggaacccggggggaaatctaagttctggcatataaacattatgtgggaccactacttttatgattggatccagtacggtggacagtagggtctaaacatatgctttctggaaaataagaaaagggtccggtggggatccagaagatatacgttaatagtcaggtttaatataataggtggtccttcttccagtcaaagtgggtctaaaatattgggatacaggagcaggttgccctttcaaatttttattttagcaaatagggattaagagcggatcaggctgggggtcgtgaaagaagatcttttccaggaagacattacaatggaatttctacatgccaataatcctagaggctaatttatgaacattatatttacggattcatcagaagtcttcttctgcaagaagaggaatgggttggagaccagtctcaggattgatattgatgacttactctgtctaccacaggatgggttttagctttccgcacaggatcaatcgttacacttagcttaatacgatgttaacctttcctcatataatattctaaatatggtcctccaaggatatccacctcttctaggtcccctggtaccttactcatgcaggtgagtacaatgctccctatctatctaattaccacttcatggaagggaaggccctgggctgggggccaaaaatagccccgacgttggggggggcggggaccacgagagtgttcaggcacaccaaagaggttctga

SEQ ID NO: 670443 - DNA, 171 bp, Homo sapiens
ctagtctgactctagagttatccccttgtgacagaacctacggctggacagtcgatatggatgcggatcatgaaagcccatgcacttcgggacaactccatccatgggtctatactatggcgcacaaaagcaccttgagatcgacccttatcagcccatcgtgcagacgct

SEQ ID NO: 670444 - DNA, 367 bp, Homo sapiens
ttctcctgaacgctgcctgctgagagataatgttcatcttaccttatgaggagaaacctttaatgacctcctgatcatcagccaggacagagggatgaacaaggagcccccatggcccatttcatccttgttaagcagccatttattgggcccttccccaggagccaagcacctgttgtgtctggttcgtctcatttatctcaatgggaaatacggctgcggaaaacttaaatcccaagaggttacattacttgatcaaagtcatgtagaccagcatcagcacaaagatcaaaaccctcacctgagtcccaagcccctagtccagaatcctgtggcagcatctggccagatattaactgatttgcca

SEQ ID NO: 670445 - DNA, 667 bp, Homo sapiens
ggagagagacagtactactctcgtagtcctccgacccctaatcaatccccctcctactactaactacctgactcggtacccctcacaatcatggctagccaggcgccacttatgcagtgaaccactatcacgaaaaggatctctacgctctctatactaatcatacggctagcggacctctccgttaacttagtagacatggcaccaggtcacaggagagctaaagtcatagttcttagtatctgtcgttcgaaaccacaactttagtccccacctttggcctaatcagtcacccgactgagggtaaccagccagaacgcctgagagcgcaggtcgtgggataccttccctagttctagcacccgtagttagtgctcccatatcccccgtagcgtcagtcagctagcttagcgctctcacacatcatcagagccagccgcataagtgcgtctatctgtcgcgaccctttgcgtaaagtacatccagctcatcagcctcgccccgagagagaaactaattcgaaacctcccattgagccccaagcagagagcgttaacatagttgagcgataagcatttaaccagccaaactacggcttttcttactaagttacacacggattaccgttcttttagcgggggaactcccactttaagtgacgttcccg

SEQ ID NO: 670446 - DNA, 611 bp, Homo sapiens
agcgacgtgatatatcggctatgaccgcaatagcacaggcaacaaatgcagaaatagacaaatgggattacattaaactaaaaagcttatgctcatcaaaggaaataattaacagaggtaagagacaatctacagaatgggagaaattatttgcaaagtatatatatgataaggggtgaatctccaagatatataaggaactcaaacaactcaatatcaagaaaacaaataacctaattaaaaattgggcaaaggatctgaaaacacatttttcaaaagaagacatacaagtggccaacaggtatatgaaaatgtgttcaatgtcactaaccatgagggaaacgcaaattaaaaccacaatgagctatcacctcatgactgttagaatggctattaccataaagacaaaagttataacaaatgttggtgagaacatggaaaaaagggaatggttgataactactgataagaatgtaaattagaaaagttgttaggaaaaacagtttggaaattcctaaaaacattaaaaatagaactaatatatgattcagcaatcccactactgggtgtatatcaaaggaaatgacatcaggatgttgatgggtacgagc

SEQ ID NO: 670447 - DNA, 106 bp, Homo sapiens
gaactacatgcagggctctgatagaacccacaaaattcacttcccctccattcttgtggcttcatgctgacagcagcttggtttcatgatagccagatggctacag

SEQ ID NO: 670448 - DNA, 258 bp, Homo sapiens
actccggggttttttgggggttttttcccccaaccctttcaacttttttttggattttcggttttgcatgccccccccggcctttttcccctgccagttccctgggggcagtttcccgctttcctgaatgggtttccggccccctccccccccccccccctccctttccatccgtttgaaaccctttgggtccttttttggcagaaccgtccccggccttgttaagtttttttggtccataaaggcaggggctttcca

SEQ ID NO: 670449 - DNA, 121 bp, Homo sapiens
caactagaacaactggtcaccctagtgcttctatgcgccctatcagtccacagaactgagtacttctgcaatagtaactcttcttgtcttacttggataggcgctctaaaaccactaggtg

SEQ ID NO: 670450 - DNA, 187 bp, Homo sapiens
atgactcgggaatgatcgactgtctaggcgtgcggcgggccgtagtgaaaaacagatataaaaacacagtcactgcagatgtggccagtggaagagcttgcagagctgtgtcgttacagaacacactccttcaacctagcataggtgctcttccagtagctcttaacgcatgatttccacgttgtag

SEQ ID NO: 670451 - DNA, 383 bp, Homo sapiens
caaggggtgttttgcaagggcaggttcattttttttagccccctttgtgaacccccttgggcttttttttggggttttatgcaagttggctcctaatgactaatgggaccaataatgaaggccttgttgcggcattagggtaatgggggggggttttgcccttaaaaaggggatttatatgctttagtgggaaaggttcatgaaaatccccttcttttacaaggggaacgggttttagggtttccccaggggttttacatttgcagggttttggggggtggggtgccctttgaggggatttgaaattggttcaaattggggtcctaaattttatattccctatattccctaagggaacccttaataaattttttttggtcaga

SEQ ID NO: 670452 - DNA, 101 bp, Homo sapiens
gtcctgcgacactgtgtctcgtctccatttggataaaggaaccaatcaacaaacaatgccatcactggaatttcccaccgaccatcttgagcctagtctga

SEQ ID NO: 670453 - DNA, 175 bp, Homo sapiens
ccattacgcgtgttcctggaagcctcctatttcagtttctcaacatgaaagtcatcaagctttctcccatcttccaactggacaacctctctgcggagatatgcctccagattcacacataaaccacaatgcaaaccccggtacttcaaaacagaatccttccagtcctcttcag

SEQ ID NO: 670454 - DNA, 1722 bp, Homo sapiens
gtcgtttgtctgcacgtcttgagtgtaatctgtgatgactgtgtggacgtataatctatatgtttagatccgtcaacatggtctcggttagcactcatacaagggggtgtgtctgtctgacttatgtaagacatgctttttggtggcgccgccacgatgtatgcgctctgtgtcgtcataattagttgtggtgtgttgccttgtatcaagaggataatctatcaatgcttctcttgtgtgagttagtgcgggcactactactagatcattcggttgataggttgtgttcttactgacacagtgcgtgcgctgtgtgcttatgagaggggctacagcgaaatttggtggcctgcatttttgtctctgtacacttcactcgtgggccctcataatacggaggtggttttgaccgcagactcggtcggtctcttctctgtgaagaaaacctcgttggtgtgacgagcatgatcggtatcacctctgtagatggggagggagattatttttctcgtccagtatggggaacaacatttagcgatcataaccgctggttctagggctatcctgtgatgggatctggtgaaatagtcctcctttcagcgtggtgtggttgacattttgggctagcgggcctattttcgggttttgttgacaacaatactcggtatcggttgtgtttggtggggcacaataaaatagcggagttgtgccccacaattgggggggcgcaatatgtgtccttgtaatataaagttcggcggaatatctttcgcggtgcaatatcggatagtgggctaataggccccaatatatttttggggataggacgctcgcggtgtgaataataatgtcgtggcagtagcaaattcgtaggtcttctcttgcggaggagaattttgtgcctctcactgcttattgccacgatcgtgctttcgtgaaaaatgcttttggggtcacttcgcccaattgtataaggggggtaaagtctcatattatgtattttgtatgggccacacaaaaagactgtctgatgtggcccgctcttatatcggtccgttgtatgagggagagcccccctaaatacaacacttctctcgcgcttatatcaccgccactagtgttatactctcatgatgtgatagggctcttacttgatgccgggtgttttctctaatctctagactctagctctaggtgagacattttttttggcactagaatgcgcgcgagaaatagatattgtctttaacatatttaaggggagtcgaccctataggcgctctctagcaagaggagacagagagagtggactctctagatagaaagaggtcacccatgggaaatgtcttaccagggtttaccatactacgatgtttcgttgtaacattctatgtcgccacagctgctctctcgctgggtggccaagaggcgctatatgcctgctgtcacacaatgaatgacacatagtttttataggccaaaatacctctagatggtgtaaagggccaaacaaactcgaaggacccgctaatttgttgaactaagattgttatacaccacgcggttactttctagctctctcctggttctcgtggaaaagtgtaaagacacttcccgaccaaggggcttttaaatgtagatttttttttttgcaccccatgctgttgattgctaaatgtatacagttctgatcctgacagctgaataaatgtctttttttta

SEQ ID NO: 670455 - DNA, 235 bp, Homo sapiens
caaatagcttctttctagtttttttctgacaatattcagtttttgcacgtagccctcaatgggcccccaaatgtccctttgcagattctccaaaaagagcattttcaaccttctgaatcaaaagacaggtttaactctgtgagatgactccacatcacaaagcagtttcacccatagctactttctagtttctacctagggatattcagtttttcccaatgagcctcagtgggcc

SEQ ID NO: 670456 - DNA, 472 bp, Homo sapiens
ggttttattagctatacaggaacaggctagcatacgctctgcactatatgcctgacgcccgcccaggcatgatataacggagggcacatggcaagcgagtctcccaagcacaaggaaacaccgtatactacacaagagagcggacaacactatgctacttgagcatgagaaactagagcgggttcatgcagaaggggccgactcataatgctctcgctggctcacgccggctgggctcactgtgaacgacacttgtgcacactcccgagttggtcaaactggaatacttctaagctcccattgcactcttggactacatgcctggaaggagaggtgagatcatgttaaatcgtgacacaacagtgggaagaggacaagttgatgcacggccccgaaacgcagggcttgggctagttctaaaccatatgagaggctgtgctacctagctcgtaaaatacagcataaaagctgc

SEQ ID NO: 670457 - DNA, 369 bp, Homo sapiens
acgtacacccaccacacaattggacacacacagctaaacattcgtgaccccacccatacccactcaccatagtccactcctgtgctcacaggccttgtccagccgtatcttccagaggtgaccttgtcactccgactttcgtatagaagcaattctcctgcagggtggcggtggagacagggtctaagtcccactccttatctggggcctactgaccatgtttgtggacagcccatgagagactaccccccttggtataccctgggtatgggtactgggggtccctgaccctgggatagacgaactgggtcagtgtggcttgctcagacccacctgttcccggctccagggaactcacccttagcgtgc

SEQ ID NO: 670458 - DNA, 298 bp, Homo sapiens
  misc_feature (35)..(35): n is a, c, g, or t
  misc_feature (87)..(87): n is a, c, g, or t
  misc_feature (114)..(114): n is a, c, g, or t
  misc_feature (150)..(150): n is a, c, g, or t
  misc_feature (162)..(163): n is a, c, g, or t
  misc_feature (212)..(212): n is a, c, g, or t
accccccccccccaaaaaaaatgagggactttttnaaatttaaatgtttttccccccccatgacccccccgggtttttatatttccnacccagaaaaagtaaaaatcttttttntaaaagtgttgtttttctaaaatttaataacctccnaggggttatttnntgtgccaagcccacctttccccccttctccagattgcaggacagaatantatgtgttaatgaaaatgaatggctgtacatatttttttctttcttcagagtactctgtacaataaatgcagtttataaaagtgtt

SEQ ID NO: 670459 - DNA, 240 bp, Homo sapiens
ggggggggggggtccagtgcgggagcccagggcgttccccctaaccgtcaccgaccggctaacccccatctcataacccgaaacgagacagaactataacgtaaagaggagacccatagataattagagcttcaagagaacaactacactggagacttctgagtagttgagaactgtagtggagcctttgaacacgtccttacttgacttatttcagaattacctacagagtgcatatcc

SEQ ID NO: 670460 - DNA, 183 bp, Homo sapiens
tatgtggaggccggtggcagcttctggggcttatggtgcccaggagtgaagcccagtgcccttactctgcattttccttggaaaggtgtgggtagtgactctgtattcagaacaggtgcagcgtaagaggcagcgacttacggaaggaggaatggatggatactatgtaagcatcgtatcgaa

SEQ ID NO: 670461 - DNA, 276 bp, Homo sapiens
aggatccccgacgagttgtccgagttataatgttacttcatgaatcaatttgtttattgaaagccttgaaatcttgtggatggtttgctgaccataccaaaaagatccgttggttcgtcaatgtgaatgaaatttgtggatatagatattaagcctacacggatcctaggcctaaagggaacctcgatagaatatggggccggttactcaggctgtaactggaagatggcaaagatataagtgaactccttgcacccaattggaccagtctatgaa

SEQ ID NO: 670462 - DNA, 245 bp, Homo sapiens
ccagacgtgctgggcgcaagcgcgcgtggcgctgaagtctcgagctggaattcacggaggtgcgctcgccgataacgggcagggtttccgaccgccgtgtcgaccccggcaacctggtcatgagtggagaagcgggaaacggcacccgcctgaccaccatcaatgcgctggacccgatctatttcacattcgacgcatccgaagccttgtacctgaaagccatgcgtgccggggaaccgagcgcg

SEQ ID NO: 670463 - DNA, 110 bp, Homo sapiens
ttcacaagatgcacagccaagaattttatctttattattgtaacacgttggtgtgttcccccacttttaggtaagatataataacagatgtgttattaaagtccaaagaa

SEQ ID NO: 670464 - DNA, 263 bp, Homo sapiens
tttatttattttaaatacctgaaacctcgtactttatattttgaagtaaggtgggattgtgtgaaaatgtggatggtttttcttcagtgttggttagaactactttttttaagtggagggtaacttggtagtattattataattagtcttttatatttattatatacatatacccattttatattttgcctgttttatctttgtattatttaattgatctgttcttttacttcgttaattgagttcataggtttttaatggtt

SEQ ID NO: 670465 - DNA, 202 bp, Homo sapiens
tacgaaagcgttcaagctcagcacccactacctaaaaaatcccaaaatataactgaactcctcacacccaatgtgtaccaatctatcaccctatagaagaactaatgtaagtataatgtaaccatgaaaaccatttctcctaccgcaataagccctgcgtccagacttaaaaacacttgacactgacaatttaaccagccaa

SEQ ID NO: 670466 - DNA, 387 bp, Homo sapiens
agacactgcgcccggccacagcactcaagtattaaactttagaggaactcaggtcctgtgtaacattgcttgataatcattatctcataaaaatcataagcaccattttttttctggaccagtgggtccgttttttgaggaatatgggtacttttgaaaacctgatgaaagctgtggaccctcttcccatagaaaaagatatagcacatatacacagaatactacacagtttcagaggactggcagattctgttaagtccactcatggactccaagtagaactgctgcaattgatctggaacatattttaaccaaattcttcagggaggattctcatccagattcatgggccaaaactatttatacccaggattaggagtgggagtt

SEQ ID NO: 670467 - DNA, 454 bp, Homo sapiens
  misc_feature (16)..(16): n is a, c, g, or t
  misc_feature (23)..(24): n is a, c, g, or t
  misc_feature (32)..(34): n is a, c, g, or t
  misc_feature (41)..(41): n is a, c, g, or t
  misc_feature (47)..(47): n is a, c, g, or t
  misc_feature (51)..(52): n is a, c, g, or t
  misc_feature (79)..(79): n is a, c, g, or t
  misc_feature (227)..(227): n is a, c, g, or t
  misc_feature (245)..(245): n is a, c, g, or t
  misc_feature (289)..(289): n is a, c, g, or t
  misc_feature (306)..(306): n is a, c, g, or t
  misc_feature (341)..(341): n is a, c, g, or t
  misc_feature (343)..(343): n is a, c, g, or t
  misc_feature (350)..(350): n is a, c, g, or t
  misc_feature (359)..(359): n is a, c, g, or t
  misc_feature (372)..(372): n is a, c, g, or t
  misc_feature (380)..(380): n is a, c, g, or t
ccgggggaacctcccnccccttnntgtcgggnnntgtgtgnaagtgnaaannttggggataaaggaggaagctcctcgnggcccttccaaggtgaggcaaaggcatttggacttgttccagcccagccccccgggtgacatcaccgggcagggaggggtgctggtggtggttcatacggagtaaactgctctgcctgtgtgagtggctcctgggccctaaacaggcncctttaggccatgggtcnctccccgtgagccatcaatgtgctttggtttgacatggtttctntctgttttttagtctanacctagtttttttgttttgttccccccgtatggananagtaaanattgttgtntgtgaaatttttnttttgtanattttgagttttcccttgtagggtaaaaaatgatccctttttgtaacaataacaagacccctttttaagattta

SEQ ID NO: 670468 - DNA, 394 bp, Homo sapiens
caccagatattaagccctataagattaaaagccctattgttaatttagagatttatttgaaaaatggacctcctgtgcctttgaaaattatgtggccattcccttggcctgggttgccagtggcctcattccctgtaatccccagcactttgggaggcccgagacgggcggatcaccctgaggtcgggagttcgagacccagcctgacccaacatggagaaaccctgactctactaaaaatacaaaattagccgggagtggtggtgcatgcctataatcccagcgactcaggaggctgaggtaggagaatcacttgaacccgggaggtggagattgcagtgagctgagattgctccattgcactccagcctgagcaacaagaccggaactccgt

SEQ ID NO: 670469 - DNA, 220 bp, Homo sapiens
ggtgttagagttgtatatctctatggaagtgatgatgttatctagtgtaaacagattgagtggcatggagtaagtcacagtgtaacaagctacagaagcaccatacccatctatcaataaacaaggaggtgtcggccaggcgcagtggcgcactgcctggaatcccagcacttatgagcaggctgatgcggagcggaccacgaggtcaggagatgagacc

SEQ ID NO: 670470 - DNA, 192 bp, Homo sapiens
gacgacctcgtcctgcacgccggccgtcagggcccaacggatcaggcgatgggcggcgttggtgttgggcgtgagagcgatggcctcgaagttgaacgcgatgccttcctcggcgccgccttccaccagagcggtgtggacagccttcagcttgtccgggtccttgaacttctgggccatgtaggccttccg

SEQ ID NO: 670471 - DNA, 111 bp, Homo sapiens
gcgctacctaagcagtagccatcttgggtccttcaaaatccaaatgatcttgccccagcactagctgtggaaccacctggcttatgacccctatggatgaggctgtaggga

SEQ ID NO: 670472 - DNA, 373 bp, Homo sapiens
ccggattgcttttttaaacccaattggagaagtttttggcctggaaaaaggccccgccttaggtgcaggagcctcagcccgcagcccctgggaccccaggtgggttttcccaagtcatgggcagggccctgggcttaagggcccccaccccccccccccgggatggtggtgggggctgggcccgtccttctttaaaaaaagcccttttctcaggggatttcctgctactttatgtggaaaaacacgcccctgtcccccttcgggcccctttggggggctggaaatttttccgtggggggcaggcccccgggtgggcctgccctgtcccccgcccgggggggccaaagtggaccattaatccttttcaaaatga

SEQ ID NO: 670473 - DNA, 577 bp, Homo sapiens
tgggggggggagatttgggtctccggatttttggggggcctggggcccccctcgctttttggggccttgggcaattccccctcttttttaaccccccaaggagttggtcggggggggtcccttttttttccgcccccgtggcccctttgggaaccccctctgggcctccgggtgtgggaggggtttttggggggttttcccgcctttttttccccccggggctttcccccctttgtttggggggggcacccctcccctttttttccaaagggttaaaaagggggggggggtgggccccctgggttcagggggttttcctccccccccggattaaaggggggggggggggtttcccccccggtttttcaaaggggggggtggggccccggcgcccccccttttccccgggattccccgggggggtggggggggggtcccccctttttcccggcttgggggaaaattttcccccccccccccgggttttttttaagggggttttttttgggggggggcccttttccttttttttaaacaaacccccccccctaaggggttttggtttttcccggcccca

SEQ ID NO: 670474 - DNA, 830 bp, Homo sapiens
gggaacttaaaacatcgatcttttatccaaaaatttcaaagggcaatataggaaagtattacaaatttacataaaaagaagatgaaacagtgagaaaaaacacaagtttattctcccgtgcaaagcagatcaaataggtgagacaaggaacttgtgacttctagctccctttaagcaggacgtaacgtgctagcacacagctcgtgaagtgctctagatatatttactactaaacttacagaggattcaaaaaagaggaattgaagggctaaatcacaaaataactctttgtgtgtaacacaatctcttagaattatacccaagtgcagaaagtgttataagtgaagccagtgtgagtctcacaggcctcatataagctcaacaaaacgcattatttattaaccctcaaagctcagaattatgtggtaattctcgtgtgtggccagaaatattattctcggtgggaatctattaagagcgtgccatagtgccaaagctcagggagtagacacatctcagataacacgctttagacccaaccagtgatatcaggtggtgcgattgctcttctggggcttggtgtggccctgtggatttacattcgtggtgtgcaagttacagaaaaacctttcctcgtgacttcgtgctgcgtgggccccggccgactgtacaaaggggcatctatggagggatatccttaagctaacaggttgggggataggtttgaatgaaagggatgcatgctaggacagaactatcgggacgtccgtaacgaatgctacgggccgtaaacaccctggcaatgtggccaggaaatataatctgtaaaa

SEQ ID NO: 670475 - DNA, 438 bp, Homo sapiens
  misc_feature (16)..(16): n is a, c, g, or t
  misc_feature (46)..(46): n is a, c, g, or t
  misc_feature (90)..(90): n is a, c, g, or t
  misc_feature (186)..(186): n is a, c, g, or t
  misc_feature (378)..(378): n is a, c, g, or t
agtgcctccccttccnggaaactcctttataaagacgggtctgaanggttaacaattcccctcagcatttgccttgtcctgagaaatganccctgtttccttccttccccttataaagattagttttgcccagatatgaaattctgggttggaatttctttcctttaagaatgttgagctcggtancaggtgtcacgcctgtaatcccagcactttgggaagccaaggggggcagatcacctgaggtcagtagttcaagaccagcctgaccaacatggagaaaccctgtctctactaaaaatacaaaattagccgagtgtggtagcacatgcctgtattccaagctactcgggaggctgaagcaggagaatcacttgnacccaggaggcggagcttgtggtgagctgagattgcatgtgattgcactccagcctgggc

SEQ ID NO: 670476 - DNA, 1047 bp, Homo sapiens
ggtgagattgcaacagattctgatacgccctgccctgtggacctgcagcggcccgggccccgccgcgccaggatgacaagccccgaaccgcttgggtcccccgcctgtatgggcctctgtcggcgggtgtccttcgtggaccctgtgacgtgtggaagccagggactccacagccctgagccacccacaagcggaggggagaagccgggcccaccatggggctgagatgcaacatgttcccccgactccctccaggcggggagctccagagacgggcttggcccacaggcaatcctttccgactcggacagtgcccccgcaaagggaaaacagacagcatgcgagcaccccggctcgcccatgcttgccggggacgtgatcagtctaagaggagtcaagaggctgttgacagaagaagcgaggcaatgagaatggattgtagagggagtggaaccgttgggaaaagaaagagattgggcgaatagtcggatcagatcagagacaagatgctcagaatagtagaaaagcacgaagctggaggaataagaggacagcaggacgtcgataggcatgactatacaagaggccttatataatcaacctaaagcagaatagtacctcaccaatgagaaaggggtacgtagaacaagggcgaaacagcaacatgccgcgcgaccaaagacaggcgtagagagagcacggactggacacgagagaatacagcaaacacagtagcactatatcaacacagacacgacagagcacagacagcaggcacgacgcagcagccggcagctacgacacgacgcggaaagacacagaggagaacggacgaaccagcagcagagcagtcaagcgaggagagactaggacaagtggtacacaccgactaggtagccatcagagaagacagcccagagccgcacaagaacacccacagcaccgcgtcacggaacaccgaggcgcaacagcccccaagaactacagacctctaacgaccaaccaccccgagaaggccagaccagcgcgctcaccggctagttcttt

SEQ ID NO: 670477 - DNA, 158 bp, Homo sapiens
tgtcctgccccagcttggctgactacactgactgtggtgtggtctctctctcctgagatgctagtgttgttgctcctgagtggtgccacggggctgccttgctgtcccccgcccccagctgggcgactacgccggacgtgtgcgttggccccacgggt

SEQ ID NO: 670478 - DNA, 125 bp, Homo sapiens
tacaagaaaatgcattagaccaggtagcttataaataacagaactttgttcctacacagtcctggcggctgagaagtgcaacgatcataggtgccggcagatcttggagtctaggggaaggcctg

SEQ ID NO: 670479 - DNA, 356 bp, Homo sapiens
aggtactctagaggatcgtaacgcatctcaccgcatacatagaatatattatttaacagagtgtgtcttaagagtatacttggaacctcggagtcaccatggacagaacaggtggccatggacttacagccaaagggtcccactgtggggctgctttggggagagactcacagctggacttctctatacgaacatgcaatgttagccaggaccaatttacccacaatggtttgcccgtaagagatagaaataatgtgtctcacaggaagaaacagtattgataaacatacacaggctaacagaggcccggccccgtaattaccattgagacagaagcctaccgattgcggtgttat

SEQ ID NO: 670480 - DNA, 429 bp, Homo sapiens
tttaatttttaaaataccggtggttccaagctttcaaataggttatgccccaaaaattttatttgtaagttaatttttttacaagtcaaaccattttggaagtggtatttaggttttaaatcggtccccgaaaattagcccctatgtatatcttgaatagtataggggggggttttcctaaagtccctatgtggttttaactaagtgaaatttttgacaagggaaataattgtaaaatcgtcttaaaggaaaatttaatttttacccctgtttttgggacattcgttttattaactgtcagacacaatttctgttttcatttgggagcccgttttcctttatttctacatttaaaataagaacctattttacccttttatttaatacagaattttcttaaactttaataaattcgcattttaaaggtga

SEQ ID NO: 670481 - DNA, 456 bp, Homo sapiens
tggcgctggatgcacagatgatcagcctgggcgtgtcggccgatgattttgaagagttggtgtggcgcggtgcacgcctgctgcgccaggccgactgtgtgagcaatggctttgccgccgtattgcagcaggtcgacgcgctgcccctgggcgatggcctgtggtggttgcacagcgagcagacggtcaagcgtccgggcctggcctttgtgacgccggacaaacccatgcgttacctcggccagcctttgcacggcctgttctgcctggcgagcctcggtgaagcgcaccagaccctgcttgaacgcctgtgtgccttgctgatcgaagggcgcggccaggagttggggcgcgccaccagcagccgcgcggtgctggaagtgctgggtggtgaactgccgccggactggccgagcgctcgcattgccctggccaacgcccacgggctgcatgctc

SEQ ID NO: 670482 - DNA, 134 bp, Homo sapiens
agagtccagcctgcagacgtctcacactcctcacactgtatacaggaaagaggctgatttgcaaacgcacgacacacaagtgtagtggaatgggtggttcataggcccaccaaggtgctgagtgggcataattt

SEQ ID NO: 670483 - DNA, 125 bp, Homo sapiens
tgttagtagtatagtgaccagcagctaggactgggagagataggagaagtaggactgccttgtctaagggtttttcgtggggtgtttatctaccagtgctgggtcccgttctgtataccactcag

SEQ ID NO: 670484 - DNA, 335 bp, Homo sapiens
  misc_feature (133)..(133): n is a, c, g, or t
  misc_feature (138)..(138): n is a, c, g, or t
  misc_feature (142)..(142): n is a, c, g, or t
  misc_feature (163)..(163): n is a, c, g, or t
  misc_feature (165)..(165): n is a, c, g, or t
  misc_feature (179)..(179): n is a, c, g, or t
  misc_feature (198)..(198): n is a, c, g, or t
tgtgctggcatgtggaacaaacacccttccctccaggcatctcttgaggtagtctataaagtgaattgccctcgttgaaccagaagctggattgtctcccttgtggttgtcctccacagggatgctcttgtantggtngtgnccctcaaaatggttgggacantnggctgagacgttgntcaaggcagttatgcccanggcatccagcatgtccttgcgggaagcgtgatacgcactgcgcaggtacagaaagggcaggatttccaccgggccacccttgatcgtagagtggggtcctgcaaggaactgcacccagactccgcgctgatcaggga

SEQ ID NO: 670485 - DNA, 116 bp, Homo sapiens
  misc_feature (77)..(77): n is a, c, g, or t
ctgtcgtgggtggccccaagatctcttgtaatttatatgtaaaagtttgaagctgaaagccccgtaatatttaattntattttgttaaacatgaaagtgcatcctttccctccaga

SEQ ID NO: 670486 - DNA, 319 bp, Homo sapiens
ggaagcttccctttttgtgtcaaaaatgaatcctgatttttatgggaatctctgttattaagatatttcaagatgaggccaccctgaagatcaaattgtgtttaggatccctatcttctctcctcggttctctcttactcctcatcctcccagaattttcccgtttatggtaaaaagatggggcccctatttgaatgggttttttttttccctgatgtcccattttgttgtgggaaaggatttggataaaatttttgtttaaattttggtagatttttatctatcccaatttaaataaaattatgttttgtaagctgta

SEQ ID NO: 670487 - DNA, 896 bp, Homo sapiens
  misc_feature (214)..(214): n is a, c, g, or t
gttttttctctgaagagacaaaagtaaaaatcgaagaaaagaagagaggcgaacagaaggaaaggtgttgtgtgaccacgtttatgagattgtatcatttatggtgactacctgcttgttagcaactatgcatttttgggttatatgcgaccccgttgttaataggccgacgcttttagttaggtgcgggaccgatattttgcgtgctgtccgncctatcccgatgtgtacagtcattaggaatccaaggttccaaacagtaaggataaagctaggaaactggaaccgcggctaattttggcattaggaatctttggccaagttttccaaggaaaaaaaaatagtactgagggttatgttacacaaagaatactgtcttttagagaaacattctgcaatatctataataatatgatatgttttggatttccttttaaataatctggcatgaggataaacaatatacccagcttaccagcattgataatccttaactagcgtgataatacatgcagttcattgaactctttatgataaactgttaacacaagctcatgtcctcttaaaagacccccgcaattgtaaaacttatcactgcgatattaaacattgcttgccaagcccgtggctcacccctgtaatcccagcactttgggaggccaagcgtggcggatcactgacggtcaggagatcaagacccatcctggccaacactgtgaaacctcatcgtctactttagaatatctacaaattagccgggccatggtggcacagcaccagtcagttccagctatttgggaggctgagtcacggagaattacttgcaaccctgggaggacaaaggttcatgagccaaggtcgcacccctgtactccggcctgggtgacagacaagac

SEQ ID NO: 670488 - DNA, 941 bp, Homo sapiens
  misc_feature (47)..(47): n is a, c, g, or t
  misc_feature (71)..(71): n is a, c, g, or t
  misc_feature (73)..(73): n is a, c, g, or t
  misc_feature (232)..(232): n is a, c, g, or t
  misc_feature (238)..(238): n is a, c, g, or t
  misc_feature (242)..(242): n is a, c, g, or t
  misc_feature (246)..(246): n is a, c, g, or t
  misc_feature (313)..(313): n is a, c, g, or t
  misc_feature (317)..(317): n is a, c, g, or t
  misc_feature (321)..(321): n is a, c, g, or t
  misc_feature (334)..(334): n is a, c, g, or t
  misc_feature (349)..(349): n is a, c, g, or t
  misc_feature (381)..(381): n is a, c, g, or t
  misc_feature (418)..(418): n is a, c, g, or t
  misc_feature (430)..(431): n is a, c, g, or t
  misc_feature (461)..(461): n is a, c, g, or t
  misc_feature (473)..(473): n is a, c, g, or t
  misc_feature (507)..(507): n is a, c, g, or t
  misc_feature (533)..(533): n is a, c, g, or t
  misc_feature (560)..(560): n is a, c, g, or t
  misc_feature (562)..(562): n is a, c, g, or t
  misc_feature (566)..(566): n is a, c, g, or t
  misc_feature (572)..(572): n is a, c, g, or t
  misc_feature (574)..(574): n is a, c, g, or t
  misc_feature (586)..(586): n is a, c, g, or t
  misc_feature (674)..(674): n is a, c, g, or t
  misc_feature (834)..(834): n is a, c, g, or t
  misc_feature (841)..(841): n is a, c, g, or t
  misc_feature (844)..(844): n is a, c, g, or t
  misc_feature (847)..(848): n is a, c, g, or t
  misc_feature (855)..(855): n is a, c, g, or t
  misc_feature (858)..(858): n is a, c, g, or t
  misc_feature (864)..(864): n is a, c, g, or t
  misc_feature (866)..(866): n is a, c, g, or t
  misc_feature (873)..(873): n is a, c, g, or t
  misc_feature (893)..(893): n is a, c, g, or t
tagctgtaatttaatctgacagtaaaacacaagaagcaatattagantaggtttagtatattatatatttnanctttgaaagccatagaaatcagttatcccagtttttttcctataaaagacccatttttccaaagcattatgcacaattttaattagaatataatgacagatgatattccataattttttaaatataaaatgaagtcaatgactcaaaaaagttatctgntgcggngggnttgnggggacatttcataatcagtatcattacagatataaagtataatggttcaactttttagtgcttganaggnaggntcatgataaaaanatcaatatgaaatcntttgactatagtagcaatatctaacatttganatgcatccatgctcttttgtataatcatattagagtnaagtatattttnncatctgttataactgctattgcgaaggggnaatactattgtnttattttccaagaggtatacacagggcaattttnttctccaggggacttgtgccaaccantataagatctagattcttcacataatntntcanaccggngnagcctcttcagnttttttatttttgaagtctgggatgctggcactttccaattaggcaacagttcttcattcctgtaatctggctcagagctgctgctgnctatgggcctagagcagcagacatgatttctttttaggcttcttcttttccactggtgttttcctatttatctgtctgaccaggtcataaaatatctcacagcagcagatggttcagtgatgagggcaagttcgaactataatatttggttagaaatgcngaaaggnccnagnntaggttnttnctcatntntctgaantatagaaatatataattaanattgatatttgaatttgaagaagattataaaaaggaaaagttaaaaaa

SEQ ID NO: 670489 - DNA, 930 bp, Homo sapiens
gtgatatctgggatctgtctgcgagacgtatagcagttgccgcactcccactcctccgtcatccgcaacctgacagggcactccctgtcacacaccctatttagggcgctcgccgagctgtgtcccaaaggcgtgggcctcgaggatggcctttcgcacgaatcgccttccatgtgttcgtcgataggggttctccgcaggccagtgtcttcattgagcagggggtgcgccgcgtcttgacccccgttttgcccgagacgcctgcattccctcaaaaggatgatgcatcatggccgaccgttgcccttagcggttccgtgcttcgcatgtgaaggaccgcgtgggataatacagtgtggtagcgcttgcttggaacgcgtttagggaacccctcccattaggaaacgaggcgggaaccgttcccccactctggcgggctcggtatcacacgcgtgggcgcttaggtgcgaagcatgtggacatttccgggcctatgtggttctttccccccggagttcgtcgcccactgcttagtttgcgcaggaagcccccggccggggttggtggcctttaaggcgctggttctttcaggcccgttctcaatttccgtcgtgcttgtatgaccccggtgcttgagggagataacacgggtgacttccgcttgcattgctctggccacctgcccgtggacgcgtttggcgcatactgttcctcaggggcgtccatcccagggtggtggtggcttggctattttcgtcggtggaggcctcctgggactcctttgttcttagccgtgtatgaattgtcgagttcctaaaaggcttgtttggtccaccaacggcataattgtgacgcgtttgatttcccctctgttgaggcccaccggtgttacagactacccgtataacccctgcgtaggatcgtacttga

SEQ ID NO: 670490 - DNA, 639 bp, Homo sapiens
  misc_feature (605)..(605): n is a, c, g, or t
gctcgacaccggtcgggatccgggggggaatatgagcggagtgaggagggagatgagccacagtaccgggatcttccaagcacagccacttcggtgaacatcccgtgaccggcttccgggctgaaaatacatggtaaatgtctatcagatatctgaggatggggagcagagttggatccggtctacttcacaaacaacagcgccggatgcccctccggacccgacggtggaccaagtggatgacacctcaatggtggttcgcgggagcagaccccaggctcccatcacagggtacagaatagtctattcgccatcagtagaaggtagcagcacagaactcaaccttcctgaaacggcaaactccgtcaccctcagggactggcaaccgggggttcagtataacatcactatctatgcggtggaagaaaatcaagaaagtacaccggtggtcattcaacaagaaagcacgggcaccccaggctcagatacaggtgcctctcccagggacctgcagtttgtggaagtgaccgacgtgaacggtcccatcatggtggacccggctgagaatggagtgaccgctaccgtgtggatgtgatccccgtaanctggctggcgagcacgggcagaggctgccatcag

SEQ ID NO: 670491 - DNA, 283 bp, Homo sapiens
ccgaaggagacgacatcatcattgtggcctgtgaagggagccgcatatcgtgccacgtcacactctgatgcttactggtggaggactctactgtaaggtcagagcagcgagagtacctccacctccctctaacctcatcgctctccacagctgcctgcttccctcttcagttacctgcttgtgaacagaagtaatctacagttagggctcctagtcaacacaacacatgctgtcgccgttcaggagtccaatccctgcgtgattttggggtgaagatactccg

SEQ ID NO: 670492 - DNA, 207 bp, Homo sapiens
  misc_feature (103)..(103): n is a, c, g, or t
gaacacaaatgccaaggtcacaagttaactgacccagaatcatcagagagttatggcagagagagagagagagagagagagagagcgacgagagagacttgtncgagtgtctagaggggggtgcccagttgatctctggaatcatggaattccatgattttgagaacgctcttagacgctgaacttaaactcgcgcaggggtctcta

SEQ ID NO: 670493 - DNA, 977 bp, Homo sapiens
  misc_feature (673)..(673): n is a, c, g, or t
  misc_feature (702)..(702): n is a, c, g, or t
  misc_feature (716)..(716): n is a, c, g, or t
  misc_feature (731)..(731): n is a, c, g, or t
  misc_feature (750)..(750): n is a, c, g, or t
  misc_feature (766)..(766): n is a, c, g, or t
  misc_feature (772)..(773): n is a, c, g, or t
catgacgttaagcatctgtgtatgaggcccctttgcaccacgtcatgcactaaaagactttgaggggttcggtataatttagtgttgtcttgtgaaccaagggctaagctgttggcagcaaggcctgtcttctgtgcaagtggttttggctttcacattcccaacaggacacagaaccccaagaggcaactggaggagcagtggagggtggtagctaagatcatggactctgggccagactgcctgggttcacatcactgcaccactcaccaactctgtgactttcggcaggtttcttaatctttctgtgcccagttcctcatctgtcaaatgggggttatatagtatctaccttctaagattgtgctgaggatcaaatgtgtggtatatggaaaacatttgcagccatgcttagacctagtaagcattttacattttagctatcatataccctgactgcattaacccatgtgtcttaaaatttttcttccgggaaccaggatgttctaggtaggcacacgtgatttttctaaagacgtgtttaaattgtcaagtgttcacactgagaaaagctctgtaaagcaaaaaaaaaggttttaattaaatttccaaataatagcaagttaactgaattgtaaacctaccttggaacctcagatcttcaacataaggntgataatcagatcttccttcccaggattntggttataacaatngaactaatattactnctttgatctgaactttaanagagtgaaaccaatantgtgtnnaggcacttgattttaaaaatgaatcataataatataggattcttttatttcataagtgtaaaaattatcaacccacttcaggatatagctgtatttagtgtaacacaagttgtaaggtatgaggctgagaattatttcttttttttttagacatcgataagcaatatcatctcaattgaaactcctaatacagccctatcaagt

SEQ ID NO: 670494 - DNA, 144 bp, Homo sapiens
tgccggtggccatcaggacaaaaattcacaacaggaagtgtgactggatacggctgttgaacgtgttgcctccgtgcagatcttgtcatgggcggctttacgtgggatgtgctttaatcaccagctaacctaggtagcttcatc

SEQ ID NO: 670495 - DNA, 126 bp, Homo sapiens
ggctggaccctacagattatgtgaaattttgataagaagtctacgcaatgacagtatggtacataaattttatgcagaaaagtattccaggtagataaaagagtagtgttattactctcaggttta

SEQ ID NO: 670496 - DNA, 104 bp, Homo sapiens
ttcagaaaaaaatcataaacacaagaaacaatttcaccaagcggatagtaattgttgttgttactagttatacatttagaatataaaggaggcatcagaaaaca

SEQ ID NO: 670497 - DNA, 210 bp, Homo sapiens
  misc_feature (15)..(16): n is a, c, g, or t
  misc_feature (28)..(28): n is a, c, g, or t
  misc_feature (51)..(51): n is a, c, g, or t
  misc_feature (88)..(88): n is a, c, g, or t
  misc_feature (134)..(134): n is a, c, g, or t
  misc_feature (148)..(148): n is a, c, g, or t
  misc_feature (173)..(173): n is a, c, g, or t
  misc_feature (179)..(179): n is a, c, g, or t
  misc_feature (181)..(181): n is a, c, g, or t
  misc_feature (184)..(184): n is a, c, g, or t
  misc_feature (196)..(196): n is a, c, g, or t
cgcgcactcacgcannctcaacatcctnccgggcaccagcacgggcaaggnggtgtgctaaaggctgccctccacacccgcgccccgnggcgccccccgaaaggtcacctcactcagcaccactcacgaccaanatggagacagaggnccagcacactcccgagacggcactnagagancncancgccttcacagnagtctggatgcggg

SEQ ID NO: 670498 - DNA, 1149 bp, Homo sapiens
ggcggcctccttgccgcttgcgttaccagagtccacccggtcctcgtgctttctccgggcgcccgtagctggcgccggcatccacaaaaatatgatcagacagaggatgaagtaatagaggaagctcctaggctgtgaatgcgtctagtccttgctcccctcagaagctgggacatgttggaccaaggtggtaaggatacgtgacgtttcccatgaacgctgtgaccaagtccagcgagcggcgccttccaataaaacggggaactccagagacgctatgagaaaacgaggaacagatcatctgcaatagactttctgcaacttccttcttcaaacaacgaccattcggcattgctttctcaggaagccactgccagcctattggtgatagcttgacactgagttcctgagaattctctaattaggatcccagatcggagggtcagccagtggcttagcatataatggacacaaaactgattttactggaagactgagggtgggcactcaccatggttctaagcattcattactcagaagatccataaaaacattacatgttctgtagtgtacgacgtcaggaacatactgagaatcctgacgaaaatcccaacctaaaaaacagtgtcaacctttgtaaagtaggcattggggcacggcggacgatgcctttggtgccagtgtcatcacaagctagctggactatgtgcgcacttttaaccaactaacgcaccccggtggcggactcgggaggaggactctaactagaacccgcgagtaagaccgatttcctggggcacacaatgggttacccaatgcctggcccgacgcccggatacagtgctaacggaaggacctaaaaagttcacaggaaggtgtgaaccacacctgcaacacaacgtgttaccccaacaagtggaaacagaggatgagctagcagcacactgttgcgaggcaggagtcatcgccggatagaaaaacaacacagctaagagaagaggacctacaagacacataggaaaacactgatgcaccacaaacaaacagatagacaaagatcggcacataagagcacccacaagtggatagcacaaatacgatgcatgcgaaaaccaaataaaagaaacaagaaaaagagacagcaccaca

SEQ ID NO: 670499 - DNA, 112 bp, Homo sapiens
gaggaaaccccgtctcaaaaaaaaaaaggaaaggaaaggaaatttattggggctggggggcaaaacctgtggccctggttcctgggcacttttcggggggggacccggcctc

SEQ ID NO: 670500 - DNA, 297 bp, Homo sapiens
  misc_feature (46)..(46): n is a, c, g, or t
  misc_feature (64)..(64): n is a, c, g, or t
  misc_feature (106)..(106): n is a, c, g, or t
  misc_feature (182)..(182): n is a, c, g, or t
attgcaggcatttgccaccatacccagctaatgtttattgtatttnaagtagagatggtttttnaccatgttggccgggctggtctcaaactcctgatctcaaatnatctgcacaccttggtctcccaaagtgctgggattacaggcatgagccatcgcgcccagcccagccattgattatnaaacatgttacttagaaagtagaattaggacaggagcactggctcaggcctgtaataccagcactttgggaggccgaggcaggcagatgacttgaggtcaggagttcgagaccat

SEQ ID NO: 670501 - DNA, 491 bp, Homo sapiens
tggcttctttagagagtagtaagcatggctgcctatgcttggagtcataagtgttatttggactataccctgagataagctgatagatcaagtttggctcccttgaaaagcatttctctcatgtgcgccctcagggcttccagcaggattgagtcaccctgacgatgactggggccaaccagtgtgatcttcactattttcagctgcaggacagagtccagggcgtgagtgcctagggtctcatggggcgtaggcagccagccagtgcaggtcgctggcctgtagcagccaacaagttgagatgcagcccaggagccagacatgcccgttggagttgacctgctctcggtccacttttgccgttccacgggtaaaaaggaagaaaggtgtgtatttcatacacacacgaggacctggattaagaatccgaaaagtgagtgttgtacacgattgagttcaaagtcagccatagataattcaagatttgtatt

SEQ ID NO: 670502 - DNA, 241 bp, Homo sapiens
agtgagcgagatcgtagcactgtaccccatctgggggacaagagcgagacttcatctcaaaaaaaaaaaaaaatcagttgggcttggtggtgcacttctatagtcccagctatgtgggaggctgaaacaggaagattgtttaaccccaggagtacaaagtaacaggaagtaaggatcacacaactgcactccagcctgggtgacagattgagacactgtctctaaaaaaacaaaaaaggtc

SEQ ID NO: 670503 - DNA, 123 bp, Homo sapiens
tctcaaacctgggccaagagatcacccaccttggcttccgagagtgctgggattataggtgtgagccaccaggctgcctgtccgggctgctcttgaactcctgagcacaaatgatcctcccac

SEQ ID NO: 670504 - DNA, 439 bp, Homo sapiens
attgtttagtcctttgcgaatttttttgatttgtgggcccagttatgaagtttccccccatgtgaagacagggacaaaatagcagagcccagcagacagtgggtttatttttcattaggtcagtgacttgtcccccctcgttttagcacttacgtttcaaaagcttgtccccaacccttggggtcattccccgataatagaactggaaatgataaatcccccaatgcccagggtctagtgtgtttttagtgggtaactggggaagtggggggaaatttaggggctgctctgctgctttggaagggtgaagggtcctgggccattttcatggggtggttgaagagctcctattttggactcctgggtagaatgctgtgggacaaaaacaaagtgaaaaaagttttttgtagatttttgaagggcatattcattgatgcca

SEQ ID NO: 670505 - DNA, 947 bp, Homo sapiens
caatgcctcctgcaccaccaactgctatagcaaccctgtgccaaggtcatccatagacaactattggtatcgtggaaggactcatgaccacagtccatgccatcactgccacccagaagactgtaggatggcccctacctgggaaactgtgtgcgtgatgtgcctgcggggctactaccagaacatcataccctagcctactaactaggctgctgccaagtgctagtatggcaacggtcataccctagagctagaacgggaagactcactggcatggactatccgtagtccccactagccaactgtagtacagtaggtagtgcacctagacactagcacgtactaagcaaacaacctaggcccaaactcatagatcgacattcacagaacggtcggtgacatgccagcgcgtcaccggagctgtgcacccacctacaaatgcggccatacctagtgagctaaccactagaggcaccacgtgtaggatcctcccttctagacctatccaaaccacgccgcacaccgcactacctacacacactatatcgcagcgctcgtgcggtcttgggaccaattagtccacatctaagctgaagccatactaattgatactaatgcctccattcttcccctgggtaacttgaccaaaggcgaacatattctgggccctaccatgaccaaacacacgcgcctggggatggggacccctatccacatgggcccccaaccagttggggccttccccacacaaggcgaaccgttccaatgaagtccccgcttagaggcacgccccaacacatgtcagcccagaacgccacaccgtagcctcacacactgaagtggcacatccacgatcgcagcacgaccctcaaaacttggcctacgggctgaattatccccttgcccaaccaacttcatagatcccctccaacaattctctggaacaa

SEQ ID NO: 670506 - DNA, 915 bp, Homo sapiens
gtgagactctgtctcaaaaaaaaaaaaaaaagaaaagaaaagaaaaaagaaaaaaataattggggcttggggatgcacccctgtggtcccagttacccaggaggctgaggcaggaggatttctggcacctaatgaggtcaaggctggcttgcagttgagctgtgattggtgccactatactccagccctggggtgatagagggagatcctggtctcaaccacaacacaatataaacacgagtttttgaagaaattgatgactggaaaacttaactaatttgggtgaaagacagaaacctacagcttcaagaagctgaatgaaccccaacggttatccccatgagactctggggggctgagatatatacaaaacacaacttccttgacacaaatacaatttctgcggaagacttttctgtgaacgcagtacagagactgaccacattaccctttagaggattcccatttccaattgaacagccgatttctccataaatgggagatgagaaggaattgccacaatattttccagtccggaagacttttcccctgacattctatgtctggaaaactatacttcccagaagtgaaaagagaaattaaaacatttctcagattgaaggaaacgtacatgaattggtggaaggcagcactatccttaacgatggtaaggaagttcttaaccgacggaaacatcacagatgaacctctaggcgtggaggacaaacaactttgcagactttggggcatcaacaagggtcttccgggagtgtaacagtggtgtaccaaagaagaagaaaaaagttgtgggccgcgcgagaattaacatgggcggccaagaaacagacagtccagacggggagggacacaacgggcggtgaacaggtggtacgtacagccacacgggcgcgaaag

SEQ ID NO: 670507 - DNA, 351 bp, Homo sapiens
gcctgtgccggtggacacccgcggctgctctggtggaggcccgtcgcggtcctgacgtgcgtcctcgaccgtccgtgctgtgtataggggcgaaccactcttcgtatcatctcgtaacaggttccctccgatgtttccctcaggatagctggagctctcgctagaccctacgcacccccgtcacgcagtttaatcaggtaagagcgaatgattagaggtcttggggccgatacgatctcaactctattctcaaactttaaatgggttatacgcccggctcgctggcgtgaaaccgggggtggaatgcgattgcctagtgggtcacttgcgattagcagaagtggcgctgcg

SEQ ID NO: 670508 - DNA, 299 bp, Homo sapiens
gagaatggcgtgaacccaggaggttgagcttgctggcgcggcagtgcgctcccgcgtggctccggggcgatacctcgtgggaggtggccggcaaagggtgccccgtggtcctcataggttagggggctctgccgcggcttgcccagctcaggctcaatgactggggcgccgcgcgcaatgaagccccccgagctgctggcagatcccctggccggctcttcacgctctcctcgtagcaggcacgtcccagtgcccgggcgtcggccatcacatccagcgggtgcacggttcggaacgtc

SEQ ID NO: 670509 - DNA, 176 bp, Homo sapiens
agagttattctcccaccgttaagcctccgaagcagcttctcggtactacagcaccagcaccatggcctggcttattttttatttagattattattcttttgtatgattgcagtgcctctatcactgcatactgcagccatggcttcccaagctcatgccattccttctacctcatt

SEQ ID NO: 670510 - DNA, 377 bp, Homo sapiens
acgcgtgggttgaattcctggcctcaagtgatccacctgccttggcctcccaaagtgctgggattacagctgaccactgcccccagcctgtacttctttttagtagagatggcattttgccatgttggccaggctgatcttgaactcctgacctcaagatgatctgcctaccttggccttcctaggtgctgggattacaagaatgagtcaccatgcctggcccaacttttctgctttgtgttttctttttttattttctaatattccttttttgcctacaaaccaatttttacgtttttaaattctgtatacatactgtgtggccttgggcaagttacttaattgcattgcaacttaagttttcccttttgtacaaa

SEQ ID NO: 670511 - DNA, 1623 bp, Homo sapiens
gcattaccatctcgacttctaccgaatactattatatcgctcacacctccatatcctccctagtatgcctagaaggaataatactatcagcatgtgcacttatatgctactgcctcgataacccttacaatcacccagtccctcttagactcagatacttgtagccgctacttgcacattacgtagatctttgccgcgctagcgaacgttacgcggctgggtctagcgccgtactagatctcgaagtgctccagagcagcatatggcctagtactacgtacgataagcctagagctactccaagtgctagaattaatcgtgccaacgattatattagtaccactgagatgaatttccaaagagaagcacgataagtttgaaatcaaacgacaaggcacgcccacatgactagattcattatggcgatcatcgcgccgcttacttatttttctataagcccaatagtcaactaatcagagccttagtcttcagactcgttttccacacaaccctttattctcctacccggactcgcccttgataggaaaacccgcgcctcacttacactactatacatacgcgtgagcgtacctttaacgcacgctcactacactcgattgggcaaggggccagggcagccagcatttaatcccagatgataccaacggtatctaacgtagacaccaaaagaacgtcgtaccacgtcctcctaagtatcgtcaggtcatccgcctattaaaattcatcctctaagattattacagcggtatctaccaagccccacacaggaaacattaccttcgattattgtgcataatacgtgtgcttgaagggaagagccaacggacttatttcccccagacacttgaggtgtactgcacttggaaaccgaactgtagaggtcaacccctgtgcacatttgaaacagccgccttgcaaacggcagttgccatcactacgtgtccgcgtatttcttaaccatcccctaaagtaggggctccccctttcccaccgtaaatttcaaatcggcgggagtaagattctaagagacttttagaatgtgaggccccgtttgtgcgattctaccagttaaaaaccatttgctaacgtacgttccacatcaatcaatgttggcccgcaagagaaacttatttaagagagtcccttgtaaaagccacacaagaatgtgagtaactgggggtagagcataacaacgacaagaagccgtctcgatgacgtgaaaagagtataaccacctgtataggggacaactacaacatagatatagtgttaccgctaaaagaaccacttttcgaagaagcccccatagaacgggcagacaaacaaacatgcgaccgaagaaccataaaaaccaagtcgcggcgaagacgataaatatcgagccagagcgagtactcacagcgcgcacacaaaaaaaaagcagacagacgcacgcagaggaaaacaaccagcaagagagagaagaagaagcacatcggtagagcaagaaagagcgaaatacacaactgagaagtcacatagaaaacgacgcagagacgaagctcagaaaccagacaaacaacggagagagactaaaaaagcgagacgaacaagacaacgggg

SEQ ID NO: 670512 - DNA, 248 bp, Homo sapiens
cttgaatgtgttggggcaaagaaatcttgatatgatcaaatcccgtgcaacagccgcatcaaattggctcatccccaagcttatggccagatggggccagtggtatggacatgcacaacaaattggcacagtatatgcctaatggttggcaagttcctgcatatggaatgtctggccaggcatggaaccagcaaggatcaaatcagacaccgtcttctgcaccatagctgggcacacattatggagtg

SEQ ID NO: 670513 - DNA, 732 bp, Homo sapiens
  misc_feature (55)..(55): n is a, c, g, or t
ttctcctcttcctgccccccttggcatgggtgagacctgaccagtcagatggtanttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagatgggttgcctctgccttggtgatcctgagttccagaaagggtacacaagggtgattttatgggtgatgtcactcaccttagaacaaccagaggctgggcattggaggctaacctccaacacagtgcatctcagatgcctcagtaggcatcagtatgtcactctgggtccctttaaagagcaatcctgggaaaaagcaggagggagggtgggcttggctgttgtggggacatggcaatctagaccgggcagcagcgctcgctgacagcttgggaggaaacctgagatctgtgttttttaaatgatcgtcttcatgggggtaagaaaagctggtctggagttgctgaatgttggcattaattggtgctgttggcttgtagttgaataaaattagaaacctgattgaacacacaccaaacacagg

SEQ ID NO: 670514 - DNA, 754 bp, Homo sapiens
  misc_feature (55)..(55): n is a, c, g, or t
ttctcctcttcctgccccccttggcatgggtgagacctgaccagtcagatggtanttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaaacctcccttaaagattctttaagggaggtttaaaaaaaaaaaaaaaaaaaaagatgggttgcctctgccttggtgatcctgagttccagaaagggtacacaagggtgattttatgggtgatgtcactcaccttagaacaaccagaggctgggcattggaggctaacctccaacacagtgcatctcagatgcctcagtaggcatcagtatgtcactctgggtccctttaaagagcaatcctgggaaaaagcaggagggagggtgggcttggctgttgtggggacatggcaatctagaccgggcagcagcgctcgctgacagcttgggaggaaacctgagatctgtgttttttaaatgatcgtcttcatgggggtaagaaaagctggtctggagttgctgaatgttggcattaattggtgctgttggcttgtagttgaataaaattagaaacctgattgaacacacaccaaacacagg

SEQ ID NO: 670515 - DNA, 136 bp, Homo sapiens
gcggccgcctactactactactgctcgaattcaagcttctaacgatgtacggggacatgtttgtgacaccaaaaagtttatcacagaaattcaggacagccaactgctattaaaatgttctggtttcaccaaaaaa

SEQ ID NO: 670516 - DNA, 799 bp, Homo sapiens
  misc_feature (55)..(55): n is a, c, g, or t
ttctcctcttcctgccccccttggcatgggtgagacctgaccagtcagatggtanttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagatgggttgcctctgccttggtgatcctgagttccagaaagggtacacaagggtgattttatgggtgatgtcactcaccttagaacaaccagaggctgggcattggaggctaacctccaacacagtgcatctcagatgcctcagtaggcatcagtatgtcactctgggtccctttaaagagcaatcctgggaaaaagcaggagggagggtgggcttggctgttgtggggacatggcaatctagaccgggcagcagcgctcgctgacagcttgggaggaaacctgagatctgtgttttttaaattgatcgttcttcatgggggtaagaaaaaaaaaaaatgttggagcggccgccaactttttttttttttgatcgtcttcatgggggtaagaaaagctggtctggagttgctgaatgttggcattaattggtgctgttggcttgtagttgaataaaattagaaacctgattgaacacacaccaaacacagg

SEQ ID NO: 670517 - DNA, 355 bp, Homo sapiens
  misc_feature (117)..(117): n is a, c, g, or t
  misc_feature (150)..(150): n is a, c, g, or t
  misc_feature (152)..(152): n is a, c, g, or t
  misc_feature (236)..(236): n is a, c, g, or t
  misc_feature (254)..(254): n is a, c, g, or t
ccagctactcgggaggctgaggtgggaggatcgcttgagcccaggctggtcttgaactcttgggctcaagcaagtccacccacctcagctccaaaagtgttaggattacaggcgtgnaccggcgtctggccctgctcatttctctacctnancttgaggaagcgtagttttttgacagacaaaaaataaatacaggagtgagaaccagaaactaattagttacctacaggcacctnagcctcccaaagtgttanggttacagggcgtgccaccgggcggtcttggccctgccttaatttctctacctaaccttgaggaagcgtagttttttaacaggaccaaaaattaattccag

SEQ ID NO: 670518 - DNA, 739 bp, Homo sapiens
  misc_feature (55)..(55): n is a, c, g, or t
ttctcctcttcctgccccccttggcatgggtgagacctgaccagtcagatggtanttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagatgggttgcctctgccttggtgatcctgagttccagaaagggtacacaagggtgattttatgggtgatgtcactcaccttagaacaaccagaggctgggcattggaggctaacctccaacacagtgcatctcagatgcctcagtaggcatcagtatgtcactctgggtccctttaaagagcaatcctgggaaaaagcaggagggagggtgggcttggctgttgtggggacatggcaatctagaccgggcagcagcgctcgctgacagcttgggaggaaacctgagatctgtgttttttaaattgatcgttcttcatgggggtaagaaaagctggtctggagttgctgaatgttgcatcaagttgtcctcgtctcgctcgctagtagaatcaaatagccaacctcactgtactcgtcatgtatcctccgat

SEQ ID NO: 670519 - DNA, 413 bp, Homo sapiens; identical to SEQ ID NO: 545663

SEQ ID NO: 670520 - DNA, 871 bp, Homo sapiens
cagaagttttatctcctactgtgaagggcaaactgtcactggaattaaatctccacggtcatatactcccaaaccaatcctgtgattcgggaagaggacaaagatcccagtctcacttgtactttgcaaagtcatgcatgcacttgtgcctcgcagttctgaggtcatattgcagcgcaacaaaaagcaaggaccagagcacaacccatcttcctcctcctcccccatctcccatccatttccagccagcccaacttcatgtcattctagccctgcagcaacccatcaatcaatgccaaaggaacctgatttctgcaacagccagccttaaaacaactccaccgtgttgcacttggcaggcatgcattctgcatcaacattcacaagcaaacgcagctggcaagtcttcctgcccatgacaggcagcaatccctctttctcactctctttcatcatgccatcagcaggtccaaccctggttgggtccccacccacaacctgcattggcagcatccatctccagcaacttggccaaacttgtgcgcaggcacgactcgcgcaacacaggattttggagccatcattattccgcagacaccattccattaggccacacatgtcgacacatacacttaaggtggcgcagccttccactcatatgcagtcaggcttctccagcgacaagcagccgggcgtgagatagaaaccctcactggtatattcactccttcgctgttgacacattctcttattggcccatcaatcgttccagcaccacgacaatgacactcggcctgagcacaatcctggactttacgcagacgaccccggacacgttccccatggacccctcttggccacaaatctgcgg

SEQ ID NO: 670521 - DNA, 616 bp, Homo sapiens
  misc_feature (55)..(55): n is a, c, g, or t
ttctcctcttcctgccccccttggcatgggtgagacctgaccagtcagatggtanttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaaaaaaaaaaaaaaaaaaaaaaaaaaaacatgttgcgggcccgccttgggccctgagaaaaaggtttaaacaacaatccggtgggaggccggcgccgccccaagcaagcggaaggacaaacatggggccactagggggggtcccaaaggaaagaccgtggcgccagggagccaaggtgcgggagtttttccacccatataaaaaaacgcgccgggggggacacaggatcggtctcgagaccaacacaaaagatgggaggtcacagagggccatacgggggtccttaacacaaggggaggcccaaagagacgccaatatcaaattacgcccgggtgtgggt

SEQ ID NO: 670522 - DNA, 828 bp, Homo sapiens
atacaggaaaagaaacatgtcatccacttgagttaatagttctgatttagatcagctttctgattcatgctgtctgttaacatcaaaactgatctaaagtcagaattacttaccatgtgaggagctttccttaatacaggaaacagacaacatgtcatccacttgagcttaatagttttcctacgctcgatgacagccctcatgagtagcatccacattttctaaaatttcaaattggtttttctactagctagattgtgctttctagcagaacagatgcaacggcataggtgattgtttaggattttcctctagccttttgccattacctattttgggcgatgaggttcacagctagactttgagtgaccgatcccaccgtgcaagtgaattctctgcagctggtggtgtggtgctggcaaggcaaggttatttttggagccactctctccccttccggatatttcccaagggcctgcttcaacttcttagatgacctctagcaggctgacaaactatccacatggagcatgatgccagaatactccaattcaggagccctttgcgagtatatctgacgcactcacttgctcacggaaaccctgtatccgcactagcactactgcgctgtctggaactctgtccctgatctgagtgggactagactggcttcctcgctgcctggccaaccggcacttcttgacattcctggcccctggcacctctgtcgcctgtcaccaactgcctgcccttgaccggttacttaatccccccctgcttaccggtcatacctccgccacgtctccctcccccccctctccccaccta

SEQ ID NO: 670523 - DNA, 123 bp, Homo sapiens
taagccccccaggaggttgccagtctttcagcttcggtttctcggctgtattatctgagctacaggaagttgttcagcatatttcagaggttccattagtttctcatccatctggtcttcctt

SEQ ID NO: 670524 - DNA, 306 bp, Homo sapiens
gactcatagaggctcccccatgtctgacgacaggcaaagaatgaagctttgtataacacgacccatgtatatatttggcatgagaaactaacagtccatacactctatcttcagacctatcaggatcacagttaaaaggaagacttggttaagtcgaatatgacaataaaatctgtgtgtatcagcatactatagaagcattcatcagcagcctcaaacagtatacattgtccatttactagattcaatcgtctctaagtatatagggctgatgttagcaagaccctaaaaatgtccattgaaccc

SEQ ID NO: 670525 - DNA, 101 bp, Homo sapiens
gctctactccacctgctatcccacacctataagacatgttgaatgcccccatcgctttggtcaatagtacttgcctgcagtactcttaaaactaggcggct

SEQ ID NO: 670526 - DNA, 195 bp, Homo sapiens
gggctgtatctagaggaccccgaccgccatactcggtagctaacaccctaatcaactggcttcaatctacttctcccgccgcaggaaaaaaaaggcgggagaagtcccggcagaattgaagctgcttctattgaattatgcaattcaagcatgacattcaccacgtgaactggcacaaagcagggcttaacctcg

SEQ ID NO: 670527 - DNA, 806 bp, Homo sapiens
acaatttcggaaaatcaatggctttcctaatgcttgctggggttggggtggagaagatgacgacctctggaacagagtacagaatgcaggctattctgtgagccggccagagggtgacacaggaaagtacaagtccattcctcatcaccatcgaggagaagtccagtttcttggaaggtatgctctgctgaggaagtcaaaagaacggcaagggctggcatggcctcaacaacctgaactactttgcaaacatcacatacaacgccttgtataacaaacataactgtcaacctgacacccgagctggctcaggtgaacgagtactgagaggacgagaatgtacgtttgcgtttacccaccgtcaccaagaacagcagtccgatgagacccccccccaggcaggggggcacgggtctacacacgcacagcagaacagaacctactgtgtctcactgaccggactcacagacgctccagggggaaacatgctgacagcaccacgcaccaaacgccttcactggatcagccgctggaactgagcggagtgagctcggcggacttccttcgtcagcaactggctttctgtctacacaagacacgacgtctgtcccgctgctctctcaccatctcctacccgacatcctgtcttagccgctagtctccagaacccatgattgacactgtgaatctgcacgcggaacctgcacgtgactcctagccgctggaagacctgtcccataacacatgacctttgagagcctcttggaccttcaaagcagcaggccaacccaaacaaaggacagcac

SEQ ID NO: 670528 - DNA, 106 bp, Homo sapiens
ctattagctcttagtaagattacacatgcaagcatcccccgttccagtttgaggttcaccccttaaataaccccggtccaaaggggcaaagccctaagcgcggcgc

SEQ ID NO: 670529 - DNA, 393 bp, Homo sapiens
cgtactttgcgtagattcatgagcactggccacgaggtgataaacagtcatttagacctctctgtcatttaatatcacatatagtcacatatgctcagcattactctggactatatatggctggctctatcaaattggactaacacaaagatggtatcatacattcgtgacagaaatggtacgagacattaaatgaattactggatggaagatactttacaaagcgctttaaggactataagccatgaggtggctcttattaatggtcaatctgagagactaaatttaaagggtcaggcgtttgaaacacaagtgcttattgatatctaggggaattggaaattcttgactaaaggcctataacaaccagatgagcgggtgcacatgtgacct

SEQ ID NO: 670530 - DNA, 687 bp, Homo sapiens
ctttttcccaaacaagtcaaccccctttttccctccctggtgtgaaacacgagggttatcagggggtttctccggggggaaaaatgttctaagaaggatactctctattctccccctcgtgtgggaccctccgccggtttgggaaggggggaccaagagggtctctccaccgaggccgcaagaggggcgcaccccccagggccaccagatggtgagaggtggggagaggccccagaccacaccacacgcggggggacttttccaagaaggggggccacgggcccaagaaccgcggcgcccgcgaaaggagatctgagggagccacacagaaagggacaaaggagaaccctgaggccacggagccacacaagtggggccgcccggagaggtgccccacacttcacacagggggagagagccacaccccctgtcaacccctccccctctcctcgagagacacagggagttcacaagaaatatgccacaaagagttcccccaagcctctatgccacggggggcgccgttaataataaggggccaactaggcacaataagggaggggacagttttttaatttttttatgcgccccctcctcccccaccctgtttggggcaggggggaaagatgatttttgagatataagcccaggctcccctccaaataaagtttgtaaagtgccccccca

SEQ ID NO: 670531 - DNA, 1071 bp, Homo sapiens
cccccaaccccttaacaccaaacacaaaacccccctcagggcaaacccagtgctcctgtttctaagatcgatcccgaacacccgacagaattgcttactactcctcagcagctcacccaccaggcgttcagccacagaagtcaccatatacaggagctcacactcaagcaggtcaaattgaaggtcagatgaccaacagtaccagctacaggccggctatggagcacagtagccgcaagctccacctcagtagccttaacagaattggcctgtccctattacagcccgcttatctgtcaccacgactgcgacctgaccacctctcaacaatttccagtgatatcggccaacgaccaactactcaaagcaccagactcctgacttcccatggccacaccacccgaactcgcctcgtcctaatacgccacagtaaacaccatggcgagaaactaacaactgtaaaaaagttatctcctcgacataagcttgtcatccgctactaatttactcctactgccacctctgcactctaaatctctgcaattgtgcttctcacaccattcttgatgacctcatatactacgaaactaggatattacattatattctgctccaaattcaccacttatactccgtagaccatccgtgccatcacgcctctactcctcggagatcacgaactgaccttgagaataaggtcgatttcgacatgtcaggtctcaaggatgtccaatgtaggaagctcatcgcaccgacaactaaatggaataatcataatcactatcatgaagcccagagactatcttatcaatgctccaattaacacaagacaaacaccaaatttcataacctgttatagccacatccatcatgaggacaagtatgactatgcacacccagttcatgagagccaccaacgatagagcaatctctactccaccacccacccacatcatgctcgctctacggccaggagacctactgcacccacgcgaacttcgactaacgtatatataacccataacaaatacaacaagtcaacatcagcaaactctaccagaacgtaattgt

SEQ ID NO: 670532 - DNA, 969 bp, Homo sapiens
gcatcgtgtaagcattgatccagagtgaacacatgatctatgcatgtgtattccttcagttctttcctttgattcttagaccatcttctggcgtcatctgtctcccgtcctttggttctccagttcaacattcattgtcccccgtacccgcgatcttctgagtaggtgcgggtctgacacgtgtggtcctatcatatataaggatccacacacgtaggacttttacccgtgctgtacgcgagaaaaaaacaatacactacggttcaagaatggagccggcgtggcatgctgcatcagtaggcgaagccgctcaaattatcttcacaatcaacattagtgtcaaaaattatcatctcgtttacgaaggctctccattatggcatcgttgaatttatatgtaatgtccctaaagcacagtctctctactcctatctctcaatcctgcaaggcatcctcagaaatatttgaaccatgacagttgacagtccgtagttactggacaaaatctttgcttgataagtataagaccagtatttggaccttgctgccagtatttcttaagaagctcctggttgactttcgtttccgtgttgatattgcgggggggcacgggcacccctgtgttgactgtctgcatatgcagtctgtgaacctccggtggtgggacactacaagagttgtagactgttgcaggctgatgtgatgttgaagagtgcctaggatattcttgagcagtcgctctgttcgttgcctgaagcatgtttattaagctggtgactaatacaacaagcatttgcgcgttaggccaagaaatttaaacgttagtgggaggcccagtatatagatgatccggtcagaacagtaaggggggtacaaaaaccgggcacggaaaccagggggcaggttaagcgtgcacaggaggagagaatagataaaagtaagaatataaatatatcttacattttacga

SEQ ID NO: 670533 - DNA, 685 bp, Homo sapiens
  misc_feature (31)..(31): n is a, c, g, or t
gaattctgcacgaggttatatcatttatttncgtttcctctcttctctttgttgagatatttttcttaaataaaatccctctcctgttatagtcatctcaacattatattttttttaactgcagctggcttcaccggaacccattttctgtccacaacatacacagattatgaaattatgtttcatgtttctaccatgctgccatccacacccaacaacagacaacagctcctgcgggagcggcacattggtaacgagatcgaacaattgctttccaagagccctgagcacagccattcaacccaaaaaacattcgttcccactttcagcacgctttcgtgatcgtcagggtgcacaatcccgcgctctgacagaggcttgttatagtgtggcttgttccaggtccagagatcggccctcctttggacctcccattcctaaagggggcactttccctaagataaatgtgcttagggccttccctttgtggaaggggctattgcgcaaatagctgcccacaaaacgtcacggttcccccccctcgaccctttctcgcccgggatacctgccgtacctgcccaacagaattgctccaacccttatttcccttctgggtttcgatcactcctctggcttcccggagcccgcgccctattcgcattcagggtccccctcttcgcccgtc

SEQ ID NO: 670534 - DNA, 223 bp, Homo sapiens
tgtattggtggtgctctctatatagcacataacagggaagaacaataacagaagcagatcatgccaattgctctctctttgggatatgattatttcccttgtgaatgaagtatttaacaacatatgatatggaaaagaacgattctttttgtatactccctaaacacacagagtttactgggtcagatctaaccgtgagcatttatatgcctacttccaggct

SEQ ID NO: 670535 - DNA, 106 bp, Homo sapiens
ggtgagagtatcttgccagtgcagtgttctaagaaatagtatgctatctaaggctcgcgattctgggtggtgcttccttagttgttgagctgcagtgtctctctgt

SEQ ID NO: 670536 - DNA, 741 bp, Homo sapiens
tgtagtactatccgattagtcgctcgtgagccagataagctgtgtgagtgtcttcttaggagcttgcctaggagacttagtcttgtgactaacttgctgtgtagtgttcaccttctatcaccctgcgcagtatgttgctactgatgccgcttcatgatcacgaactccagtattgaagatatctgaccgcatcacaaaggtggtagtactactcggtgaatggagatcaaatgctgttgcttcgtatctactcacgtcgttaccttcaccgcgtagctgacaattagttgacactgaatcataattacacccagtacgctcaatcatacacttttactcatcactgtacttctattagcattgagtaacaagctctgatttgcaacaatgatcctgacgaacaaggccactcagcaaagacagttttaattgtcccactgtttgtgcgttccaagagcagcatgaagaagaatgaaaagccacggagttcaaataccttttcacctgtttgcctccctgggttataacaaagccagtcagagtatctattgcctctcagatgattagccttgtgacgtgagaccagacatgttgattttaccctgactgaaggaaagacttcatagctgggaaattcgtagggctgcccaaagtcattctctatggtcctactatacttgaaaattttctccttttggtgggcggtttctttccgtattttctaaggtacaacataccaga

SEQ ID NO: 670537 - DNA, 672 bp, Homo sapiens
  misc_feature (52)..(52): n is a, c, g, or t
ttagcaacctcctgattagattctgttttctcctcttcacaggggaattagnagtaggggtggtttctggtttgacagtccgccgtcttacatcgatctgctcctgcttttaactctgctcttgtttcctaccactggcctgggagccagccttttcagttctctcactgacaaactttcagttcttatttatccatctgttttccagctttcaaaatgttgtagctttgtctcttgggtttttctcttacttatggattttattgaaaagaatctttgttttatttttaatggaatatagggagagaacgaagttagatgcttctgttctgtcttgataccttgacccagaggtcatttttcattctcttagagatgtctttaataaattttttttttgaagaaaagtaaagcaaacttctttgttttaatacagtcagatatttattagagtcaccatattttttatcgtgttgaaaaaattctttcctactgtgatgtcataaagattctctgatactgccttacatagttgcctggctgtcacattcaggcacaggaggccatcttttctctgctgatgggtagtgccagtgtcaggtcaccagaggctctttcagagttctccactctggacgtgtctgacgttattgagcagctttagagtagttc

SEQ ID NO: 670538 - DNA, 609 bp, Homo sapiens
tcacagcacttggagcggagtctgcgagcacacgcaatggttgaaaaccagatactcgtatgtgatgacagtacaaagatagtacggatgtagtgaagaagaaacaggagtcattaaggcatatcaggaggagagatatgtgagaacgaaaagggtattaaagcaaaatttacgtatgagagaatgaagtaaggtgagagagtggagagggagggagtgaatatagagatgttagccatggaagagtttagcaagtggcagttggaaatgaaattgtacattataaaatgtgtaaggagaagcagaggatagaatgagacgatgtgatgagacaaatttaggaagagacgaaagaaaagatagatgatacatggggggaataggaagtatagagaagaacacgaaaagggaaagaaagaaagaattaagaggagacataagagagaaaataaaattgaagaggaagaataataaagagcattaaatggtagaatgagagatgttattagacaaagaatagataggtctgtttagatagtgaatttactgcattagtagagaatatttttcaaagggagatggtcatagacaagaagctcaatagacgat

SEQ ID NO: 670539 - DNA, 911 bp, Homo sapiens
acagaatccctggggtgctggacgtggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgttggcttgacagggtcacctgagttgattaagcatggtgggtcccggtgagtgtaggagatggcacagataccagggcgagctcttgaaaacggctcgggagacgggagctgcgagcaggtgggcagatgagggccctatgcgcactcaggggtgaagggcgtcacgctggcacactctgcagggtgccccatgaaggattccaggacacctcccgtattgtccttgaggactgctggctgtaaccagggtacatcaacacaactcaagacaagcacacacagcccctatgtcagcttagagggggagccccagtccatgaagagcttgatcatctgtagtcaggaccagaacaccaggacaacaaagctggattcatgctcccatgagcaccttacaccaaccatggataccttcaccctgggagcatccagaggagaccttagcaccccttgaagggtaagactactccatctcaacggtgaggtagatccttatcacggttggcttgcaggacacaccaaattgggatctagatataatgggaaattctgggatttaagcagagatgtgacagatattcttgaaaacacatagcaaattggggttgatttaagaagcaaatggatcaatttgtacataagggtaaaataattggtgcaaacacttgagtaggtga

SEQ ID NO: 670540 - DNA, 413 bp, Homo sapiens
  misc_feature (14)..(14): n is a, c, g, or t
  misc_feature (23)..(23): n is a, c, g, or t
  misc_feature (160)..(160): n is a, c, g, or t
atactggtcgggtnaccttatanacccactcctcaacttggatgttttatccttatggtttagacctggagttatggcttttgggaaagaagaccgtggagatataatgcccattcctcatcacatcagatcaagagtacatattgttggctggtgtggntgtcacgccctataatcccagcactttgggaggtcaaggcaggtggatcattcgaggcccaggagttcaagaccagcctggccaacatagagaaaccctgtctttactaaaaaatacaaaaattagctaggtgtggtgacacaggcctgtaatcccagctacccaggaggctgaggcacaagaatcagttgagccagggaggcagaggttgcagtgagccaagattgcaccactgccctccagcctgggcaac

SEQ ID NO: 670541 - DNA, 103 bp, Homo sapiens
acggtgctcaagccagaggctgtgttcatttgtgtaacgacgaataaactggtacgagtctgtgtgcaacgaaatggggatcctgctagatgtcgaccgtgca

SEQ ID NO: 670542 - DNA, 222 bp, Homo sapiens
ctccgagcagtgttattgtcattcctaccagtagtatctatgttctccaccatcatcaccaacacgtgttattgttttctccagcatcatcaccagcacgttagtgggtctaaagtggtatcttgtgatttttttttttttttttttttggaacgggattctttttttttccacccgggttggattgcagtgtcgcattctcggttccattggacctcccac

SEQ ID NO: 670543 - DNA, 176 bp, Homo sapiens
ctgcacgatcagtgcacggtactcatgattcggcgctgagagcaggttacggcaattcaagttgccgctaacagctgtatacctactctcaagcggcagacgtgctagctacatgtgggcccttaacagcccatatgagtgacgataatcttaactcaggccgacgaaaatcttag

SEQ ID NO: 670544 - DNA, 141 bp, Homo sapiens
aaaaaaaaagttttttgggccgggggtggtgggtcccccccgttatcccagccccttgggagggtgagggggggggatcattttaggcccggggttttagccccgcctggggaacaaaaagaaacttcctttccaggggga

SEQ ID NO: 670545 - DNA, 370 bp, Homo sapiens
aaggcagtggttatcctctttcccaacgccaccgcgtcccccccaacctccggctctcgtcctcgtggtgggtcctcggcaccgcccccctacctcctggtggagtaagaagaggaacaacaccacaacaccactgttgtggtcgacgccccgcccccacaccatgaattacacaagaaggaccgagtctccttccccacgagagaggagtctgttgtgatgacgttgagaagagacaacactacagtcgggcgtcttctctgctgtgaactctctttttcttgcctgtaaacccccctcccctgttttcatacacacacactgtctctcccacacatagaaaaacactctggacccctctctgtgaaaa

SEQ ID NO: 670546 - DNA, 153 bp, Homo sapiens
tgtacatgcgcacagtacgagcgtgggcgtgtccgtgcttgcgtgtgaatgcaggtgtgggcgtgtgctctgcctgcatatgtgtgtgcatgagcgtgtgtatgtgcgtgtgtgtgaccttgcgggtgtgggctgtgctgtgtagtgggaagt

SEQ ID NO: 670547 - DNA, 512 bp, Homo sapiens
  misc_feature (47)..(47): n is a, c, g, or t
  misc_feature (62)..(63): n is a, c, g, or t
  misc_feature (108)..(108): n is a, c, g, or t
  misc_feature (117)..(117): n is a, c, g, or t
  misc_feature (152)..(152): n is a, c, g, or t
  misc_feature (169)..(169): n is a, c, g, or t
  misc_feature (178)..(179): n is a, c, g, or t
  misc_feature (192)..(192): n is a, c, g, or t
  misc_feature (219)..(219): n is a, c, g, or t
  misc_feature (231)..(231): n is a, c, g, or t
  misc_feature (236)..(237): n is a, c, g, or t
  misc_feature (241)..(241): n is a, c, g, or t
  misc_feature (278)..(278): n is a, c, g, or t
  misc_feature (297)..(297): n is a, c, g, or t
  misc_feature (305)..(305): n is a, c, g, or t
  misc_feature (307)..(307): n is a, c, g, or t
  misc_feature (310)..(310): n is a, c, g, or t
  misc_feature (312)..(312): n is a, c, g, or t
  misc_feature (340)..(340): n is a, c, g, or t
  misc_feature (342)..(342): n is a, c, g, or t
  misc_feature (409)..(409): n is a, c, g, or t
  misc_feature (419)..(419): n is a, c, g, or t
  misc_feature (431)..(431): n is a, c, g, or t
  misc_feature (477)..(477): n is a, c, g, or t
cttcaaatggagtgtccaaaaacactctgtcttggctttccaggggntcagtctctaaattnnccccagaatcttcatttctgtcttggagccggggtacacttaaangggggactngggggatgggggctcttacttcgtccacaaagtcnggggtgttctttttganccccagggnnagaacacattttnagccaggggggggggggattctctcantggggggggggncctgnngggnggggacacttctgcgggggcctaactgaatcaagtgnggggtgatcatggcgggcntgactgantnacncnccagaactaacaggggttccctcctttngngggcgcgggtaacttcgttagcgccaatggccagccgccccccggcgcgggcgggcgtccaccctgncactgggtgnttagcatctgtnttcttctccttcagattctcactaatatcaacagcaatgctgcatntctctctgctttcttttttcagaaaaggtgttttg

SEQ ID NO: 670548 - DNA, 132 bp, Homo sapiens
catagagaaggctcctggtgcatcttccaaatgagtccttaaagaacatactgagtacttgaagtagaagaacactagatgtatttctgactaaaacaaataggtctttcacatgtgctttattagactctg

SEQ ID NO: 670549 - DNA, 182 bp, Homo sapiens
agccggccccgatttaccggaagcatctctacatactccaacgatggacaccttgcaggacattatgctaagggaaatatggcagttacctgaggacaaatattgtatgattctacttatatatggtaattacggtagtccacttcaaagacagaaagtagaatagtggtttcgctaggggc

SEQ ID NO: 670550 - DNA, 99 bp, Homo sapiens
ccgttctctctgacagcactcgcggaggggttcgcgtggtcgcgcgtgacagatcctcaaatattttctgttactaattgccttcatgtaaactgtttc

SEQ ID NO: 670551 - DNA, 126 bp, Homo sapiens
agtatgactgtgctatcatctcataatcaatcttatattagattactggttcttatcacatttacacaaatatagataacacatagaagtatattaacccacttataagtggttctgacacattag

SEQ ID NO: 670552 - DNA, 576 bp, Homo sapiens
gccggggagctccagggtacccagtgcgccgtcgcttcggcggagcctgggttgaccagccaggacagcggggtaaacccgaacaattctgcgcgaggtacggaggccatggcgtcctggcagctaactggctctccggggtgaatgtcgtgctggtgatggcctacgggagcctggtgtttgtactgctatttatttttgtgaagagcgcatcatcactgcgctttgcaatgaaatctcgaaggggacctcatggtccctgttgggacacaatgcccccaagggacttgaaagaggagattgatattcgatctctccagggttcatggatattcaagttatgagccccagtctccttgcggattgatgatgctagaactacgtacagactgtgaaagccctagcggaaagtcaaaacgttgctaacagagctattctgctatagagatgaaatgctctggcatgccgattctgtagcctctggaggaatcccatttcgattcgtgcaagtgccggtcatcccccggttcctttaatgcggcaagaatttccgctcctacctggctggatctgcga

SEQ ID NO: 670553 - DNA, 187 bp, Homo sapiens
gctctgagatccgtgatacaccagtggctgagctagggtgagaaatagagcatctaggtcaagctgcagtctctgtgaataagtcaaggctagatgaggatcagtaacaggcccaggaacacggtctcaggctgctggtgtgagaggggttatgatgagctttgcccagtggatgcccactgggtta

SEQ ID NO: 670554 - DNA, 171 bp, Homo sapiens
agtgactccttattaaaaactctttacccagttatgaattagtgttattcctttttatacacttatatgtatagaaaacaaatgggtcaggtttcttagcataaaaaaagtattggaaaacaacactcattctttttttttttttttaattttttaataaggcgggtcccg

SEQ ID NO: 670555 - DNA, 294 bp, Homo sapiens
gggccggggcagggacgccttccaagatgccaggctgcgcagtgggacagcgcagccccagaagccagcacagggcaaggtagacagactagaagaggaaaggagagccagccgcatctctacactcgcgtcctgcgagccagcaggcgctcttctggtttgctggtgaagccagactgggtccaccgttgtggacatgaagagtcctcgggcgagcggggtccaacagcagaaattggggtgttatgtgttgaccctcagggtggaggtggcccccgctcgcccgaggactct

SEQ ID NO: 670556 - DNA, 162 bp, Homo sapiens
gtgtcaaggttgtgctggtccaggtcttggtgaggcagcagaccgtggtacggtcccagggttgcgtggtcccaggttgtagctgctgaggaccctgaaacaccgttgtttaaagacttcacacagaaggctctgaacaagagccactggggaagggaagtt

SEQ ID NO: 670557 - DNA, 1988 bp, Homo sapiens
ggcggctcggctgtaaggaggtggcagggacaaccacaaccacaacggccgggggagtcgcggtggctcagggcggttgccctggcactcgaggaggcgaggctacacgttcgaggccaaccgtggtcaacatagactaaaaaaaaaaaaaaaaaaaaaaaaaaaaaatatgggcggcgccgcgccccgggcccccgaaaaagctttctaagacaccacatccggttggggcgcgcgcgcgggcgcccaagtagtgtaggggaacacattgggccacaaacggggttccctaagagagaacccgggggccaaggaaaataggtgggctggggattctctctacccaaataataaaaaaggcgcccgggtgggcacgccggaggcggttctggaaaaaatctccacgaggaggaggcttcgaggagggctcactaccggggagctcctattcaacagagggaggctccaaggcggagccaccggaatattaaaattaaccgccccggccccgtgggatgcaagagaccagagaggacaacaagaaacaaccggaaagcaaccagagacgatgaacagccaaagaaaaaaaagacgagaacgaaggggcgcacgcaccagaggacagaaccaccgacacacaagcacaacgggacacaacagaagccgaagagagcaacaataatagaggcagaagacagaacgagagacgaccacacctaacacagagagacagtagcaacgacaacaaacagacgaaccggcacaaaaacacgcgcacacaaccgctgacgcgcagacagacacgagaaagagagacgacgaagaacgaagaaagcagacaaaaacggaaacagcagcaagcgaaccagctgacaaggaaaaacaagaaagagcacacggggtcaccacgacagcgggcacacgccacgacatgtagcatacgcgacatactacgcagatgaatagcgacgacagagaaaagcaacacacacacagcgagcatacaaggaaaacagaacagaaaccaaatacagcagacgaacagacaaagcacaccagcgcagggcaacacaagacaaggagaggagaagggaagaggcagagagaggagggaggaaagggagaggagagcagagagagcgcggaggagagcgaggagggagggacaggtaagtagggtaagagaggaaggaagaggagggagagcaaggcgggaggagaagagagagaaggaggggcgagaggaaagagagaggggagagagagagggcgggagccagaagaggacaacacgggcagagaacgagaggaggagaagcgaacagacgggcagagagggagggagagagggaggcgcgagagagagacgacgagagggggggaggaggcaggagacacagagacgagcgagggaagagagagaggggaggcaagacagagaagaacagagggcgaggaagcgaagagagagaaggaaggagaagagacaggcgtaagagggagagagaggagaagcgcaggagagggggagaggaagagcagaggagtggagaagaggcggaagaagggacgagaaggggaagagaggagagaagagccagcagacggaagggagggagacagggagacaggacaagacagggcagagagaacgaaggcgagaggagagcgagaggagcaggagacgagagagaagcaagggaggaggaaggaggaacaggaggagagcggaaggaagagcggggaggtgcggcacagaggagaggaagagccaaaggagaggcgggagcgagcaggagaggacggcgcggggggcgcggacgagaggagcacggagggggggcagaggaggaggggggccgagaggggggcgggaggcagcaaggaggcgacgcggcggaggcagaggtgaccgtgaggaggagcgggcagagaggggcaggggagaagggaggcagggagagagaggagggaggggagaggcgagg

SEQ ID NO: 670558 - DNA, 121 bp, Homo sapiens
ctagaggatcccgctgcgctatactacctagtgttccctgttcctgccatatcactggaggtgtctgtgagggtgttgaaaaggagattaacatttgagttagtggactgggagaggcaga

SEQ ID NO: 670559 - DNA, 1784 bp, Homo sapiens
  misc_feature (506)..(506): n is a, c, g, or t
  misc_feature (531)..(531): n is a, c, g, or t
  misc_feature (533)..(533): n is a, c, g, or t
  misc_feature (605)..(605): n is a, c, g, or t
  misc_feature (1127)..(1127): n is a, c, g, or t
  misc_feature (1645)..(1645): n is a, c, g, or t
aatttatggtcgtgcatggtgggtgcatcgagcatcataggaggcgactattatatgagcaggaaaccagctataatagtaaagataatcaagattttcagaatggaaatatctgcaagcaagtgacatgactgctaagtcgcgtagtgtcacgacctccatgagcatcgtatgatgtcgacatccttccttgtgggctcgctatgatccacgaaagacatcacatgggcagtattaccggagcggtgggcatgagattgggatcacgtatgcgataggctcatggatgtaagagtagtacgcatataactttacgcatttaagcgtacgcatacccattactcagtctcatggtatcgtctagggggcttatatcgatcttctctctagaaagcatcacacaaatacaacaatgacgttacatttcgccagccataagcccttgttgcaccaggcgcttcaataaatataagcttatgagtctccacaggctagaagaccaatantcctcagtgctcatcgatacaaggntntatcgcgtcgatcgagtaccttgataaccgccgagcgaacgatcgttaatacacgccatagctaaaggagcngtctattacgagtggaacagcgtagatattggagggccctcgtgctacgctcgatgaagatttcgtaggtagcaattgcgtacgcagatcatatgggacgcccgacggggagatttagccctcaatcatttcgcaaaacccccaaggacaaattccttcagttggaattttctctcacgttccacgaattacccatttgcgcacaaccaaggaggcgaagcccctttcgggtaaaattaaccaatttgttccaaaggttttaccccgtgtatttcaacccaagaccgtcctcccattacgaattggtttccggggaaagcttaaccctttataggtcaacgtcccccccagttatgcgtttatagttgtacaaggctacaactgtgcctttccccaggaaatgtgtagcagcctagcgcaagaagtctctttcggctggggacggacccaataaaggggcctctcttctgacacaacagtctgtgcctgacatttatagaaccgtgttccgccgcacaaaanaaatgggtgcggcccccaaacaaagtcgcccccaatgtcgcacaaggctttgtaccacaagcgcccaacgattaaacggctagtgggacactttaaaataccctctttggggaagagcgccgtaacaaaagagtgttacatccccttttcacgttgtcccccccttctttgcgcttaaacgggcactagtctaacacgttcccgcaggggtcgcacaagcccccatggatcgcccctgtgcgacaatctgcggacaggtggacactaggtgagaaccaaaggatgtagtcaacaacagagtgaccacatagtgggccgccgttgttaacacagtggtgcttctggagagcggcgacatccacccatgtagcgaggagccaccccatcaactcactgtggtgcggttagaacaccattaacgcagaaggactcagcgtcagatagcataccactgtactacataggacggacagctgcgtaatcacgaacaagctacgtataactgagctgacagtccnagcacagtgcataaggcgactagataccaaccatacgaactatgatgctcccgtgcgtaggcagaagcatcgagtgacatgctccgcatctcactgtctcatgttctcctcacctcatctctcttattggtgggggggc

SEQ ID NO: 670560 - DNA, 147 bp, Homo sapiens
tcacgacctgcaacagtaactaccacctacctctcaccaaagcccataaaataaaaattaaacaaaccctgcaaaccagtaacgctgcaaaccagtaacgctgcaaaccagtaccgctgcaaaccagtaaccgctgcaaaccagtaa

SEQ ID NO: 670561 - DNA, 207 bp, Homo sapiens
gctatagatgtggaacactgagtctataacatagggatagatttatctgggccagcacaaatgacagggagttcgctatatccatcctccccctctggccctcaccgttctgcaggcctgggcttccatgttctcactccctgatgggctgaactctgtggactgtagccggctcagggtggtcctgccatcggacccgaaaggcga

SEQ ID NO: 670562 - DNA, 221 bp, Homo sapiens
atatttggagcaatgaggctctgctgagtgtgagcgattacattcgaacacaaatcatagaagaaaattaacacaaatttttccaggaagaaaatacagagaaattaaagttgaagtactataattaaatgatccagctggatcaacatgagggatcctattggtctatttgtaagcactacattgcaatatatgatactccctgtattacaggcagaaag

SEQ ID NO: 670563 - DNA, 1024 bp, Homo sapiens
tgaaaaattcatggaggccatgggttttggtttgaaaccagcttgggggggttcgattccttcctttttggtctagaatttaatgtatacgggtttctcccgaagtgtgtggttaggggtggggggcactccatatagttcacctccaggttatatggagggtcctctctactatataggaactttctcgctctcgaaagccgaaggcgttctcaaatcagtgaaaatttattataattattataccgtgcgtgttctagcaagaacatgtgaatgtgacccctaccaacagtgtactagcgacgtgtttcacacgtgtgtggcgtgtatgtgcatctcggaggaatagtctccagagaataaacgttcgagggcacattccccgggaaatagtgcccgaagaaaccagggtgctgtgcgtgggaagagacacagagtctttagacactttttacgcgcccccgcattgacactactgtttggacactgaagtgtgccacaacagtctggcaatttctggcggcaccgcaaacgcagtcacagtggaggggactcaccataaagcgaggcagtgcatccaccccgtcgttgccaaaccacaaatcaagcggcgggaacaaaacactacccgcgacgaaacacttagcgagcagcgccacctccgcactgaagatcgagcaatagcgagagcgacaacaacattatccaccgacagactcaccacctacaacttgctggaaaaaatgcaggcgaccaccaccaataacggtggaggcgaacacaatcgatgagcagagcactcctaaaaccaaacaacgacggtaccaagcgacgcggacagccacacgcgaggcacacacaaacgacgacaaagtggaatccactgcaagcgtaggcacacgagagagcatacatcgaaacacccacaaaacacaagcacccaaaggcccaccgaccagacagacaagaagcacgccaccagcccccagaaccaacgcgagagcgaacacaaacaacatgaaca

SEQ ID NO: 670564 - DNA, 442 bp, Homo sapiens
ttatagccaacactaaactagagtactgcatactatagcagctggtgacagacatcgtgttagtggcacaggatggaatctctagagagtgtcccacttatatgattgctctggtgaaccaggggaaaatccgacccatgtgcaaaaggtttctattttcccacttaattagcatcctgctacagggccacacctgccatcttggtgggtgagtttagataccatacacttctccaggaggagtttgacaacatggtcacacagttgcaaagtgcacaaagctcaaggcacagagtagaagacagttgtgaactgatgggggaaagttctagcaaaagcagagttaccattttcctttaacaagactttctaatgctaaacaaagaccaactcttttaaaaggggtcgtatcggtgtcggggactcacatcacgggtaccga

SEQ ID NO: 670565 - DNA, 601 bp, Homo sapiens
caaagaatactacaagttcaaacatactgctagattactagaatcccattcagtcattagtaattagtccagttcattatcatgtcgtatgaatatgtctcccagggagagaccactcaagtttgcaggcttcctttcagtcttgtcagattccagaagcaggagcagtctccgcaaacatacaacttttaccttttgagcatctcttataactgagttcaagacagtgtcatctcatgctctgagcttctttaaatgtgttaatgtaatgttggatttccctcaatgaataacccatttattcctgtctttaccctcagctgctattcctcctctccagtagttcccaaacttttcctcctttggaaggcacattaagaattgccactgtgctggtttagattgcagacaacaactctagtctagcaagtacctcctcctcagtccaatcccctttagatagggtacttacatgggtgcagaaccagtgagctgtttctcatggccggaaacgtagtagttgcgttcactcttaggcccaattttgggaaatcgagtgacggtacacaccaacccattatggcccttggaatttggccca

SEQ ID NO: 670566 - DNA, 352 bp, Homo sapiens
agagttataagctcaagtatctaggaatagcagtgttgatggaagttttcttattgctcttgataacatgtgtacatgtgtacatttatttagcttatctacagatttatttacttatttatttttactgtttgaaccaagacagaagttgtaagttgtgaattagaaggcaccctggcctgggagctgggtgatgggggttcaaggctcagtgggttgaatatgagtccaacagtagtgttctggggtggaaagcagaggcagggggccagtccaaggagccacctccatgacgttgtccttgggagaagataactggagggagaaaaccaaaaagaaggcagatctgaaa

SEQ ID NO: 670567 - DNA, 549 bp, Homo sapiens
agcagacaacagcgtgtactggtaccaaaacagacatatagaccaagtggcacagaacagaggctcagaaataacaccgccatctacaatcatctgatcttgacaaatctgacaaaaacaagcaatggggaaatgattccctatttaataaatggtgcttggaaaactggctagccatatgcagaaaagagaatctggaccccttccttacaccttatacaaaaattaactcaagatgcactaaagatgtaaatgtaagacctaaaaccataaaaaccctagaagaaaacaggaaatgccattctagacattgcatttgggaaataatttataattaagtcctcaaaagcaattgcgacacaacaaaaattggaaagtgggacctaatttaaataagagcctctgcacagcaaaagaaatatcaacagaataaacagatgacctatggaatgggagaaactattcacatactacacatccaacaaaggtctaatacctagaatctataaggaacataaacatttgagcaagtgaaatacaaataacccc

SEQ ID NO: 670568 - DNA, 130 bp, Homo sapiens
aggtggtgcaggcatgccccctctaggacgcgtccattcatcgcctgcgtccattcaacgcctgcgagcgttcaacgcctccggtcattcaacgcctacgggccattcaacgcctgcggtccattcaacg

SEQ ID NO: 670569 - DNA, 103 bp, Homo sapiens
catgggtccggtcgggtggagggggggtgtctaagtttccccttttagggtttcaacaaatttcataggcactttcctttcaataaagtggtggcatacccag

SEQ ID NO: 670570 - DNA, 707 bp, Homo sapiens
ccgcggactgcaggaatactgtacgaggcctgtatcccctttggattggccaatttctccaatttgcaacaactgaatttacccagagtctgtacccccattatatgtaggaagtaactaacttgtttttgattttacaggttcataggcagacatgacttgccttgtctgagatgagactttggactgtggactttggagtaaatgctgaaacgagttaacactttgggggactgttgtgaaggcatgactggattggaaatgtgaggacatgagatttgcaaggggccagagtggaatgatctggtttggctgtgtccccacccaaatgtgatgttgaattcccacgtgttatcgtaggaacctggagtgacgtaatagaatcatggggttagaacttttccatgctgaaattatgatagtgagccagcttaacaagatctgatggatttaaaatatggaggttgccttgacaagctctattctcttgcttgctgtcatttgagacatgccttatgcctattaccatgagtgaaatggcatgtggcactgttagcctaataaacgttatattttgtaaaaaaactattttttaaccaatggccgaatcgggtccctttaaacaacgcatgggccgccttgcgaaattgtcctcagttggacatgatctctttgcgaacgtgcaccagtagtgccccgttttcgct

SEQ ID NO: 670571 - DNA, 565 bp, Homo sapiens
agatgctatattgactgtcacttgcccagatctgcttctcacgcaaggaagagattctttgcttaagacgagctatacagggtcgcccaatggagctggataggaggtaatacagcgcacaggtcatgggatgtagcgtgcagtcttagtcaacgagccatgttcgacgagcgtgctgtcattcacaggaaatcgattcaaggttcccgtgtgcgtcgatcatacacccagtgatgttccgtcagtatccatcatctctaaatggtctgaccaagctttctggacttcagtttgtgtcctgagcaagctgggatggagctagatccccaaggggaaatacattccgtgctgctcgtccatcaacgagatacgaactggaagcagagaagtctgacgttatggacaactggaagacccatatgttacagactgcgtggaagatggacgatcgcaagattgggagagggttcatctgatacgtggccaggatggtatatgacgagtagagtcctggtgaatgtggcagcattatcaggaattgtggaatatggtccagcaagtccga

SEQ ID NO: 670572 - DNA, 545 bp, Homo sapiens
  misc_feature (319)..(319): n is a, c, g, or t
atgcaaagtttttcgaagattacggcctgttcatgcgggagggcattgtgaccgccaccgagcaggaggtcaaggaggacatagcaaagctgctgcgctacgagtcctcggcgctgccctccgggcagtataagccagcctctcagaatacgccagctcgcatgcgggtccggcacccgcaacatctactatcctgtgacgcccccaagccgtcacctggcagagcactcaccctactatgaggccatgaagaagaaagacacagaggttctcttgctgcttgtgagcagttttgatgagctcaccctgctgcaccctntccggtgaagttttggaccaaggaaaagaaaagctgagtcctctgtgcgaggacggggaccataagtcggtgggattcacgtacaagggcggagacagtttgaggacaggtccccagccgcggagtgcctatcagagaaggagacggaggagctcatggcctggatgagaaatgtgctggggtcgcgtgtcaccaacgtgaaggtgaccctccgactggacaccca

SEQ ID NO: 670573 - DNA, 129 bp, Homo sapiens
tcttggcagctgctgcatgcgcaggatggcgggcagccccatctccagcacggtgaccatggcctggatgagaaatgtgctggggtcgcgtgtcaccaacgtgaaggtgaccctccgactggacaccca

SEQ ID NO: 670574 - DNA, 302 bp, Homo sapiens
tcgctgggggcgaactgtggtgctggccttgtgatctgcacctggacctggatgggttgctcagtaggctggtgaactggtgagttgtgggaagagctgagcctgagacctgttgcggagactgctgtacctgcacctggacctgaacctgctgcggctgctgaacctggatctgctgttcttgctgggtttgtggctgaacactggtggtgactggacaggcaagttcaagcaaagacccagccacttcagtgctgtctgtgtatatgcagttctgcccgcagcgaggggtaccgagctcg

SEQ ID NO: 670575 - DNA, 347 bp, Homo sapiens
taccagtctgttctaccatgttggtcaggctggtctcgaactctgacatcaggtgatccacccaccttggctcccaaagtgctgggattacaaccatgcaccaccacaccggctaattttgtgtatttttagtagagacggggttttgccatgttggtcaggctggtctcgaactcgctgacctcaggtgatctgcctgcctcggcctcccaaagtgctgggattacaggcgtgagtcaccacacactgcagattggttacatttttttttttttttttttttgggccctaacttggttttcctgggtggtgggccaacagattgtgaccggcttgttaccggttag

SEQ ID NO: 670576 - DNA, 443 bp, Homo sapiens
gtcactgcaaactcactgtgtgagcctcataccccagacccttagcccatcagtgggcaggggaaagggagacccttcccaagaaactctagttcctttttgtttctctacccaattccctttggattttcatatttaaatgtttggtttctgtattttgtttttttttgctgcgagtatattgatttctgatgggaagggaatggccacataaaagcaagcctctttctccctctataggagaatgttgccttgtggcctaggtgagcagccattcctccttccatgttcagagggcaggaaaacagtgtgggggtggtggacgcgcaaagggattactgcctgcccgatcttcaaacttttttttatatatataaatatatataaaaatgccacggtcctgctctggtcaataaaggatcctttgaagataaaaaaaaaaa

SEQ ID NO: 670577 - DNA, 159 bp, Homo sapiens
ttggggggaaaacccccccccccaaaaaagggaaccccccgggcccttattttaaaggcccccggggttttttatttggggcccggaaccccaattggaattaaaccccggcggggaatgggttttttaaattttttaaaaaaaacatttggcccggga

SEQ ID NO: 670578 - DNA, 342 bp, Homo sapiens
  misc_feature (2)..(2): n is a, c, g, or t
cngcgcatttcatatacatgcagtcatattacattgggcttttatgttcattttccatagttgtttctatatagcatgtatcagtgcttcattctttttaatgggtagataatattccatggtatgaatatatcactttggtttcttccattcaactgatggatgttggggttgcttccacttgggggctattatgaatgctgctataaatagtcatgaacaagttttggtgtagacatgtattttcaattctcttgggtgtatacctagtagtaaaatggctgggtcacatgtaaactctatgtttaactttttggggaactgtgaaactattcttaaaat

SEQ ID NO: 670579 - DNA, 724 bp, Homo sapiens
gtgaaggaagcaaggactcgggagtggacaagataccaggtctccaggaatgaaggtatcatctaagttgtgttatcaactggaggcgatctaccccccacacaggagacagttggcaatgtctggaggatagggactcaggacctaccgaatggcagaaataaaagagctataacataaacagggctgaaacgtgccctgtgctcaccaccctgtgggtgaagagaaggagagaagagatgcagccactcagggagcccagacctgggagctccccgagcccaggctgtgactccctctttgaggtcctgtggtttctggtgtttgctgagctcctgaacaccaccacattccctggtgccagctggggaagctggttgccatgcacatggtcaagccacagcctcacagagagccagtgtctgttccagcacctggagctgcccgccccactgcagcagcctgcatgcctgactgtgtgcagtggccggaccccatggttggtcgttcacacaccccctgccactccccacctggttcacccgtggcaggtgtgggatccaggctggtagtgtgaaccaagcacagcctgccaggccaggtgagcagaacgaggtgagcaggcctgagcaaaagtcaggcaaaggcaccactggccacagagttttatggccagaaaagcaacaccccaaagatcccatgaaaataaaaggagactgagcca

SEQ ID NO: 670580 - DNA, 872 bp, Homo sapiens
gggatgggtggaacggcgtcgcgcgagcttgtggtgccgcgctgctcctaggtggccgtggcgctgagtgcctggcggaggcggtgtcgagcccacgacgtggcgtttgacgtgctgtgccgtgtggcgtcgtgcattccttctcccataacgtgggcccggtggggacaaatatactgtgtattgttcacttactgcctctcaaaggagtggaccacaatgagcaattggcagatgagtctggtgtgaccagccgaagaccaccagcacttcacctgcaccatcttggatggccccatggtgaagtcctatctgtacttcacacagttcaaggcagagtgtgctgggtgcgcctgcgattgaggtacgccatggcctactctaaagccgcatttgacagggaaatgtgatgtccctctgaaaactgaggacatttgaagtgaccaaaaacagcagtggctcacaggccctggggcattcaaagctgagctgtccaagctggtgattgtggccaaggcatcgggcacttgagctgtgaccagcagcctgtttgcgggtggaccttctcatctccggtgaagctcgaatgggcctgtggccctgaaggtgtccagcaccatcacctggttttctagcgagcggactcttacgttttctaccctgggcttgctgttgccttggtcccggatgtgtgtcttgcagtggtggttaaagcccttggggcatgagaccagagggtcccgggccctcctgttcccaaaagttctcagtccacttctgctggagtcttctggctcaggatcgcaatctgggccccaacgaggttgcgaccatgggcgtatgccgggaaagtcttgtccccgactcacgaa

SEQ ID NO: 670581 - DNA, 376 bp, Homo sapiens
  misc_feature (371)..(371): n is a, c, g, or t
atgcagtgggcacacagttggcactacataaatgctagaatataagaggatgctgttgatgatgtacactccaatgctatgatcctatagcttactcagtcctttcctatattgtgttaattttattattgtgatataatacttataccctaaaattcacccttttaaagtatacaattcagtggtttttagtatactcacaaagttctgcaaccatcactactccataattccagaacattttcatcagccccaaaagaaactctatccctattagcagtcactccccattctcccctccccatagctcctggcacccaccaatctgctttccaactctatggatttgcctgttctggacatttcatatnaatgg

SEQ ID NO: 670582 - DNA, 644 bp, Homo sapiens
gcctaaatactattgtttgcactcttcattctcttctctcgaagtgctaccaccaccactaactaatctactcacaagaacattagcatagggacaatccttattgcacaaagttagtttcgctaaatgttactgatgaccaggttaactagatctagaagctctggattactagttattctcctttctgtaaggtaaatcgtactgtaaaaccagcaatgcacgtttgatctttctgtacctataatccctgtatttgtcgcatttgctctgcgtagactttctcattccatgggtgtccttcaaggaaggccatagaacacatcataagacgcaacacaggggtacttcgaccaatccaggggagtcacatgtttactggtaggcaattcaaactttctcaagttggtctaacagtatacagaaatcaccataaatcccaaatacaaatctcactggtacttcacagaaagtttgatcatagcccacacctttgtggcttcacaaatacacagagatcactgggagcagggaactctaggtccctctctgccggtttggcatatggaacatcctgtcaggcaacatcagcaatgggtaattgggtcatagggaaggggaccttgagtgtgatccttggcacc

SEQ ID NO: 670583 - DNA, 159 bp, Homo sapiens
agagtttcccgctgttgtaccgtgtgccattattcaccacagagtctcatgaattatgaaagtgtcttcacttaagctcccaggccctaatgcactatcgcgttcggcgggatgaaaagcggggttgaacgcgcagtcattattcaacgtgcggctgga

SEQ ID NO: 670584 - DNA, 889 bp, Homo sapiens
aaagccccagtggatgatgcacaggaaatgctgacactccggattgccaccatgcctaaagatacgttgacagtgaacgtggaggcagtcaggccgcgttgtcctcgctttcgaaaagtcaagccttcacggactcataataatatgtatgcctgggggcaggaggtctcggggcgaacctattcttacatgcactgatgtcagtcttacaggtgttcatgggatcactggaggatagctatgcagtgtccagtgctgcttgaatgtgctaataaagtcaaggacacttcagaagatgcagtaagattccacaatttcacttatttcttccttgtgtaccatttcatgctcgtggaaaccaacagatgatgctactatatgctgtgtataacgatggtgggagacaagatatggaaaatgtacacatttgtagattaagctggaattatgatgagagcaataggaactaatttatattcgctaaccacagggtgatggctgcttctagaaatttgaagtcttgatgagcttaatgaggtttataaagatagagtgtgccgcgtccgtactgatgtggctcattgtgtattgccagacaagagccaaagaggcactggaatcgtcattggtacctttgaaaagttgttgccttattttagcagagagtgacaaaaggagttatgtaacgtgggctttggtattcacgagaaattcttgcattcagcggtatgtacaactgccggggctaccaaggagaggggatatatgccgatgggggaaagtgcgcggaaggaacacaacggatgtggcgatgggaaagaaaaagaggggaccgcgaaagagcaaacattgaacagataagagaaagagtgggtacagcgaaaaaagg

SEQ ID NO: 670585 - DNA, 1233 bp, Homo sapiens
gctgagccatgtgagggatccccggcgggctatcacttgctgcactcgacggtggtctgctgacatcgcatccggcgtttcctcgtcccgtagggcgagcggatgagcgcacggtgggcctcagtgacacgttgtcagccagtgtggtatgtctgcctcgaatcgcagtgcgagcgtagatcatttggccgtctctcaggaacagattcccactggttggaccggttggatcatcttctcatgcttccaaaagaggtcgtctctctatgagactaggtgctgtacccagaatgcgctggagttccaacctgggggtacatcttactgagaaggccactatcgagagctggccgggtagcaaatcgactaagacctcgcgtctatactaggtggtaagagaggtgtgcgaaccaaacaggctctcatgaatccctagcattccaagttagagtagaagtacttgcaaggctggttgggcctgggcatatgatgccaagggacaagctgggaagcgctacaagagcaaacaacgtagaagatcgggagcaacgtctggatgatcggatgatggagtggaaaacagcagagaataaaatctatagtagtggcagcgaaacggccaatctacgtcgcgtgggtgatcacccttgtccagacgatagacacaaagactaggtgcctgattgacgaagtgggggtaccccactttggaacaagccaacatcgacgtgacttttgctgaaggtaagctctgtagagtcattacttggacacaaccccaggtcgtaaaatcgtcatccacaggggacgtttcactagggtaggcaacaaagtgggggcatgacagagcgtatcatggatccctcccaatcctgtgcatcgatacttcagggtagcccatgccgcattgcgagctgtatcgtggaacgcagcttacgtgccaggaaatagtcactagcggatagaaaaatgagcgaaagaatgatcacccagcgtacagatgatgattggagagtagatgagcacataacctggggcaacgctgcacaactgggataggagcacctgagaaacggcaactcgggggcaccgattaagcgagaggggtcccggtccggcaccacactggtatatcaagattatctgatggaggcaccacacacacatctcacattcacacatgacatcatgtataatcgagccactgtagaacacacgagaaggatagaacaa

SEQ ID NO: 670586 - DNA, 392 bp, Homo sapiens
agcaatgacatatgaaggagaaagcttgaatagactgtgttcatgaagagtcatctacaacttctattgcttcagtgccttaagacgactttttgaacaacaaacataaaatctgatgatgatcattgaaaaaattagcatattgtgactaacaaagatcgctggtgtaccgggcacggtggctcatgcctgtgatcccaggacttcgggaggccgaggcggacggagtcatgagtgtcaggagatcgagaccagcctggccacaatggtgaaacgacgatctctaataaaaattacaaaatactaaacataagaaaatagcctcatgtataacacaaaacaccaaaatataatgtaacccatgtcttacggaatcacgtggtcggggatcc

SEQ ID NO: 670587 - DNA, 172 bp, Homo sapiens
cccccccgctcatgtctgacgtctggcctattaaatttattattcatttattaattattatatcctccaattacaattttttctactgtacagcatggtaacccaattacacatacatatacacattcttttttctcacattatcattttccatcgtaagacattaccgctg

SEQ ID NO: 670588 - DNA, 1307 bp, Homo sapiens
  misc_feature (429)..(429): n is a, c, g, or t
  misc_feature (1032)..(1032): n is a, c, g, or t
agcgggccggctcagtcatatgaccggcagccggcggctccggcgccgagcagagttactcagtcgcagcggaccccgcgctcccgcaaggctgggcggccggccgccgcgacgggacccggagaaccagcagagaccagcgcaacacaacacgagaagaagagaagaagaggacagcggagaagtaatacagggcgacaatgcagcgacgagaagagagaaagcagaaagacggcgaaacacacgcaagaagcatacagaaaagaacgcgagagaccaggaaagaaaaaacgacgaccacgagaggagcagcagagggcgccagcgcatgatagcaacgagtcgcgaaacatgcagtgagaggccgtcctcgggcgtgattactgacggagatctataaagcagaaaaaaacaaacaggcgagcgagncacgcacacacgcatcgcgcgaagcccgaagcagggaaccgagagagaggaaacacggccggaagaagaatgaacagctaaaaaggaagagaccgcagaagctcagtgcacgaaaacagtactagcacagtcacgacgacagaaagatcagaggtgagaagatgcaaaggcagtcagagacgaacccacaccgcgggaccggatcagaacagacaggcagggcaaagcagcgtgagacaaaaggagggaaacaggagacggaggagagagcaagggagggagacacaggacagaggcagctacacacaaacgctcaacagacgcagacaaggagagagacgaaaaaggcaagaaaaagacgagatgagaacagagcagccaaagaaaagagagcacgagaatcgcgaacagaaagaacagcagaaaaagagaagagagaagaacaacagagtaacaagcaacacgaaagaaacagggagacacagcgaacgaggactacgaacaccgacgagagacagcacagagactagtaaacggaccaagggacagacgtacgagacagagagcagacgacagacagaaacgtgcagcagagaaaaagcnaacagacagcaagacgaagagcaacagatcgagacgccaaccagcggacgaaaagagcagacacgaactgagagaacgcagcagcgctacatacgaacagcacactcgcaccgacagacacgagatacacgacgaccactaccacacgagagcacaagagcgcagctcgcgaagcatagccgcgacaccagagcgcaggctgccgagcacgcaaagcagtacagaggaccacggaacgaagagacagcgcgagagaaccacaaccagccaggcac

SEQ ID NO: 670589 - DNA, 979 bp, Homo sapiens
  misc_feature (22)..(22): n is a, c, g, or t
  misc_feature (50)..(50): n is a, c, g, or t
  misc_feature (478)..(478): n is a, c, g, or t
  misc_feature (979)..(979): n is a, c, g, or t
ccaccttcttgagaaggtgttngggggggtgctgagagtctaactcctgnagaatgttaagcccctctccagcctcactccactgattgctgcagctgaggaggcaacaaagaacaataactacaaccacactaaccccagcctccttgtgccaagccttctgtgagacaactgcccactccagaaaggacacctgctgaagccctatctacctgtgctagcttattctgctttgctgcagcagtcctcctgaggattttgattttttttataacaagcaaccgcaaaacaaacacacctcgccatcccaagatctaacacatgtcgaatctcataacccccccgcattcaacaattcccttctcgacccacagcaccgctgtgataacgtaccatcaggagattatgtcctgccctctcagaaatcgagactggtcacagatatattgatacgtcctagtagtcagccccagtaatncctcaagatattccccgctcacactctctcctccgtatagtaacacatcacgaagacgttatctcacaagcatcatagctagcgtctcgcgagttttttcagctagccagacaccacaccacctcaccatataacgtatatcacactaacctcaaacccccgcttcgcgtacatttgcaggctcctaccccaccttcctatagactcgggctctacagcgctagtgtctaccgatcgctagcgtcacgagcattcaatattcaccatcattccgatttctattcaccatgtcactaataatacgctcaccgtttcaacatcgccgccatctaaacaacattgtccgccactttcgccacatatttatcggacagtcgcatataacgcgccatcgctacgagatgtgggattgcagtcgagcgggttccctgtcgataatgcgtctgcattatatagacccacctaatatgccgcccgcccccccaccagcaccaccgagcn

SEQ ID NO: 670590 - DNA, 184 bp, Homo sapiens
tttatggctgcatagtattccgtggtgtatatgtaccacattttcttaatccattctatcattgttggacatttgggttggttccaagtctttgctattgtgaataatgccgcaataaacatacatgtgcatggaagtcaaaggaaatcccttttcttggtgacgacttaaatctgggttccct

SEQ ID NO: 670591 - DNA, 567 bp, Homo sapiens
ttaaatgtccctgtctgacagctttgaagagagcagtggttcttccagtacacagctggagatctgagaacgggcagactgcctcctcaagtgggtccctgacccctgacccccgagcagcctaactgggaggcaccctccagcaggggcacactgacacctcacacggcagggtactccaacagacctgcagctgagggtcctgtctgttagaaggaaaactaacaaacagaaaggacatccacaccaaaaacccatctgaacatcaccatcatcaaagaccaaaagtagataaaaccacaaagatggggaaaaaacagagcagaaaaactggaaactaaaaatcagagtgcctctcctcctccaaaggaatgcagctcctcaccagcaacggaacaaagctggatggagaatgactttgatgagcttgaggaagaggcttcaaacgatcaaattactctgagctaccgggaggacgtcaacccaaggcgcaagaagttgaaactttgaaaaaaatttagaaagatgttaacttgaataacccattcccccagagtgctttaaaga

SEQ ID NO: 670592 - DNA, 685 bp, Homo sapiens
  misc_feature (632)..(632): n is a, c, g, or t
tggtagagacggggtctcgctatgttgcccaggctcaaactcctagggtcaactgatcctcccactttgccctcccaaagtgctgggattacaggtgtgagccacaacacccagacaaaacaatcacttttttagacctctacccttcaacattacatagactttctgtttaggaccatataattttgggggaggaggggaggaggtatttggtgtagtcttagaaaagagcaaagcttgttgagatgcaagggcaggtgaccagatagtttcactcactgcttaaataaatggctcctaataaatatttatgcctcagcaaataaataagttatgtcaggaactttggaagtcaatcctaaaagcagaaattgaatgtaaaggtcttctgttcataacagttgacatcagcagcacataaactgtctctttctaaggaaactacgtgggcaaatattggtcttttattggaataaaagaccctcatacacctatgcttctgcactgacaatacatttttgatactgaatttcagcttctaaaagaacaatttaaagaataaaatctgatttaaaaaaaaaagcagactacctttcctttgcagtaatgtgcccaccaagtaaaattgcacntgaggttcacacatgatgcaggccatctgtctaggaacagtgaacatgctaag

SEQ ID NO: 670593 - DNA, 1292 bp, Homo sapiens
ctgcagagggatcctgtggctggaagcgaggaggctccacgatcggccgtatgcagcgtacctgcagaccgaggatctgggacatccgagggcacggccatgacccctccgagggctcttctggtgtgtggctgctgggttgcggtgaaccctagaggcgtgtaagcgatggtgacttgcggctgtgcctgcactgggtggctgccaccagagccagggccgtcgtggagactcttctacagcaggccacgtggggcactgtgtgtgagaacctgtgggcacgctgagctgagtgccagcgtcggtctgcctgggcgcctggcgcttcgcagaacgccagcccaggcgtctgggcaggagcgtgccttcgtggcaagggatctaggcctccatcagtgctcggtacgtagcagttccccatctggcagcgtgggagacgcgagtgggcgtcacatgtggcctgaccatgctaattcccgctgggggcatggtcgtagatacgcaggcgaagcgtggcagcgcaacgtagacgcagacggctggatagtgggtcgtgcgccagattgacgaccacggagcatcccacagctcctgggacctcttccagggtgggctctctggagggcccgttggccgggacttcttgggacccgccaggccggggcttgcgagcttgtcccgtcacgcggtgacatgtgcatggggccggcacggtacgccgcgtgggcttctgttggccacgctggtcagtccgtgcacctggcaatcgctggaggcccggggccctgtggcagggagcggggcatgcagtggtccccatgcagtgtggctgctggttgtcgttgccccatggtcaggggacccttcctacagcgtagtaactacttccccgaacggagttgacattaagcgctgaactacagcgcagctgcttcacaaagctggcatatgcctaatgggcccgggcactcaacgacaatagggcaagcctttacggatggatcactacaccaggaccctggcccagaagcccgggcacccgttcgcccatgtgccagggacaagaggacacccggcagtgaaacaaccgcagacacaaccggcgcaggcaacatgaggcgaggacaaagaggacaggcccgggtccaccgacagtaacgagcagaccccgacgacagagggccaccaagaccacaacgacaagcgaccatgcggaaagagcccacacgagggagtgaacgaaaggagaacgacggcagaaacgagcagactaaaagagaaaagcacaagca

SEQ ID NO: 670594 - DNA, 158 bp, Homo sapiens
ggcccatgtcatggttaaagcatttagatttttatcttaaatgattgtcaggtatcaggttcgtccgctaatgagggatcaacagtccatctaggaacgtgaagagaaacgttgcgtcgcctcacgactatatgaggaacggacagggcgcagtggct

SEQ ID NO: 670595 - DNA, 149 bp, Homo sapiens
tagacctaactatccggcaatcccaaccaaagtcatgtacatgccgttgtgctagtctggacaatcatctgtcactcatccaacacagttatgtacagaatgcgcagtccctgcaacagtgtagattacagcaggcgttctctacctgg

SEQ ID NO: 670596 - DNA, 491 bp, Homo sapiens
gtgctgctccataatttatcgccatgtgcaacagctgcgttttctagcattatgaaatgatgtgtagatttcaatctaataacagctcacatattcgaatccctccagggctgaggaaatttctgcacctatatggaacccacatgcaaagaacccatctagcatgtaataaataatcgctagccatactcaataagacacggaaaaattattgcttacataacagaaaaacatctacttgacccccttttatgactacatcaatctattaggagtgtatccatagtctacattcacaaaatgtcatcttgacttatttgccattgatttaaggcagaataaatagtccccctttccccagtcttaacaacaaaaaacaaaaaaccagcctggagatctacattgtgatgctttttaataacttgactcctttcttggccagctgaaactcgtcgcacaggccggaaaataaaccagctctccacaagagt

SEQ ID NO: 670597 - DNA, 119 bp, Homo sapiens
tcagcggcagtgagcttctgtgtagctctggccccctgccaagcattactgtgtgagctccaccccctgccagagcattactgtgtgagctccgcccccttgtccagagcattacgtgt

SEQ ID NO: 670598 - DNA, 200 bp, Homo sapiens
gaacctctgcgccatgagagccaagtggaggaaggaggcgaattgccaggcttgaaggcgcaaaagaaggaaagatgaggcaggaggtccaggtaaaccgttagcttttttgcaccttgggaggccacaggaggcaggaaacatgggattgccagacgttggggatgctggaacaagtttttggggactgcaagctactt

SEQ ID NO: 670599 - DNA, 288 bp, Homo sapiens
atcccctgactacatacttatagaacttagtgagcacactgtgttatacctgctcaaatctacagtagccaccaaaaccatggcttaatattttgagccctataagaaggagcagagctgcaaacactagcttgaaattagtaacactgaccaatacagctctgcaattctggaccatattaactaaaatactatgccttatcatatcgggaatttctaattctaatgttcagtgcaatgctagacatttatttgcacactaatactagcaaagctgttagatattct

SEQ ID NO: 670600 - DNA, 395 bp, Homo sapiens
acaactcttcctaaccagtaactaataaataatcatcatcacaatagcttcaataaaacaaccccattcaatataaaggtgcaatacttattgttaacctagacagccaccgaacttgtgtagctaggtccatatcccttttcattcttagctgatatcctgaacacaatggcaggcctggatgtataatcaatatgtgcataaaagcaagtagcccagcagttactatacatgatgtcttaagcaccacaataaatcctcatgaacacaagttgactatgagattgaatcttgtatctgtgctgtgcggctagccaagtacggctgaatatcccaaatatctttccaagaaggtaaggatggaggttcccaggaaaggatgaataccttcaaaa

SEQ ID NO: 670601 - DNA, 440 bp, Homo sapiens
aggtttgtcctcacttaaggcattttgttgtggggtttttgggtttgtttttgggggtatttgcctcattccacccctgagctttcaggtaaacaaacgtgattcaaaactttgttttaaggtgtttattgtagtggagtaatgggtttgcagtgataagtcatacttttcccccgaaagggagggcttgggaatccctgaaattagctaaagttaagttgttggaaaaatcccttgatttggaaatggaccctttgggttttgttgctttgtttcctgaaaataactgggggaggttcctggtttgtccattaacggctttgattccttggatcccccccattttttcactttaaaaaaaaacaaaaaattgttgcaaaggtttttgtattttgcagcggcccttttgtaaaaagcacttttcccaaataaaccaatta

SEQ ID NO: 670602 - DNA, 565 bp, Homo sapiens
  misc_feature (423)..(423): n is a, c, g, or t
  misc_feature (432)..(432): n is a, c, g, or t
  misc_feature (438)..(438): n is a, c, g, or t
  misc_feature (451)..(451): n is a, c, g, or t
  misc_feature (482)..(482): n is a, c, g, or t
  misc_feature (558)..(558): n is a, c, g, or t
gcggcctaggaaatccagctagtcctgtctctcagtaggaaggcataataggaattatgagggtaaatctaaaaacaacaaaaaagtgctgggattacaagtgtgagccaccgctcccagccctggccagttcttttcttgagacagtcttgctctgtcatctaccctggagtgtggtggcgcaatctgggttccctgcaactcccacctcctgggttcaagcaattctcccacctcagcctcccgagtagctgggactacaggtgtgtgcctccatgcccagctaatttttgtatttttagtggagacagggtttcgccatgttggccaggctggtctcaaactcttgacctcaagtgatggcatccattttgggcctcccaaagttgctggggatttacaggtgttgagccaccgtgcttnggccctggnaatttnttttttaaaaggntattattttgggcatcatcgaattttaaagntattggtctatgattaccagacaagaaggttttttgggaggagggttattccagaatttagatttttaatcgttgnattgaat

SEQ ID NO: 670603 - DNA, 433 bp, Homo sapiens
agaatgcttctcaggccattttcaggagccatccataggataaggtgagctgatcacctcccagggacaacactatccaaccagagtgctggggtgcaggagtggccgccaatttggatgaacctcgtgtccccctaacaaagtgaaagtggttcactggtggagaaaatgggccgatacagcggcaagtgcagcaaggaagagtttgttggcagaatggtaagagtggcttgccaccccaactgggagtgtgtgggtgtgtgcggacctacccaggacaccagagaggttcgtttcctctgatgaagagtcctggggtagaagtggtgtgtgtatgtgtgtgaatgtgggaatctaactaggctcacccgggacacgagagagggttgttttgtccgatgaggagtcctgaggcaagggaggtgtgtgaaag

SEQ ID NO: 670604 - DNA, 308 bp, Homo sapiens
  misc_feature (32)..(32): n is a, c, g, or t
  misc_feature (76)..(76): n is a, c, g, or t
  misc_feature (78)..(78): n is a, c, g, or t
  misc_feature (134)..(134): n is a, c, g, or t
  misc_feature (166)..(166): n is a, c, g, or t
  misc_feature (203)..(203): n is a, c, g, or t
  misc_feature (266)..(266): n is a, c, g, or t
ataatcagtcccttgctccttcctccaccctnaaggatccacatcacaaagtgtgctacatatacactgatatggntnggctgtgtccccaccctcgcctcttgaattgtactcccataattcccgcgtgttgngggagggagataatttgaatcatgggggcagnttcccccatactattggtgtggtagtgaataagtctnacaagatctgatggttttatcagggatttctgcttttgcatcttcctcaatttctcttgccgncaccatgtaaggtgccttttacctctgcatgattctgggcct

SEQ ID NO: 670605 - DNA, 172 bp, Homo sapiens
ttatgaaatcatatcatacgatatctttcactttgtgactgcgcttattccccttagcatttagcatgtttgcaaggtttactccaggttgtagcatgttcagtacttattatgttaataattatgataaaatacatctaacataaaatttgccacttcagttaatttcttt

SEQ ID NO: 670606 - DNA, 1112 bp, Homo sapiens
atgctatctgcggggccattcgtatgtattgcgtctcgcagtccagtatgcattccattctccgtattgcgtcaaaggccgatggcatcgtctcaacagaacttttgcactgcgcagagcaataacagatgtgcgcaattatttgtccataacatccatataattggaaaacctcagaacaaacactgaaaaataaatatactataatccataaccatggtctgcgggaactaagtctccccaataataagtattcttaaataacctcctgtgattatggaggacgaacccgagtccgggaatagccatagggttaatggtcgtgacgcatactgagtattcccataggggacattccctaggggcgcttttatcaggtggtgaaggcaacattcccaatcactactttttaaaaagataacgcggacactcggggcggtaacgaacgaacaagcgattgctataatataacaactcctcgcggcgtaagccactaaagtcgagtcagcttatccgccggcgacctgttcagtcagagaggtactcccaagcggagaactcggtctattaacatcctatctggacccgccgagtctttgtttgagaactttgaattccttgccttggacacggtgggcttccttgtaagacccccctaacgggaactttccaaatcctattcgtttttctccacccggatacgaggtggggccatgaaacttgggcaatttgttattttagcgcaaaaccttcaattcaacttaggaacaattcgggtacttaacaacgaaacaacggtaactaacagtttggtaggcatcaacttttcccaccttaattgttccctaactccaacataagcgaagccttggataattttcggccaattcaattagggacagggcttttcaattttcaacttgaacttttccccccttaattttcttcgagggcttaacaaccgccttaggaaacagaagacacttaacggcccaaagaattcccaattttccaacctcaatccattaattccatccgggagttcaaattcttaacctttttctttcccaacagacaagttatactcgggccttattccgggaaaatgtccc

SEQ ID NO: 670607 - DNA, 404 bp, Homo sapiens
tcgagaaatatgctggtaatctattagaatgtcatatcacatttaatgagtgatactctcctactgctttccagattctatgtgacttccgaaaatctgattataatgtgccttgcgtctacgtctctttaaattgatcttagtaggagtcctttgagcttcttgaattagtatgtacatttctctcctcagatttgggaaattttcaaccattatttcttcaaataggttctctgccactttaactctctcctgggacttccataatgcatatgttatatcactttatggtatcccatgtgtcccttaggctctcttcatttttcttcattctttattattctgctcctctgcctcagtaatttcaaaagtttgccttcaagtttactgatcctttcttctgc

SEQ ID NO: 670608 - DNA, 370 bp, Homo sapiens
  misc_feature (370)..(370): n is a, c, g, or t
tacaagccacgatatattttaaaaagatcgtgtttacaataagtaaattatgtagtgaagaaacatcaccatgaagttgagtaaaaaggcacatttgaaaagttgaagagtacaaagagtcccattgtttgttctactagcacaggaggaaagggaaacagatatattacaattaccgttctcagggggaggtttctgtcagtggaagtgattaacactggcttcttttctccccgctctggggcaagtcttttagttcttcggcttcggagagacaagtcaatcttctgccatgtagaggcgatacatcagagctacagccagggctgagatggctgggatcacccagttggtccaccaactggaattn

SEQ ID NO: 670609 - DNA, 343 bp, Homo sapiens
gtacggcacgctgggctcagccatgatgctgggatcagccatgatgctgggatggccaggcctctctctctccatgtggctgctccacatggtctatccagaagtgtagctgacttcttagatggtggctcagggctctccaatgtgcaaaagcaaaatctcccaggtcttcctaaagcttatacctggaactggcccagtatgacttctgcaccttctattcattaaagcagtcacagggccaggccagaatcgaggggaggagaaaaactccacctcttgactgggagtgtgacaacaaatttgcctcccaccttaatccaccagagagctgagttcagag

SEQ ID NO: 670610 - DNA, 265 bp, Homo sapiens
accatatgaaaaaccatttcctgggctcaagggatcctcttgcctcagcctcctgagtagctgggattacaggcacccaccaccacacccagctaatttttatattttgggggtttctccatatgggaccaacctggtctcaaactcctgtcctcaagtgatctgcccaccttagcctcccaaaatgctgggattacagatgtgagccactgcacccagcctgtttctggcatcttatatttacttctatttactttcttttctg

SEQ ID NO: 670611 - DNA, 524 bp, Homo sapiens
ggcgtgaagactcagagatgagaaaactggaccatgtttgcctgtgagggcagggtgtaagctagcgcccccaggttgcaaggtgcctcaggcagagcgtggtgagcggtggattctagagggagagagtgtatcatgtacatctccatttagtaactaacagggtgactgctggtggatgatggggcgtcgcgtgacagaatttataacagaggcaagatgcaaccagatttcagggtgtaaagaggccactggggctacatgtgtacttggaagagggaacctggctggcaaaggtccttcaggagggaggactacttgtcacttatggccactgggaatactagagtaggagacgtcagtagccgagggccaggaccagcaatgcaagcatggagcattccaagaggaaccctacaggctcctggcaagccaggatgaagccagcgccaagattgcagggttaggcaaaaggccatgcggggagccccatcccaaggaacatgaacttagtcttgtaatag

SEQ ID NO: 670612 - DNA, 1106 bp, Homo sapiens
  misc_feature (647)..(647): n is a, c, g, or t
  misc_feature (706)..(706): n is a, c, g, or t
  misc_feature (729)..(729): n is a, c, g, or t
cctgtatggcatgccatggctgcccagcctggaatggcatggtcttgaagcccctacttccacaatggacttggcagctggctgctgtggccactgtgtgttcaaccatgcctggccctggaatgatcctgcatgactgtaatgtgccctgtgcaatgccaatggctgctgcctgcaattctgcttcctgctgcccctgctgtctgtgtgtacccatccgtggcccattctgtgctgcttgcccctactgtgttctgtgtaccactactgaatgtgtgctgctgcctgtgcctgctggctttcatgccctggatgtgagctcacggcgtggcctgtgcatttcacaacgacaggttggccccgtgacccatctgcgcatttacttgtgtgcatcctgacgtgagtgctgcgaactaatgttccactgtgagtaccccttgcatgtgcccaacctgtggcagtgctgtgtctcgacacgtgcatgttaccgagctcgcagaaccttcaattccatactttaccacccagtgaaagtgcccatccgtgcacctcccatatgcacacggcgcacgacatgcttccttgcttgcaacgcaaccgtgacacaccctgtgcccagccccatgtcttgaccctgtagacctggntcagttgcccggatccctggaaaccggtcgtactacactgacaccggaccgacaatgcntccgacgctcgattcagctcgangcgacacgcacgcacacgacatttctcagacatggccctatccgaataacgcttctacccgctagtagcgccaccgatgaccccaagtggccccgtggcatctatcggtgccataccgtgcgcaacacacatgacgcccaaagggcaacgccggctatgacacacggcactggtctggacccacgcgaaccccacacttcaacaggccccttacccttgtggatgcaccctttgcgcacattacaagttacagcggccggctcaaactacacaacaccatcagaaacacacatcacaaactaacccatccatatgacccacacatacagcagccgcacaccacacatcacagacagactacccctcacaagacgtcc

SEQ ID NO: 670613 - DNA, 185 bp, Homo sapiens
ccccgctagccgacggtgctgtcaggctgccgtgcttcacctgtgagcttctcgatggctcgggctcccgtggctgcgtgcgggggaggcatgaatgcactggtctgcggcctgtgcgcccctgggctcgcacgtagttggggtccaggtcgtcgccgccctgcaggttgtcgggctagtcgggg

SEQ ID NO: 670614 - DNA, 200 bp, Homo sapiens
tttgagacggaggtcgcaggtgagctgagatcatgccactgcactccagcctgggcaacagagccagactctgtctctacaaaaaaaaaacccaaagaaacaaaaagaataccttcctagttttgttgaccattgaattgttcatgaccaagtggctcatgggtgacctttgaattggtcgccacacttcacagggacaa

SEQ ID NO: 670615 - DNA, 668 bp, Homo sapiens
  misc_feature (203)..(203): n is a, c, g, or t
  misc_feature (373)..(373): n is a, c, g, or t
  misc_feature (396)..(396): n is a, c, g, or t
gtggtttctagagggggggggttttgggaggtttgggtattcacctctacaaagagctttggggggttgcctaacccaaagggagaacccaccccccccggtctttcctgtatcattaccgtggtacatgttcccccaagtgttaatgggtgtcaaaatctaatgcttttttgtatgttgcccattaatgcaagggcctttcncttttggttcacaatcttatcccaagtgcttgaaacaaagttggcctagagtagctgcttatatgtgttgaatgagtgaggggcttgagggtaataagcagatgggatgtatacatacgaggtatttacaatacagatgccgagtgctcagaatgtgaaagaaggaaganccccttgtgattggagtcaatanagaagactccatggatgagcgagcaggatcagtcttagatggatggaaagaaaagaaggaaagacatagtgtgactgggtgaggtttggcacagagttcttgggaatggtctttgttgtgctaaagtttatcatccattgctgaggggtgagtgtgtcgtcccctctaggacctttagccagcccagctggtggctgacattggagggctgtgctgtgaaaagtgacactgggtttagagcaggagtccgaaacttatagggctccagaagc

SEQ ID NO: 670616 - DNA, 445 bp, Homo sapiens
aggaccgctatgattagcagtatgaatagtattcttgggtaagcaaatagccctagtgaatggataagctcttttaaaacactctggctaatcgagatcgcaccacatcagcgctgggcaacagagcgagactccatctcacaaaaaaaaaaacattctgggataataaatacagaaggattaccagggggcccattttcagggcctaagaaattcagtaatccaggcacggggtcatccatagatggtaaaaccactcaggtgaaagaagggggtgaaccgtcagtgcgtaataccgcacggaacttaccggagctgtcaagctcccaaacacctgagctggtgaggggctgcctggtgtgtggtgcagtctcggctaggcggtatgagcttgggctgaggggcctgggccccccaggaaagacctgatgggaccctggcttcc

SEQ ID NO: 670617 - DNA, 813 bp, Homo sapiens
gagaagcagcatcgaaggaggtcgccagatgatcaagctccccctttgctgtcatctgtgaagtgagacttcgccagcgtggtgggcacctgggagccatgcggaggtgtggtgctttgatgtttaagactccaggtactttgtggtctaaggaaatcgcctagctccaggctgtgttaggacagtattagcatgaaggctgtgctgagcagtcatgcctgctgatccttgaggcaggcctggtccagaaaactctggtgtcagtgactgcgcagggccatgccgctaccaggacggccctgaaacaggacacatctgtattttccgtcccttcaaccactggggggtccagggggcccggcggttcatgcaaagtccagcgggtcgctccgttcctcgcccaggtcctgtacgtctgaagcgcaggggcttgaatggttagtcccaactctggccgaagatagctttttctccagagagcgagaggcctgtgtaggccagtgaggggagcccccgtcgggggcaggcggcggcgaactgcgcacgatgcccctttcccagccgtgtccttgctgggttcccggccccttgtttcccagtactttgggacgtcttacactttggtgacctttggagccccgtgtgtccccccatgtacttgaggggcaaggccagaactttttgtggttggttccttcctgggggggggtcaccgagggcacacccaatttttgtggcggggggcccagggtttctcaacctcgctggggggttaaccacccaagtatgaggcttgtggggagccacgacact

SEQ ID NO: 670618 - DNA, 973 bp, Homo sapiens
  misc_feature (680)..(680): n is a, c, g, or t
catggcgcgcgagctgcgggcgctgctgctgtgggtgccgccgcctgcggcctttgctgcgggcgccggtcgctggggccgtgccggtgaggaaaaccaattctgtgtcctcggagtgaccacagcccagttggggccccagggaaaccagcctggagcttgcaggaggacgatgttcagcaggcagaccggcgaggacaagggagtgaacccctgcactcgattatccagcagcacagagagcgtgcagggtccaacttccaaacatgagttccaggccgagacaaagaagctttgtggacattgttgcccggtcccgtgtactcagaaaaagaggtgttatacgggagctgattctccaatgccagcgatgccttggaaaaaactgcggtcacaaacgtgttgtctgacgggccatgccactgccatgaaattgccagattcatttgcagaccaattgccgacgaaaggcccaatcacccatccaggatacgtgggtatcgggattgaccccggaagcagcttggtgtccaaccgtgggaccgattgccaagatccggggtcaaagggcttccgtggatgctcttgcagaaacaggctgaatggccacgcacgcagaatcatcggccagtttgcattggttgctacctcagcttcactggtggtggcgacgtggaagntcaatccccggtccgaaaccccgagggagcctgcgtcccgttggcttcccaatgttctgacggttaaaacgcgagccctttggagttaacgggccaaatatcttccccgtgaatcgctgcacaggtcccgggcgggcgcgacgtagtgcaccaccacccctcgatcccctcaatagggggaccctcgccgcttgttgacaccactagtttgtcatatattcatctggtactcaaagcctctatatgtacctatcacgtatcatttgtggtagctcccacacatgctctgtata

SEQ ID NO: 670619 - DNA, 114 bp, Homo sapiens
ccatgtgagaatccacagcaatatgggtcattgttgcagaatatcacaaaggtctgttgtgtatactccttttcaccaggaaacaaaaacagtccgaagtgattgttccccgct

SEQ ID NO: 670620 - DNA, 180 bp, Homo sapiens
cgcactctccctgtcgagcgtccttctcccccgcagggcacaggcctggcacctccctgccttgtgtctgagccatagtgacgttcctcatcccagtgacgtcctcatcccagtgacgtacctcatcccagtgacgttcctcatcccagtgacgttcctcatcccagtgacgtgcctcat

SEQ ID NO: 670621 - DNA, 925 bp, Homo sapiens
aagggagtgaggcgccgagcacgggggggtgaaggccccccctggatggtccagggccccgcgcgggaaagactatcgcgcccccctccgaggacttcgccggggcccaagaggtcaaaaaatgcgggggtacacaaaaagtcccttcgccgccccgtaggacgacaaacgggtggcggcccacgtggtctgggccaggcaaggcgcttccgttagaaaccgcgtgcgcccaaccaagcggcccgggtcaacccaacctggttggcagcgccccccccccgccgggccagaaacaataaggccggggtgtccagcccacccgacctcagagtgcctgtaccccaaatttaggctgccgcttcctaccgtatgatttagtaaaacggtctccacccttgtggacaattcgtggtgcgtaaatctaaggccaagtttaaaccatagggctctttggagcgagcaatgcgcaaaaaaaaattttatgtgcctgagcggagtatatatactaggaaaataactgattacaatggctactatgctgcgactacacaacaaatcattttcttcaccgcaccgctccaccgccaaggggcatacacgacaaccgcaactgatagaaacagaggaagcgaaccattttacgcacacaaaagactgcgtacaccacggggataggaaccaccatacgccaaccaagggagtgctgggaccaccgctagtaggcaaccgcaggctgcgtggtggcgcacacccagaagaccccccagaaccttgtagatatagatagaataacccggaaggcgtcaatcaacaacgataggaaaagtatcatcagctctgataatactggatagacagaacgtgacctcgggtgaaagaacaggggacaaagaggagtaaacaaaacaaagagccccacataaca

SEQ ID NO: 670622 - DNA, 575 bp, Homo sapiens
tatatctgcggccatgtaatcagcaattcccccttccctcttccctccaggtgtctgagacgagccacattgtactctgccaactctgtgaattcgactaccctatcccccttccctcctcccaccaggccctggcaacccacattctactttctgtctctatgaatctgactactctaggcacctcatctaagtggaatcatacagcatttgtcctttagcaactggcttatttcacttagcataatatccttcaaggttcattaatgatgcagcatgtgtcagaatttcccttcttttgaaggctgaataatattctgttgtatgcagataccacatttggttagtctagtcatctgtcactgcctatttgtgttgtttttaccttctggctatcgtgaataatgctgctatgaacatgggtgtacacatatctcttagggtctctgcttacagtcctttagcacagaaacccaggagtggagctgttggctcatacgggaactccctgtttacattctgatgaactgccacagttttcacaggggccgtaccatttatattcccagcagcat

SEQ ID NO: 670623 - DNA, 107 bp, Homo sapiens
gtcaggaccgcaaaggacctcactctgtgcatgtcaaatctacctctgtgctgtccccatcctctgtgctgtccatctcctctgtgctcctcctctgtgctgtccag

SEQ ID NO: 670624 - DNA, 128 bp, Homo sapiens
  misc_feature (63)..(63): n is a, c, g, or t
  misc_feature (71)..(71): n is a, c, g, or t
gaagatacagaaccatccgtgaaaatcatttagcactggagaccttctttgtattacttcctngttactangacctctaattcaatggggccctgctggtttgtcgatgaattgagcaactgagaacg

SEQ ID NO: 670625 - DNA, 158 bp, Homo sapiens
ctgcaggttcggcacgacgatatatatatagatagagagagagagagagagagagagatagagacctttttcctgatttcccctttctcccactttcgttctacttctttttcctcctctcttgctcctttctcttagttccttcttccttttctccc

SEQ ID NO: 670626 - DNA, 649 bp, Homo sapiens
tccatgctgtggaagatttgttctttcactcttcacaataattctgtgctgcttgcttcaacttccttgggggtcgcactacctttatgagctggtaacaacttcaacgtggcgaaggggtcgtgcagcttcacctccctacaagtcaggttggcagcaccaacttaacctcaccagagggacagaaacaacgtccaggactattgcccacctttttaacacgcacggctgggtaaaccaacctctgggcaaaacgcgggggtcctgggccgagactttttcaactcttcccctgtgaaaaccgtttcacatggcggaaggacccccattggacaccccacaactcaaggacagggggcacacaggaaacacttccccaaggaaccgcacagattctgttggaaaacaaacaattttttcttttgggacaatactgggcgcgcacaatgtccaagtaaaacatacgcattcccaccccggggggaaacaccccaaaccgcatcaccaccgagacccacttcttttccaaacaccaccaacctgtggttaacccacctttcaaccctcgggtgaagggggttcccttccaggtcttcccaatttcttgtgaaaggtccacaggccaaagaacccaaagttaaaagccccc

SEQ ID NO: 670627 - DNA, 116 bp, Homo sapiens
tccgagtaggagggtcaagttcgtgaagatattctgaaatttaatcttgtaaactatgtgcctatgagggtgctctaaagtggctaaaatatgcatttaatatgtcgtctaattga

SEQ ID NO: 670628 - DNA, 410 bp, Homo sapiens
ccatgatagcagccaatcgttcgcggttgtctacaactggggtcattgtcgagaatgtcatataagatggagtcatatagcatgtaatctttgaaattatctttcttccaccagcataatcccttgggatgcctctaagggaattcatgcaggggaatcatcagacatctaggctgctgagtgtgtcaatagtgtgtccttgttattgctgagtgctgtagtgtggcatggatgtagccacagttaatgtgtaaatgacaacatagtgttcatttgcatgtcggcatgttcatggccagtatatacaaattgaagtgatcttggggactggatttggtatccctgaccttgctaaattcacatactagttctgggagtttggtcagttggttcgttggcttgttccgctg

SEQ ID NO: 670629 - DNA, 127 bp, Homo sapiens
atactgcatcatcattcgccatcagtttctcggtcatcatgccatatggtcccaatcatccaacagggcaatgcatcagccattgcaaggcactcggggcatggggcaatcctctcaggcagtcgca

SEQ ID NO: 670630 - DNA, 457 bp, Homo sapiens
  misc_feature (16)..(16): n is a, c, g, or t
  misc_feature (258)..(258): n is a, c, g, or t
  misc_feature (276)..(276): n is a, c, g, or t
  misc_feature (283)..(283): n is a, c, g, or t
cagatactcaagtctntatacatggtgtaatatttgcataaaaattatgcacattctcccatatactttaaatcatctctacattacctctaatacctaacgcaaatgctatgtaatagttgttatactgtattttttaaattcgtatttgttttttgttttgttttttgaatactttcaatctagtgttggttaaatctatggataaagaggactgactgtattgtgggaaggaaccattgccatgaaaccaccaanaatatgtgcatgcaatgngtgtatntgtgtgtgtgttttgttttgttttgtttttaatttcccttctccagcattttattttgaaaattttcaaactacagaaaattttaaggattaatatggtaaatacctctatgtcacctacatttttaaaacattttggcacacatgggttgtgtcttctctttttttgagttgt

SEQ ID NO: 670631 - DNA, 165 bp, Homo sapiens
ggaatcactgctctggctcctagcaccatggagattagattattgctccccctgagcagtaaatactctggtctgaattggggcgtcagtcctggcgtcgtcgtgtcactttccagcaaagtgtggagtaggcaaggccaggaggtacgatgaggcagggcccag

SEQ ID NO: 670632 - DNA, 195 bp, Homo sapiens
cctcctctttgttgattttcactggtcatttagataataatatgtcagaatatgttatggctaatgcatttcccctactaaattattgtcataaattcacctataaaatcaaacacttcattgggattaaatttcatttaggattgtatttcatcaaggatgccaagatcctccgtcgacgcggccgcgaattta

SEQ ID NO: 670633 - DNA, 1298 bp, Homo sapiens
ttccttttgtttcggcctcgttctggtgcttttcgtgtcgtcgctggtcgttacgtctgtttatctgttgtcgtggtggtggttgggttcttgtttttcgatatcgctggtcggtgttcgtcttgtgttccctggtcgcctttgtgtttcttgtgtcttgtgttcgttcttcgtgcactctttaggtggttctgtaggtacctggtttcataattttctgcttgttacttgggtcaacccgtgttgtccctgttctgtcttctgtcgttctcccgggggttgatcaatgccttcttctgaagttgcctctactttcaaaccctgtaatgtcatttgattccctttcctgtggtaccttctttagtatgtttctttcctatttgtcaatgtgtctcactgccaatggcgtaaatatgtgacgttcgtcggcttcattttcttgcaagtgttcgtcatgaactcgctgttagagcattccgagtttgataattggtctacctgggggtggacttaggaccaggacacgcgactgttctccaggccctctgggcttataccagcggaaggtctactgtcaagtccctggattgtaagtggcccttatacttaggtagtctgcgtagaacttttctagattctgtttgctcacttgatccttttagaggctctgctatactgtggctacctgcttcaagtgaggtcgacccttgcctaattgtatgaacttattgggactgcaattctgagtctcacagaccgaaagagcagagtgtacagtgaagcgctgtctactggcctctcggtgatagcacggatctgtggcaagtcttgttgaatgaccagatgtcctctaactcatgacaggtccttggtgattcaacacgtctatctacccttgggaattagcacataacaggcattaagctctaagataggtgtttgtcctatctaccatcgagctacttcccataatagaccactttgcatccgacactcttcacccacctcccatacgcaaggggatgtggataacattggcccaaagtaactggtggtaggaatactatagaaacaagaccacttatactgtactgtcagaggcagaagataacagcagacatctctgaaccagcactctgccttaaaggaaatctttattaatcacgtgtggttcacagataattactttgttataaaaaaacccgaacctcctagagaagcactagctataagagtggcttcaagcatttgcatcaacgagtcattgtaattaaccacgcggatcaaagtggtacaca

SEQ ID NO: 670634 - DNA, 890 bp, Homo sapiens
aactgtgaagcaggcaagccctctgtagataaatcccagattgggagtgtggttctgaatcttgtgaagacagacataggtgatatccggacctgctgtctcaaagggaccacatctttaatactctactggtgtttggccacgaaatcatggacgtactggcaggcagagacagaattttagtacatgggtatcttccctccagtaacttcagctgcatcagacgtaatgttacgaagactagaaaatcccgaaatgagatgtgtgatgatttgattaagtgttagaatctgtgtgtcagcatactctgcatagtagtttgcaattaatgccatagacttcaaaagtatatcctactggaatactgtgatgtgagggtttgaatggcttgctgtgttcttattttgcatgcgggagtctatgaccaggggtatcagaatgtcttacggtttatttgagatgagataggtgttatcgtataatattgtatgctcatctagaattgttttatgatacaacaagtgaaagcctatattagtacgaatgtagggtgggcagttgtatgcaggtagctaagatacttcaagattttctaatcttcgaaactcttgcatgaagacggatgaatacttgcaccccaagccatatgactgaacgatcttgagagtaatgtgcttactcattgctagtaatcgcacgtaggtgtacgtccatctgcgtattcttttcatacgttgccttgtttcaacattttaacgtcgatgcccttttaagtcctctcaaaagtcgtgtcacaggttctctcgtgttaactcgagccctcacgggtttggactttatcaagaagacctttaaagagttccctttcaacaggataggaaaaaaaagaa

SEQ ID NO: 670635 - DNA, 461 bp, Homo sapiens
  misc_feature (459)..(459): n is a, c, g, or t
acgttgacacttcagacaatggaatattatttagcaataaaaaggaatgagctatcaacccttgaaaagtcatagaggcaccttcaatgcacattgctcggtgaaagaagcccatttgcaaaggctacatagcgtatgattccaacaatatgacactctgggaaaggcaaaaccatggagatggtaaaaggatcagtggttgctggggttgaagagagggatgaataggaagagcacagggtattttagggcagtggaagcactctgtatgatactgtgatggggacacatgtcttctttttttgtgttgagacagaatctcactctgttgcccaggctggagtgcagtggcgcgatcttggctcactgcaacctccgcctcccaggttcaagtaactctcctgcaactggtacaaccacgtctcctgaagtgtcaacgtggggatactctagagcggncc

SEQ ID NO: 670636 - DNA, 120 bp, Homo sapiens
  misc_feature (117)..(117): n is a, c, g, or t
tgggtggtctgcgagtgagctcaaggtgggctgggaggagtatagcaagggaccgcggcagatcgtgggacagattgtggtgaaggcatgaacaggtgtgagattggtgcctcatgncca

SEQ ID NO: 670637 - DNA, 282 bp, Homo sapiens
  misc_feature (39)..(39): n is a, c, g, or t
ggctgaccctagaggatcccgtgatgttatcccaacacnctaaaaatacaaaattagccaggcatggtggtgggcacctgtaataccagctacttgggagtgctgaggcaagagaatcgcttgaacttaggaggcggaggttgcagtgagccgagatcacaccactgcactccagcctgggagacagagtgagactctgtctcaaaaaataaacaaataaataaacaatatctttggggaatgttttagcctccaaattaagttcaaagaactgagtgtgca

SEQ ID NO: 670638 - DNA, 271 bp, Homo sapiens
atatatgtcaaggtcagacatggcatcatggctgtaaacagctttgtgaaggactgtgaaggatcctaatcctttgattcgagccttggaagtcagaaccatggggtgcatcctgggtagacaaacattacagacatactctctgtgagcctgctccgcgaagtcgcttgacaggatgcaggatcccgtatgttcgggaaaaccagcagcagtcttgcgttggcaaaactcccatgatatcacatgcccaacatggtggacagatcagggg

SEQ ID NO: 670639 - DNA, 227 bp, Homo sapiens
tctgtagtgtaacgacggccagtgcatggtcatagctgttagtgtaaaacgacggccagtgcatggtcatagctgttagtgtaaaacgacggccagtgcatggtcatagctgttagtgtaaaacgacggccagtgcatggtcatagctgtaagtgtaaaacgagggccagtgcttggtcatagctgtaagtgtaaaaggagggccagtgcatggtcatagctgtaag

SEQ ID NO: 670640 - DNA, 207 bp, Homo sapiens
ccggcgctggactagagttgcaccccctcccgacacctcaatacgcagctaatcgacgaacgggcctcaatgcctggcattcgccggtatcctgcacacgtctagcacgggcatctgcctgaatctttccgttactgctcctcgcttttcatggagtgaagcatgcttaaacgctgtattttcgtggtcagcatcctggtcgccagc

SEQ ID NO: 670641 - DNA, 348 bp, Homo sapiens
tgcagatagtcccaaaagccgtttaaccctgcagttcagaaaagaagactagatgtaaggggcaataaaaaaaaaaaaaaaaaaaaaaaaacctttagcaattttccccatgttgggccaaacttgtgtgtaaacccaactttcgggataaaaaggcctgggaaaactcaaccaggggtgccgccttgttcttatgaagggagataattccctatagagagtgagaaagtgatgcgaaacccatagaaaagagaagcctccctcctttcaaggccctcctgttgtgcacacctttttgtgtaagcagttcgcgcatccttaatacccacatttgaaaatttgcactct

SEQ ID NO: 670642 - DNA, 153 bp, Homo sapiens
cgcatgactggtgttgagcacaggtttctttaaggtggtaacaatgttctgaaattagaagtggtggtggttgccaattacatgaatatacttaaaatcactaaattgtacactttaaatgggtgcacattatgatatgtaaattatagctca

SEQ ID NO: 670643 - DNA, 300 bp, Homo sapiens
caagcgatatgcggggggactcacagaccatgctgctgcagagtggtggctgtgcgaggtcgccgtggggctggctgccatgcacaagctgcacttcctgcacagtgatttagccctgctggaattgttttctcacctcctgacttaaattgtgaaatgtgggagattactggaatagtgattcagcagtgtacaatggaggattatatatgaaacatgatgataacaaaagtttaccactgtgcgagtggacgtgctccatgaattatgtaagccatgctttcaatgacagcactgcta

SEQ ID NO: 670644 - DNA, 487 bp, Homo sapiens
cttacattgagaataagactgaaaatgggcactattaaaccatatgttgcttacggatatacatataaggtaaaattattgtaaaaaagtaacagtaggctggggtggtggctcatgcctgtaataccagaactttgggaggccgaagcaggcagatcacctgaggtcaggagttcaagaccagcctaggcaaatatgggaagatcgtatgtctatgaaaaagaaaacaaaaacggaaacaaaactttttaggcagttaaaacttttttccaaaactattcctttcatagagaatatctttgtagttttatcaggttggtttattcggccggacactttctttcctcattacatttagacaattttttcactttaatcgttaataggaagctttatattatattttgctgattttgtttctaaagaagttaaaaatgtagcagcagttctttacctgtgtgaaaatctatcacatctttaattcact

SEQ ID NO: 670645 - DNA, 295 bp, Homo sapiens
tgctcagaccacgcttttcgacggtgtctgactttcacgggagtcacatctgagagtaggggacagctggttcgagccaaggcgggtagtccttcactctacctgtcacaaactagctcagcaccttcctgcgacaagggttgaccacacactgatatgcgagcagccgtgcagtcaaagtgttcacacaacaatattcacacagcaacccatgcaggtgttgacaatactcacagcctgaacgcgctctcaatgtgacaagacttcctcccgctattcccgcggtgtccactga

SEQ ID NO: 670646 - DNA, 964 bp, Homo sapiens
tttgaagaacttggccaaatactttcttcaccaatctcatgacgagagggaacatgctgagaaagctgatgaagctgcagaacccacgaggtggccgcggccacctgtgaggatatcaagaaggacccagtgcaaggacggggagaccgcggctgacggcgaggggacgcgcgatatggacacgccggcacacaaccgctagcgcacgacccaggcacacgaactcggaagagtaggcacaaagcctagagcagacacggcaccgacacaggtgaacgaccacatagagcagcagcacgagcacacgagccacagccttagccagcaaggcacgacacggctgccaccaaccgaacccagaccatcagcgagtaccccacacgagtcgcaccaagaaggcagacacgccccacccgaatgcgcaggaccaggcaacacaggaaaaccatcccacgagaaataacagccacaggaagcacaagcagacacacgcgctaaacacagagacaacacaaagacggactatagcacccggcacacacagcggtgaaatcacacaccacgatagaagacacacaagctcgaaacaaacgcgaccagacgagaacctccaccagagaaccacagaacttcacaccccaggcgcgcaccagaaaacagacgactagacacgacaacacgagagcacagcgacccaccatagagcatacaggaccaaacgcgagcaccaacatacaaacagccagaaacctagcaagagcagcagcaaaacagacagaagaaagaacacaaaacagccacacaaccaaacagcgaccacaatacaaaaagcaccacataaagcagcacacatcacgcagaggacaggagaacaaccaaacaccagcaacacagacacaacaacaaacagcacacagcaaacccacaaaacacaggaaccaccaaccacacaccgacacaacac

SEQ ID NO: 670647 - DNA, 519 bp, Homo sapiens
  misc_feature (269)..(269): n is a, c, g, or t
tacttcggaattttgaggattcagtttcattttcatccctcgtatcatctcaaaactttcagagtctttcagaaagtgtgtcagatagtttttcaaaggaactgcatgacatctctggattttaactatcgttcttgggagagcctgtgagaaacgtggatacccaacaaatttgccagaagactctgctgctgagcaattcttctaaacatttcaattgggcagcattgggataaagaaacattttataaagcagcttctcgcaccanagtcatctggtgattctgcgtggagaccatcaattatgatatgatccccagcagatgtaaagttacgacgaatgtgttctggtaaaagatgcttctcaatcttggtgggaaaattggttcccataagaaatgtactactcaaatccaagattttaacattgaggtccactgctcttttacgcctttctttggctagatggattccactaatttcaaaatcaaacataaacagttcagccaatccccggtc

SEQ ID NO: 670648 - DNA, 168 bp, Homo sapiens
acatagcagcggaggtggcagcagcggggacgaggaagagtggtatcagggccttcctgctgtccctggtggcaccagtggcattgatggtggccaggtgggcagagcctgggacccagagaagttagcccaggaactgtcagcatcgctcaccaggacactggacct

SEQ ID NO: 670649 - DNA, 392 bp, Homo sapiens
  misc_feature (20)..(20): n is a, c, g, or t
  misc_feature (325)..(325): n is a, c, g, or t
cggcacgatggctgcgaaancgttgacaacgcaaacatttcgcatcgatgtgacacagccgcttcccgggggaccgtcatgaaccgaaagcagtaccgcattgcactcgcgacactgagcgtgttcatcgcgctggctcgctggccggcatcgtgcacggcatgctgttcgacgagcgggtgttcaggtactcgatcgtcacgctgatcctgagcatcctgtcattcgtcgtgctgttgaatctcgcgcccggcaccgtccgtaaacggaacacgggcaggacgatttgccttgcgcatgtcaagcgaggcttcactcgaaacgnccgtgcagccgcggttgggcagattcaagggagcgcgcgaaattggggcgagttcattagcggattc

SEQ ID NO: 670650 - DNA, 940 bp, Homo sapiens
ctttagcgtcgccaagcgagccacatcgctcagacaccatggggaaggtgaaggtcgtgagtcaacgtgattggtcgtattgggcgcctggtcaccagggctgcattttagctctgggtaaagtgagatattgtagccatcaatgaccccattcatagagcctcaactacatggttatacatgtgccaatatgattccagcccatggcagaattccatggcaccagtcgaaggctgagaacgggaagcttgtcatcaatggaaatcccaatcaccatcttccaggagcgagatcccatccaaaatcaagtggggcagatgctggcgctgagtacgtcagaaggagatccaatggacgtcaacaacacacatggaagaaggctgggagatcataagacagagggggaagccaaaagggacatcatcatctgacccacactgcatgatgcacacacatgatacgacacatgggtgatgaaccactgagaaagtaatgacaaacagacctacacagactcaatcagacaaaagaccatccatggacacacacaaactgacatagacaacaccatggacacaaaaggatcactccacaaaagaccacaccataaaggagtacatcgacggagaagggacatcaatgaacacacacgaaccaatgaacaatcacacaagcccaacaccaagaaaggacatggtaggaatggaacccaacacacgaggaaaaccaggacagacagactgaaaatgagacaagacaaggaaacaaacacagaacaaaacaaaaaataaaagtcaccaaagaccaccaaaacatgggacgccatgccaaaaagagcaagaaagagacaaaagagaaccacacacacaaggagaactaaaacaagaagaaacgacatcaacagtgacaaaaatagaacaaactacaagaagataacaaa

SEQ ID NO: 670651 - DNA, 133 bp, Homo sapiens
atcccccacccccatcctgctaccccgagtccgtgaaaaattgtcttccgtgaaaccggtccctggtaccagaaaggttggggaccactggcttaaaataccaataaatttttgaaccttaaacacttaaaaa

SEQ ID NO: 670652 - DNA, 176 bp, Homo sapiens
gcttatctatgggcagaaagagacagcacctactattctcagaatataatttgaagatcttagtgcctacatttcggagccttctataagtcagtttattgagcagtcacttagtcaacaaggtttgatgaacatcccttctgaatcgccccagcagtcccaaacatcatgtacct

SEQ ID NO: 670653 - DNA, 684 bp, Homo sapiens
tacctcgaattagggcacttggcttaatgaaaaggacaggtgccttccttttaagccagggttatgtaacctttctaacagaagaaaatattcttacatgaattcctgatgccctatggatggttcttgttcaagtggcagtggaggcaacagatattgaaggccttccgacacagcataatggcatggaatggaagtaaacgcaaaagggctttcaaacattgatattctcggggggctgaatatcaataatgaagtacagaagcttctaaagaagttgtcgttaaagctctcacgaatgttggcccggagtacataggttcttctaattcgtgaaaatgtgcatgcagcgtgtgccgctatggtagctgcgtaagttccagcaacatagatcaccgcgtctatgtgatagggcttcaaccatgaaggtaccagagcagttaggcctagtctaggtagtagatcttgctccaaaagctgagatgggtctggaagcttaagcccagcaagcacttgatgcacaggcatttggcaatgttgcatgagtggcactcctagatagaagtaaaggttcgttttgaccagaggacaaatgtataagagctcttgcatttaaagcgtatcatgtctagagtaaggcggcagacttttagtagtattataatatcccgtccataaacgcaa

SEQ ID NO: 670654 - DNA, 354 bp, Homo sapiens
accacgccgtatagacccactccaatttgcttaccgcccaaataggtccacagacgatgcaatctcaaccacactgccctaacccatctggacaagaggaatacctatgtgagaatgctgttcatcgactacagctcggcatttaacaccatagtgccctccaagctcgagaccctgggtctcgaccccgccctgtgcaactgggtactggacgtcctgacgggtcgcccccaggtggtgagggtaggcagcaacatctccaccccactgatcctcaacactggggccccacaagggtgcgttctgagccctctcctgtactccctgttcacccacgactgcgtgcccagaagg

SEQ ID NO: 670655 - DNA, 113 bp, Homo sapiens
taaataaaagtcatttaacggtagaatactttaaatttcactttcgtgtatttaaatttggttgaagggctgatggggattccagtgtcttattaaaaatctaacaaatctgt

SEQ ID NO: 670656 - DNA, 189 bp, Homo sapiens
catctgatggctatgatttccaaagagaatccaaaacaaagttaaatctaccaacgaaggcactgaactgctatgccttgcttaattagtagaccaccaaccttttatttgtaaactagtgaaaaggtgcatcagacgatgaactagaatccaatccacaaagattggaccccaaaaggcactgcacaa

SEQ ID NO: 670657 - DNA, 784 bp, Homo sapiens
aaaattgcgtatgagaacccaaagcagaggtacctaatcaggtcaaaaaaaaaaaaaaaattggagcaaattgtgcctaataacttggtattttcctgcatccatttgatgttctacctacttttcttcacttgtcccatttactaagggtcgacactttccattgcaggtggcattatgtttgtccccaggtatttactttcccgtgttgctgcccttaaccaaatttgtcacaccttttgcagcttaaaacaacacaaggtagcatcatgttacaattctggaaggagagaagttctaaaatcaaggttttcacagggccagattcttctgggaggctgcaggagaaaacctgtttccttgccttatttctggcttctagaaggcttcctgcattcttgcccttgtaagccttccttcctcccagcagtccagcctctgcttatggtcatcatatcattttactctctgacttgagcttcttgcctccctctttacttaaaccctagtgtctacaccgaacccaccaggatacttcaggataatcctcccaatctcaggacctttaccttaataatctctgcaaagcccctttcggcttgcaaggttaacttattaccaggttccagggatgaggcccatgcccatttgtggactgggggtaggttgtaggaaaacgcatcatgcaacctaccagtcttggtccacaggatttcccatctggatcttgtaagaattaatcctaattcattacctacacttgtgcaggcatatacacacaaat

SEQ ID NO: 670658 - DNA, 429 bp, Homo sapiens
atggagacgggggtctcaccatacccaaaaacttgcttggtatagcccaccagaagggacagagtcattggatgtggtcacaaaaggtgtgagttcacactaactgagcagttcagggagaaattggtggatcccggaaaccacaatagcgggattgatctctttaggacctatctttggcgtagccagttccttttcacttgggtgagtacaggtaggacgtgctgtggggcttggatcggactttgtgctggcattggccgaagtttatatcccagcagttgcacgggcatactccatctccttgcagataccaggctgtgaagtccaggccacatggaggtgtcctgtgtagatgctcgagttgaaatcccaagctaagctcccaatggacagccaacatcattgccagccatgtgtgggagccat

SEQ ID NO: 670659 - DNA, 142 bp, Homo sapiens
cttagagagatccccaatacagaactgagaagtgacaacataacatagtcccccatcattaacaagagctactcacatgtaagtgactctggttgggtggcactccagaaaatgccattcctgatatgcacgccctgctagt

SEQ ID NO: 670660 - DNA, 293 bp, Homo sapiens
tatgtataaagaaataacaaattatactggccacggccgtggtggcttacgtccatgtaatcccagcagctgttgggaagctgaggtgggcgagatcacaaggtcaggaattcgtgaccagcctgaccaacatggtgaaaccctgtctctacataaaacatacaataaattagccaggcatggttgcgcatgcctgtaatttcagctactcaggggtttgaggcaggagaatcactgacccgggaaattccgctgcatgaagcgaagtggatacgccagcctgcacatcacct

SEQ ID NO: 670661 - DNA, 255 bp, Homo sapiens
gcgatgacaggcgaggacagcgcagaagaagaacatgggcgagtatcacatgaagaaatacagccaagtcatctgtgggagagacggatgtctggaggatctgatgagctctcagacaacatcacccagcagcagactgctcccagagagatcaaggatcccaaatcagtggacatgtcaacatgtaacgcttgggagaggaacggagaccacggaccatttccattgatgcgcaagattcatatgccataccca

SEQ ID NO: 670662 - DNA, 156 bp, Homo sapiens
  misc_feature (65)..(65): n is a, c, g, or t
  misc_feature (98)..(98): n is a, c, g, or t
cgatgactcgagccggtacccctaatcggcgactttattatcaaactcaaccatttcgtttgacnggtggttcaacgcgcaggaatgagtttacctgnagtttaggcatatcttctggagcagcatagaacattttagctcttactaggcctgact

SEQ ID NO: 670663 - DNA, 167 bp, Homo sapiens
ggaggcagaggttggggtgagctgagatcgcgccaccgcactccagcctgggcaacagagcgagactccatctcaaacaaaaacaagaacaaaaacaaacataaagttggcacagaaaagggacctagtttaacacagggtttacaatgtatgagacttgcatcgtt

SEQ ID NO: 670664 - DNA, 431 bp, Homo sapiens
  misc_feature (12)..(12): n is a, c, g, or t
  misc_feature (39)..(39): n is a, c, g, or t
  misc_feature (66)..(66): n is a, c, g, or t
  misc_feature (72)..(72): n is a, c, g, or t
  misc_feature (74)..(74): n is a, c, g, or t
  misc_feature (94)..(94): n is a, c, g, or t
  misc_feature (109)..(109): n is a, c, g, or t
  misc_feature (129)..(130): n is a, c, g, or t
  misc_feature (142)..(142): n is a, c, g, or t
  misc_feature (149)..(149): n is a, c, g, or t
  misc_feature (152)..(152): n is a, c, g, or t
  misc_feature (159)..(159): n is a, c, g, or t
  misc_feature (197)..(197): n is a, c, g, or t
  misc_feature (212)..(212): n is a, c, g, or t
  misc_feature (215)..(216): n is a, c, g, or t
  misc_feature (220)..(221): n is a, c, g, or t
  misc_feature (242)..(242): n is a, c, g, or t
  misc_feature (245)..(245): n is a, c, g, or t
  misc_feature (248)..(248): n is a, c, g, or t
  misc_feature (254)..(254): n is a, c, g, or t
  misc_feature (257)..(257): n is a, c, g, or t
  misc_feature (274)..(274): n is a, c, g, or t
  misc_feature (283)..(283): n is a, c, g, or t
  misc_feature (301)..(301): n is a, c, g, or t
  misc_feature (303)..(303): n is a, c, g, or t
  misc_feature (321)..(321): n is a, c, g, or t
  misc_feature (324)..(324): n is a, c, g, or t
  misc_feature (361)..(361): n is a, c, g, or t
  misc_feature (371)..(371): n is a, c, g, or t
  misc_feature (392)..(392): n is a, c, g, or t
  misc_feature (406)..(406): n is a, c, g, or t
  misc_feature (414)..(414): n is a, c, g, or t
agcctcggagcnaacagggagctgggagctgggggaaangacgccaggaaagctatcgcgccaganagggcnangggggctcgggaagcctganagggcttttgcgcanagctgccggctggctgctanncgcccgcgccanccccganaangcgcgancaggcacccagtccggtcaccgcagcggagagctcgcngctcgctgcagcgangcnnggannggccccgcagacactccccanaangcntgggcngcncggatgtgcactaaaanggaaaagcncttctacaaagaagaatnanaaaaagataagggataangcngggcccctggtggcctctctctaaaagaataaaaaancatgaaaaanagaatggcggtcaaaatggangaaacctaaaggantttaaaanagcctggggctcgcgga

SEQ ID NO: 670665 - DNA, 168 bp, Homo sapiens
tctctccacacggacaggagcgtcctgagacaggagtcgagacagcctgagcaacatagcaagaccttctctctatttttaaaaaactaaaagtggatttaaataaagaatctgcatgaactttcttgtccacttattcttacatattattggccagtgtggagagag

SEQ ID NO: 670666 - DNA, 137 bp, Homo sapiens
gctcagttcacctttcttcacaattgaggctcccttgcttcagcttccttggggcttgcttaattgcttcttggggccttcttgggatcccaagttggggggattattttgttgattgacttcatgtcttcccactt

SEQ ID NO: 670667 - DNA, 494 bp, Homo sapiens
tggttgccagggaggaattggaactgactgccattaagcacaggtttctttctgggttgatgaagatgttacagaattagatatggtaatggttgcacaacatagtgaatatactaaaaatcactgaattttacactttaaaattgtgaattttagaggctgggcatgttggctcatgcctgtagtcccagcgttttgggaagccgaggcgggtggatggcttgggttcaggagttcgagaccagcttaggcaacgtggcaaaatcccatctccacaaaaaatacaaaaattggcctggcgtggtggtgcgtgcctgtggtcccggctgcttgggaggctgaggctggagaattgcttgagcctgggaggtcaaggctgcagtgagccgcaatcctgccactgctctccagctcaggagacagagcaagaccctgtctcaaaaaataaattaattttaaaaatggtgaattttatattatgtggattatagtgc

SEQ ID NO: 670668 - DNA, 690 bp, Homo sapiens
  misc_feature (5)..(6): n is a, c, g, or t
  misc_feature (39)..(39): n is a, c, g, or t
  misc_feature (196)..(196): n is a, c, g, or t
  misc_feature (248)..(249): n is a, c, g, or t
  misc_feature (284)..(284): n is a, c, g, or t
  misc_feature (518)..(518): n is a, c, g, or t
tttcnnccgcagctggggcggggggcactatctttatanccaaccttggaacgaaagtgaccgaggagctccttttcgagcttttccaccaggtctgggccatgtaattaaaggtgaatatttccaataagatcaaggcatggtaataccaaagcagtcttgccgtttgttttattgtggagggggggggtcctcntcttcctctatttcaattaaaaatacattaatgacaatcataacctttatannaagggcctactcaataattcatatttactatcatntatagaaactcattgcccccacatagatagtcaagttctgtcatatcgcccaaacatcatagttggagagttcaaagccctacctccaacatcgttctagggagcaaggttacaagagggtactatcggataagcatgccctccattcagcacaagataacttccaaagaatcgtttgtgctttattcacgttttccttttggcaacaaacattcttactaccgtcaaactttnggggttaatctcactggatcttttcaccaggcaggccccatttcactccattacaatagtgtctcaatatcgttctgcaagacctctcccccgcccatcctttggtttcatccctctttttcccgttgttacgcggcaaagtagaacatacataagtcacataacaacaaag

SEQ ID NO: 670669 - DNA, 221 bp, Homo sapiens
tgctgggattacaggcgtgagccactgcgctcggctgataaattatttgaatggcttctcctaatttttttggattaatatgtttggataacatggttcctatggtaatattatcaaaaaagttttctttcctgcctttaggtgtatcattaaggtgcctcggtgtggttgaatttatttaatcggaagatatttatggggcatgtgtcttttttaatcag

SEQ ID NO: 670670 - DNA, 570 bp, Homo sapiens
cactccttttttgggaagctgggccggccgtttcgggtgactgatgagcttgtgttcaaggtgccaagaagggcggatgctgttcggaaggcctataagtatctagctgctctgcccgagaactgcagccagctcatccagaccatcgaggacacaggcaccttcatgcgggaggtttgagccctcgaggagcagatcgagacagagctgggcaagaagaccctcagcaacctggagaagatccgggagggcttccgagccctcccccaggagaacgctggcctcctaggccgggtccgggaggccttaggaacccccggcaaaggtctttccccagcctcaggcagggatttggggttctggaggcagtgggccagacacatgccctagttacttcccccgctgtccagttcctcctggtggggccttgggcccagacccctgccccctggcccccacccttttatggggtgatagtcccgcatgtggggggcccggctcccgttttttgggggcggtactgtgggttgggggccttgggtccccaataaatgggtggttcctctgcca

SEQ ID NO: 670671 - DNA, 457 bp, Homo sapiens
gcctcatgtagtgccccacgatctgagggtcgggacactcgagtttcttgatgatttcaaagctctggttgagttgggagaaaacatccaccacggagcaggagaatagggcatgctctgaggtctgctggaacccatccttcttgtctcgctccagggcaccgtgcaggaaatcccgggacacctcctcattctcatccagccactggatgacgaagggttcaaaccatgcagggtactcaggcacgcggtccttgaaggcgggaagttccgtcacatactcattgtagagccatttcaccttgaagtggaggttcatgtagtcggcactcttgcatagacgatgcttgtcgtgctcctccatggcgtacttcatgtcttgggcaaacagattccacatcacttcagcgctgattttacccacattcagctcctggggaaactggttgaggcaggc

SEQ ID NO: 670672 - DNA, 109 bp, Homo sapiens
tgctgcaggtcgactgtgtatgcaccagggcggtgcatgcctcctgtgtacaagttccgtcgacacgtgagcaccgggctgacctccaaatatcgttaagctggagcct

SEQ ID NO: 670673 - DNA, 421 bp, Homo sapiens
  misc_feature (421)..(421): n is a, c, g, or t
ctatgatttacatcattttgatgcagagcatttccttgatcaaatgctgtagtggagtgtactgtacaatagaattctccacaattaaggaaatgttctgtatctcaagagattgtccttaatggtggccattagtcatgtgaccgttgagaatttgaaatgtggctagtgctactgaagactggccttgtaaattgcttacaatctaaattctgcctgtgctattatcggctgtgggttcgccaaaatttgtttttttaaagaggcaaagataacggactgttggctgctttattggacagcacagctagcatatagatgcagataggtagtataacttgtttgtagtttaatataaatgttgtatattgtaattaggccaaatttgagtttcatcatggtgactatgaaagacagtttn

SEQ ID NO: 670674 - DNA, 388 bp, Homo sapiens
  misc_feature (177)..(177): n is a, c, g, or t
gtctcatcaatcatgaaaaaagatttgttacaacctaagtcagaaaaggttttcatctagtcatatatgtgtggcaaatacggagaagccacagacggtgagccacagacaatgagagcagctgttggggtgggctccagggtgctgctttccctgagggccagctgggtctggcanggttcacttcccaccccggtgcccccggtactcgctgtctccagcctcaggttctgaaaggcagagactcctagcctcattgaaggatggttagagaggcaccgggagctatctagtggcaggcccacggtatatgtttgctgctttctacaaatacgagatcaaaggaaaataaagcaggggtggttcctgtcagtgtggagcgagaccc

SEQ ID NO: 670675 - DNA, 1117 bp, Homo sapiens
tctgtgtcacggttcctgtgtttggtcctacacttgggttgtgtctttgtgcttacatattcctggggggttatctatacagtatttgggcttgtccttgggttccccttatgccctgttagtgtccttgatgggtttggtcttgtgacgggtcttctggatttctcttcatgtggtcaacatctggcgcattccccaaccagggtctcttgtaggtttccttgtattagtttccttcggattcaattgattcttgtcccgtcaggcgtctctcttacccaactgtctacccctttcaactttggaagtcaatgcagcatagggttccagcctgcgtctttagtgtagtaccttagtagctgcctcattgagcagtcctcctagaagttctcttcttggcaggggtagactttggacctctcaggtatcccgctggtcgacacaggacgtgcaacacatcacacgctacctgagcagccatggtgctgtgcctggcggtgctggacctgagcttcacggggcctgagtgatgagctgctgcacctcctggctgcccagcctgtagggctgcttgccccgccgtctacccagctcctgctcaacggcaaccgactgacgcgggccactgcccgcatgctcactgatgccatcaaggacacctaccaagttccactgctttggcttgggtggacctgggcaacaacgtggatgtggcttccgtgccccagcccctgctggtcggcctgcgccggctgctgagccagcgcacctgcactccccagccatctacgagggcctggaccttagagcctgagggcagtagcggccggggccacacacccctgcctgccacactagggactccacagctggctgggctgggacgcgaagcccaaggcctgctgtgacacaggtgacccaccacccacattggctcattagctacggacttgtgaggctctcaagcacatgatagtgggcagatagaaggtcaaggagactcacaggcccggcagaaatccagtgtaaatgctcagcctgagattaaggggacagaagaatgacatcataggggccaggtggccagtcctggctagagaacagccgtgctcagtga

SEQ ID NO: 670676 - DNA, 332 bp, Homo sapiens
attgggagtgcgcaggtaggcaccaaatgacgagagtgctgttaccagtacactaagttacatcttaccttatttctcagccgttaacctagctgtgaactcactgttactaccgttcattaaagtggcaaaccacaggaaacagcctggaagagattcacacttgtaggccaaacaccggcagagcattgcacatagcgtcctcatggggcccaaggaagcatcccgaaaaggcacttcgacagcaggcaggaaggcaagcgcatcaggcgggaaccgggttgcccaggcatcctgctgcagaaccacatgcccggcagaaaaaaggctcg

SEQ ID NO: 670677 - DNA, 802 bp, Homo sapiens
ttgtatatgtgggaaggcccgcggtcttctgatgattataggaattgcagtccctctggtcctctcgttgtgttggattaagaatgtgctactatattatatagggtgtagaacacggcacgccactcccatgggtatgcgctctaggcgctccctaatatgatataattctgctcctccctccgccctactatcgttgctctatctcttctcagcacacattgtatactatagaagtggttgacctggacgtcttgctgtgtttcttggtaaggtatcctttgatggcggtgtgtgtggagttgagagagtgttgaggtgtgtctgggactgataccattatggtgtagtggtagtcaaaggatagatataaattaactacggtcacgccactccatgttctctacgtgtggatgtagtatccaaaatacatgttaggtggaacgcgcctgtctgtggttattgataggtgggcgactcacacaataggcatgtgagaacccaaatgatcttctctcacgagagatattttttatctctctcgcattggtccctcgccccgccacaggagtctcttcgacgcgtcgttgatagaagggaagaacaatcatagtgccccaaactattgtggtgggggcctcatgttcatctagctcttgtttgagatcctccctatttatgcgaagggccgctcgcgtatgctgctggtgcttgtcctaggaaaccgagttgactcggtgatcttacgatggcaacagcaaacaatacgacagtgaagaggcttccagatcaacaaaacaca

SEQ ID NO: 670678 - DNA, 244 bp, Homo sapiens
  misc_feature (104)..(104): n is a, c, g, or t
  misc_feature (187)..(187): n is a, c, g, or t
  misc_feature (190)..(190): n is a, c, g, or t
  misc_feature (217)..(217): n is a, c, g, or t
  misc_feature (242)..(242): n is a, c, g, or t
catctctatgtttgcccccaaggtagagatctttctgtttcccttgggaactcacattctgtgatggttaatactgagtgtcaacttgattggattgaaggatnttaggattgttcctgggtgtgtctgtgagggtgttgccaaagaagattaacatttgagttagtggactgggagaggcagaccnatnctcaatctgggtgggcaccatctgatnagctgccagcatgactaggaaaaanct

SEQ ID NO: 670679 - DNA, 481 bp, Homo sapiens
  misc_feature (62)..(62): n is a, c, g, or t
cggttaggcccaaccgaacacattgctttagattttccagcggggcaggttgttgcgttccnctttaacccccggttcaatgagaacccacggagggtccttgttttccatcccaagttggattatacctggggaagggaaaaaaaccagttggtttttccctttttaagtggggaacccttccaaaaacatggactggttgaacctgcccccttcaagggtgcagtgaattagggtcccctgttgccggccaatcttcggggtaaaaaactcaatgaaatcagccaactggggatttttgggggcaaagcccccccccgggttttatataccctgatataatttgaaaggggggggtttaaaaaaaaaaaagaattttacccttccatggggaaagggtttatgttccctgggagggaaaattttttcatttatccatatcccttttgtaagttatttacttaataaatatttccgtgga

SEQ ID NO: 670680 - DNA, 1503 bp, Homo sapiens
ggaaaccaacagtcggttcggccgaaagcaattgtgctcctggctaagagcctagaggataggtttctatgtaccgtaaagagtctcgagtccaaaaataactaggatgttggataggcgatagtgccgcctgtttcttccccctagactatccaagcagtggtgaagggaagagtgagaagatattccagctactaacggtataggaggagaagagcagtcctactggtggtactagttacctacattactgtgacattatttggtaagcaagtgggaagcagtacatctaacttcctgtgcactactgctccgtaactatgcgcagatactatgcagcgacaggcgcataggccatcagggactttcttctcaacagtagttcatttccagtgacacaatttcgactagttcggtgcaaacataaaggtccgtacaaggtattacatgttttacatggtgtttgtccccatttgtatgtaagccgccgaatacgtcaataacgaatttctggggcacgttcccatttaatccgaatgatagatgtcaatcttcacctagtcactaggctttgtgtctataaccaacaagtaatccatggacataatttccaacacaagtgctatccctggctgtctgttagcgcccaatgtggcccccagtgggcatagaggtcatggccaccacagtgggcagacacaacctctggatttcactttgcaatttgcgagctttctccggtggtgtgccagattggctcacctttggcatgtcgaaacacaattccggagactagaagtgtgggatgggggccttcccgcgtagattatggataccccatagggataccggggtccaggccttagttgcgcccagacaataccaaccttggttcgcagtaagttcgatggggcaagtgtcgtttcgcccctgacgctaccttgggagaatctccccggtttgcacaaaggtacttaaaccgggacgcagccttaccaaaagaccagcaaagaccctgggggtggcacccctggttgggacgcaaaggggacgtggtaagcaagaaactaacaatacccccgtccccaaagtggataacccaagagggccccaaaaaaccatgctgaccaacagggaaccacaacagaacaggacccacacaaggtgggcaccacatacagcagggggtacacaggcaagagcctttatcaaaccaatcaacgtgtcgcgcacaataggcccaggggtgatagcaacggcacagaaacaccactataccacgacgccacaacgtagaagccaaacactggaacccggggaagaacccaacagaacgtacggggaccaaccaccaggggcccatctcagagaacgagccacgccactacacaccaagcgctgcgaaacacggaatgagacgagagcgagacaataacaagaacaaacagacgaacacgacgcaacaaagaagaaccaagatgatccacgagcatcgatctcaca

SEQ ID NO: 670681 - DNA, 801 bp, Homo sapiens
gcctttgtccgctgcaggcccgagcccgagtgtcgccgccatggttcgccgagtctgccggcgctggtgtcggcgcaatgggtggggagggctggggccacgcggcgctggggcaagcctctgagcttgttggaacgcctccctgttaccttgccgaagctgggggggcggcgaccgccgcaggacggcagatttccgggagaggccgcacaaaatcccggggggcgccccggttttctttcggcctttccgcccaggttgcggcggacagcggacctttcggccctttagggaaccatttggtttggcccggggggcccgagccatttcccgggggagcacaccggcagggcccgctctggcttgtggggccgccgcccaccccacggttgcgtgttcatcattcgggacggcagggcagaccaggggccttataacttcgggcccccgtgcgcgtttttgagaggggatattgtccccggccgccttgtcggggacaccaggcgccggggtacactgtcgattgagtgtgggggcccccgccccattttgggttggccccaagaaacctctccgcgggaccgtgtccgggaatagacgccaccttttgtccccgcgcgaggtcccgggcccagggtaccgaccccagctttataatcaaggcacttgagcggcacattaagggagaaccctggaactcccgggcgactcccaagggggggggacccccgcgacccatgtgggaacgttccggcgcacctgatcccgaccccggaaagtgttttggaaccggccaattcc

SEQ ID NO: 670682 - DNA, 93 bp, Homo sapiens
cacatggtggctgggatctgtgctaagctttacaggggcaaaaataagtgacatgtagcaaagattttcaaacaaaatattttttcctttggt

SEQ ID NO: 670683 - DNA, 367 bp, Homo sapiens
  misc_feature (15)..(15): n is a, c, g, or t
ctcaggaggtgaggnaggagatcgctgtgagcccagcgagtgaggcggcagtcagcggagactgcgccactacattccagcctgggcaacagaactacactctgtctcaaaaaaaaaaaaaaacaccgaaatcacacccaaaacaacaacaacaaaaatgactagtttaaaactaaaaggttatagtaaaaaaacttatcatatatatatattggttggttttaaaaaggcagggtttggctgtaacccaggctgaaggagtgcagtgggtatgatcacagctcactggtaaccttgtactcctgggctccagcaatcctctgggtctcagcctcccaagcagctaggattacggatgtgcaccacc

SEQ ID NO: 670684 - DNA, 293 bp, Homo sapiens
ccacttaaatatcatgcacagaggcgtctagtcacactgctgaacatcacaatcttaaatatccatgcacagaggcgtcctagtcacactgctgaagatcgctgtcttaaaatccatgcacagaggcgtcctagtcacactgctaaagatcacagtcttaaaatccatgcacagaggcatcctagtcacactgctgaagatcaccatcttaaaatccatgcacagaggcgtcctggtcacactgataaagatcaccatcttaaaatccatgcacagaggcatcctggtcacac

SEQ ID NO: 670685 - DNA, 284 bp, Homo sapiens
gccactccacctggctgcacccaagccacccagagcaccaaggagggtggatctgtgggttgccccacgctccctccagggctgtgccccagcccacgaggggccttggaccctcagacgctggcgaccccacaccacacctaaggctcagcgcagcctctgaggggcttccgcagggcagaggcctgaaggctgaacgtgggacgagacctcggctgacgccccacaggctagcgttgctgctagagggactctcattgtacgaggccgactcggcatccaca

SEQ ID NO: 670686 - DNA, 426 bp, Homo sapiens
  misc_feature (7)..(7): n is a, c, g, or t
  misc_feature (134)..(134): n is a, c, g, or t
  misc_feature (139)..(139): n is a, c, g, or t
  misc_feature (178)..(178): n is a, c, g, or t
  misc_feature (201)..(201): n is a, c, g, or t
  misc_feature (224)..(224): n is a, c, g, or t
  misc_feature (249)..(249): n is a, c, g, or t
  misc_feature (260)..(260): n is a, c, g, or t
  misc_feature (285)..(285): n is a, c, g, or t
  misc_feature (287)..(287): n is a, c, g, or t
  misc_feature (289)..(289): n is a, c, g, or t
  misc_feature (300)..(300): n is a, c, g, or t
  misc_feature (346)..(346): n is a, c, g, or t
  misc_feature (374)..(374): n is a, c, g, or t
ccgtccnccgggatgggggtgacaccctcaatccgcccgaccttcagacccgagcgggccagggctctgagggccgactgggccccaggcccaggggtctgggtcctatttcctcctgtggcccggagtttgangtgtngggcggtgatacccagctccttgcacctttgggccacancctgggcagctaacatagcagcntagggggaggattcaccttggtntgcctttaccttcaccccaccagtnacacggcaganggtttccttgccagatagatcagtnananggacaaaagtnttattgaaggatgcgaagatatggcagaaaccaaaaacattctctncttcagccacctgaggtccgaggctgangaactgttcttccttcttttccttcccctttcgaggggccactcctgcccgt

SEQ ID NO: 670687 - DNA, 267 bp, Homo sapiens
gggggcccccccccttttggggttttttccgggtttataagagttggggggccggggggaaccttttcccccccaattttttgcccccccccccccacccgggggggggtttaaattttggggggtttttttttttccccggtttggggggggcccccccggggttttttttttttggggcccggccccctttcccgggcccaaaaccggggtttttttttttttttgggtttttttttaaaaaggggtcccccttttttggtttta

SEQ ID NO: 670688 - DNA, 422 bp, Homo sapiens
cacacctgagttagcaaacacttttaaaacacttctacactcttcggagctccatgcctgcttctggactggagtgccatctgcaggtcggtccctgatcccccaccatttggtgcctctctgagatgtgattgtcccatgccctaccccaccccgggctcttgttctccagcgcagatgccagtgtcctcaagaggcagtacccaggtccatttgctcgcgtggccactcccccaagagcacacttccagcctgcacagggattgggcgggtaggttgcagaagctggagtgcagtgagggccagcgtggcccctggtcagaaagtcgggctctggagtttgagccccagtcctgccaacaattttgccgcatgaacttgagcacgtgtacctccagtctaccttggctggtgatcatgag

SEQ ID NO: 670689 - DNA, 202 bp, Homo sapiens
  misc_feature (152)..(152): n is a, c, g, or t
  misc_feature (177)..(177): n is a, c, g, or t
tacgtggtgtaccgtatgttcatctggtatccgctacttgctgaatatgtgatcagttcaagcagtttctgggtgagtccttagggttttctatatccagtatcatgtctttgtaggcatacggtgacagctttaccctcttctcttcctangttggatgcctgtttatttctattngttagatctggttgcatgtggctag

SEQ ID NO: 670690 - DNA, 236 bp, Homo sapiens
catcagtagactctgctacaattatttgttttttcttcaagtgacagaatgggtgggatccaaggaatcaaagcagtagtatggacaaaccagagagcatccccgatgttattttcatggaaactagagtcagcaataacacaaatggtacaactttccaactcacaggaattcttccacacaatcttaacttttagtcgtaatctcagggtatgcccatagcacctccctttctg

SEQ ID NO: 670691 - DNA, 442 bp, Homo sapiens
ctgtgcctggattcgggaaagtccgacggggatctgccgtgccatcgcgccttgccttccggccaccttggagttgtccaaggggggcttggcaatttgcttgccgtcttgcggcttttcttcccaagcaatcgtgacgctggccaccgtagcgccctaccttagcggggcgtggcccgtcagcatctaggcgcgaagtctagattaatctcggcaatggctgtgctggagaggggcgctggttcaggttcgagaaccgatccagttttccgtcttgcactcctagcacggcccgcagctcgcccacactgaacgttttgctggcgacgtgattgaggttcacaaggctggcgacgtgctggaacagcagaatccgaatacttggacgacaaggcaaacacagttggccgatccatgattgcccaatgacaggaaatctcgg

SEQ ID NO: 670692 - DNA, 102 bp, Homo sapiens
tacaatcgagctcggtaccgttgcagaacgaaatatagtctgcatgaacgttgttgatttggggttatcacctagggcccgcgcgaggctgcttgggtgtga

SEQ ID NO: 670693 - DNA, 406 bp, Homo sapiens
atgccacacatacacacaccacacatacaacacacatgccacacacaccatacacaacgcacaaaacacaacacatatgacacacatgacacacatacacacaccacactcacactcatactcacaaggacagatagtaatcctgaaacattctcttctaagcccataaggaagaactcagatggcagctgcctcttcctcttcagagtcaggttgagaaacactaaacttatagcctaaaacccaggttttgggctccacaggcagagaggcaaatacagtcaatcaccaagatctccaacacgaaaaggcccagtgctccaggaaggacgtgcttccagtctctagaaggtactgagtgatagcaatgcacccaagtcacgacagttttaaagttcttccatgt

SEQ ID NO: 670694 - DNA, 635 bp, Homo sapiens
aaactttaatgatatcatcttgtataggcattgcagaatttcataggccacattattaagcgcctaccccgccaaaataaagatggttttccagcagaatttagtgctaatcagtgctcctgaagtcgtacacagccgctggaaatgttgcattttctctgctaggcccacggctgggcggttaaatattgtttttttctccattagaatttgatgttatcaaagctcccatacccattcactttaagtttttaggagaacctcttcacagagttaatagcgcagatcttttagtaattagatcatttcagatgtgcctgaaatgagtaccacatgtggatgagtttgctttttccttcctttaagttcggtaaaaattttaaagagaggaatgccagttacctcttgcccaattttttaattaaataattttagcaatgacgtagaaaaataatttttaaacattgtcgtaaagaacttttctggacttggtgcctgttttaagacattggaagttcatgataagctgcatatcttccagtcccatattggtaaatctgcctctcaatgtcgaaaacaagagtcctggcccttattgaaaagagttcggccttaacccattctcttccctcgtg

SEQ ID NO: 670695 - DNA, 347 bp, Homo sapiens
ccccccccaaaccgggccctggaaaaccccccgtggggggtttaggccccccagggcccctaccccccttagggggccaaaacccccaggggttttaaccaggccccggccaagccttaggggaggattggccccccggtgggggccccggcccccaaaattttttaagggggccctaaaaaaaaaggggcccaaccggggcccccggggtttttcccccccccaggccccttgggggggccgggggaaattttggccccgccctttccggtcaagtgaccccggcccccccgggaaaaaatttcaagtggcccccccccccccgggaaaaaaagtttttgccggga

SEQ ID NO: 670696 - DNA, 216 bp, Homo sapiens
ttttgtttaaaaaaagggcccattttgagcctttggatagggacattcctgtttttgtgacaaaaaaaaaactttaaaattgtccccaacaaaaaaaaaatggctatcaaaagtatgttttgttttagtgtgagttcccgttcctgtatttgtttattgtaaagggggacatttagggttcagggcagttttcaataaaaagtaattaaaatttta

SEQ ID NO: 670697 - DNA, 160 bp, Homo sapiens
agccggaccgcgatactcagattaagctttttctccatctccctacacaaccatgtctcctttcatctgtcaatttctgggggttgaatttcccaacttcagtagaaatgatataaaaggcaaccgctggagtgtaccataaggagacacaagaagaaag

SEQ ID NO: 670698 - DNA, 937 bp, Homo sapiens
cttaaaaaaaaaaaaaaccaaaaaaaaacaacccggtaagcattggtcccttccccactggacaaacttatcaaatccagaaagcttgaaagttgcgtctctaattatttttctcctgaacaaaattacccaagtcaaaacaacaatgtatttttagaattacggcagcatacgacctgaatttggggagttcggtgggctttatcttaagatcaccatttccctaaaaatgggtttctttctccttagaaagggctggggggcaacttgatgaaacagccaaatgcaccagggcaggtcactttcccattgacaaacttatcaaatccagaagctttagagttccgtctctaataatttttctcctgaacaaaattacccaagtcaaaacacaaatgtattttagaattacggcagcatacgaccgtgaatttggggagtaacggggctttatcttaaatcaccatttccctaaaaagggtttgctttctccttagaaatgctgggtggcaccttgattgaacacagcaaatgccccagggcaggtcacttttccccattacagttgattccccatttaaaaagaggaggaacgagttcatggacatagacagggcaaagggcataaaggccccttttcaagaccattgggaggcagcattcattttacaatctgtacttaccggtgaaaggagttcgaagcccaagagcacggttaggggccggaaatgtgagggggtctaccagggctcgacaacggcgaactgtgacactctcacccggctaggtcaagatggcccgttaaacaggactgggcgcgggggttaagaaccaatcagccccaattgggggactttcaacaccgccagcattaacaggatatgctcaacacaagtgttctctacagaccataactacgccgggtcgacatcacaaa

SEQ ID NO: 670699 - DNA, 163 bp, Homo sapiens
gataaacagcataaactcttaaagcaaccaccaaaataacaaagagttataactaataattcagcaaaggagataaaatgaaattaggccaggtgaggtggctcacgcctgtaatcccagcactttgggaagctaaggcaggtggatcacttgaggtcaggag

SEQ ID NO: 670700 - DNA, 860 bp, Homo sapiens
  misc_feature (236)..(236): n is a, c, g, or t
  misc_feature (516)..(516): n is a, c, g, or t
  misc_feature (686)..(686): n is a, c, g, or t
  misc_feature (692)..(692): n is a, c, g, or t
  misc_feature (696)..(696): n is a, c, g, or t
  misc_feature (710)..(710): n is a, c, g, or t
  misc_feature (713)..(713): n is a, c, g, or t
gggcagacactgaccttcagcgcctcggctccagcgccatggcgccctccaggaagttcttcgttgggggaaactggaagatgaacgggcggaagcagagtctgggggagctcatcggcactctgaacgcggccaaggtgccggccgacaccgaggtggtttgtgctccccctagtgcctatatcgacttcgcccggcagaagctagatcccaagattgctgtggctgcgcagaanttgctaacaaagtgactaatggggctttactggggagatcagccctggcatgatcaaagactgcggagccacgtggtgtgttcctggggcactcagagagaaggcatgtcttgggggagtcagatgagctgatgtgggcaagaaagtggcccatgctctggcagagggactcggagtaatcgcctgcatgggggagaagctagatgaaagggaagctggcatcactgagaaggtgtgtttcgagcagaccaaggtcatcgcagataacgtgaaggactgnagcaaggtcgtcctgcctatgagcctgtgtgggccatgggtactggcaggagtgcaaaacccaaaaggcccaggaagtacacgagaagctccgaggatggctgaagtccaacgtctctgatgcggggctcagagccccgtatattatgggggcctgtgatgggcacctgnaagagntgcncgcagctgggtggntgntcctggggggggtcctcaagccatggggtttcatgcaaggggcccctttctcctctgcgcggtagcaccatgctccgttttgggtgcccgcgcccgttttgttccgggggggcccccctggggagccggggggggggcgggccagcc

SEQ ID NO: 670701 - DNA, 784 bp, Homo sapiens
tgggttgaccccggggtactttatggagggtacataacaagggggggtcccctaggcccctccccttttacagggggtctaactggaactggtgagggaggggagatccaggtggtgggtgggggactgaagtgtgtgccagggacctccccagaagttggagggtctctctcttcctctggttgcctctgcgtggggcgtggttggctccaggggctctaacctcctttggaagcgccatgttgggccatatgagggtccaccacccgtgtgtggcgtgtagcccaaatctcggtgggtacaattaccaggaaaaggaagcttgacaaagtgggctcgttagtgagggcaagtcccagccccaggcgtctcaaagggtggaggcagtggggtgctcgctgtagaagctacagaggaaaaccaccccgtgggagcatcaggtgataaacccaagaggatgcccttagaaggggagccccatacagaaagaccgagtcaatccacacacactctactagaaaggataccaacacaacatagaggaaaagagataataacactagaagcggcaggagctacaagtgctacacaccacaatgtagaaaaaagcgttagtgagaaacggggggaaaacacggggaaaaggacacacatgacaaagagtaaaaactatacccccggataaaaggaacacagggacacatacaccttgacccaacaaaagcctattgagaagacccccgaggaaaaacggcaaggacaaaaaaggctcacgaaaaaaaac

SEQ ID NO: 670702 - DNA, 275 bp, Homo sapiens
actggactggaacaaaggctgattacagagatccaagccatgaggagtacataggtgtggtgcctatagccaggtcggaaactttccagactaacctagatgctctactatgagggagtcaacgacctattgtatcaattagatcccagcctggtacacgggcttgactattgctgtttgtgggacacgtggctctgtgttgcaggccatgactgtgtggctgttgcctatgtggcctgttctcccctaagccctgaaccaaaggttccaggcgt

SEQ ID NO: 670703 - DNA, 565 bp, Homo sapiens
cccgtggcgcggactgggctcccggtgtaaaaagtgcgcttgtggctgctgctgtcttaactcctgtgcttggcggacagacaggcgagatggcggcggaggctgttgcctgaggtgcgaggtggcaagtatagtgcgggcgcccagacggggagccagtagagctgtacgtggtccagtatctccgaaggtgaagctacagagtccaggcaacatgcgcctttacctggttattgagaccaaggatttccacaaaaccccgggaggaggactctcaacgggactccgggcgagtgtgaacacgaaaaataggtcttctccatagtggtggagaaacacatcttttgggagcatcgtgggacgccctcctcaatagtgccaaccacttgtggtggccagggacacttgttgggggcacatttgttgaaccaagcaccctgctggccaacatgggaagtatatgatgctgacattgttcaaccatgccagccacctattttcagatgtatcagttgagagtgaactggctctagagagtcagaccaaaattacagagcaacagacg

SEQ ID NO: 670704 - DNA, 388 bp, Homo sapiens
  misc_feature (2)..(2): n is a, c, g, or t
  misc_feature (6)..(6): n is a, c, g, or t
  misc_feature (264)..(264): n is a, c, g, or t
  misc_feature (338)..(338): n is a, c, g, or t
  misc_feature (382)..(382): n is a, c, g, or t
cngagnctttctgggttccagtgttctaatacagaaaatgagaaagttgggctggaatcattgtgtcccaaaattggtacactttccgctagtggcatgtgacttgactctaggcggtacgtggatgaggatttttttgtaataggatgtttttgcaatctgtatttatatatgtacagccatggtttaaggtagtgatacaaaattttcttttacaatacttttttgattttaaaaagtcgagttaaaaaaattaactgtagncaaaaagttaatgtactctgtggaatatgggggaaaaaaaaaaccccatggaagttgggccaagtttagttacntggtgttttggggacccccctggggctttaggaaagtagggaantctgga

SEQ ID NO: 670705 - DNA, 175 bp, Homo sapiens
aagggaaatgcaaagtccgtccctgaggcacaagaggcagctccgcccctgtaagtgggaagccaaaatccacaacaggcaaggcccagtgagcacagcctatttcagtctaattccaggcaaaggtctatgaacagaggttcctattccagggagctggaaggaggcatagtat

SEQ ID NO: 670706 - DNA, 592 bp, Homo sapiens
  misc_feature (529)..(529): n is a, c, g, or t
gtcacgcccacagactcccaaagtgctgggattacaggcttaagtccactgtgcccagccttagcctggccatcttctaagtgcttacaatagctcactggatccacacatggtataaaaccctatgaggcaggtgctacagtctccattttacagatgaggaaactaagggttagatgtcaagtagctcctatgaggttatgtaaggggaaggggggcagtttggagattagacttggggcagtctggtttcccacttctgcttagtcccctgcttgccacaaagtcagtcctctgtgtgtgccacctttgtaatggctagtcaagggcctcggcttccctgaggaagtgactgttgagcggaaatcagagaggccacttgtcttcagtcatcccctcaccttgggggtgaaaagggtagagcagaggccagcttgcttcttggcagtgcctatggagaagggctgttttttgaaagtgccaggtcggggggagggcatcttgctatttggcttcttgacttcccaanttccaggagccagaggaaccctggctccagtcaaatccagataggctgagctgacaagttagt

SEQ ID NO: 670707 - DNA, 181 bp, Homo sapiens
tccagccccccagctaccccgtcccacagttatggaagcccctggctgctgtctcactgctgggccaagcgccaaatctcgctaagtccagcgcccaggagggaaccctgaacgcctgacaggagttaccggaggccacaacatccacgctgcagttgcgctctccagagacaggggtcca

SEQ ID NO: 670708 - DNA, 199 bp, Homo sapiens
  misc_feature (179)..(179): n is a, c, g, or t
gccatcgggatgtcctgattcaacactcgaggatcgtaaatccctacttgttgatatggacgtctagaataggcttgcgctgttatccctagtgtaacttgttccggtgggtctcgttattggatcaactgcgtatattagttcgctttgactggcgaagtcatagacatgcgtgaacnatctccggggtaccgagctc

SEQ ID NO: 670709 - DNA, 144 bp, Homo sapiens
ccaacattgcacgacgaaaagtgaactcagagaggcgtaccctatccacagcttttgtattctgctcttctttccttttctggtgagcttcatgggtggagttatcagtggtctgtactgatatgtctctgacttcctgctggg

SEQ ID NO: 670710 - DNA, 142 bp, Homo sapiens
agagtactactggggtgggacggaactgtgccccagagagccagtgtggctggggccgcgtagtggactgaacacagtgctggcgtctgctctctgggccccgcctcgcctgctgcagccttggaaggccctttgcccctcc

SEQ ID NO: 670711 - DNA, 416 bp, Homo sapiens
  misc_feature (19)..(19): n is a, c, g, or t
  misc_feature (23)..(23): n is a, c, g, or t
  misc_feature (64)..(64): n is a, c, g, or t
  misc_feature (74)..(74): n is a, c, g, or t
  misc_feature (95)..(95): n is a, c, g, or t
  misc_feature (139)..(139): n is a, c, g, or t
  misc_feature (162)..(162): n is a, c, g, or t
  misc_feature (268)..(268): n is a, c, g, or t
  misc_feature (271)..(271): n is a, c, g, or t
  misc_feature (274)..(274): n is a, c, g, or t
  misc_feature (278)..(278): n is a, c, g, or t
  misc_feature (280)..(280): n is a, c, g, or t
  misc_feature (282)..(282): n is a, c, g, or t
  misc_feature (286)..(286): n is a, c, g, or t
  misc_feature (292)..(293): n is a, c, g, or t
  misc_feature (296)..(296): n is a, c, g, or t
  misc_feature (302)..(303): n is a, c, g, or t
  misc_feature (311)..(311): n is a, c, g, or t
  misc_feature (314)..(314): n is a, c, g, or t
  misc_feature (322)..(324): n is a, c, g, or t
  misc_feature (343)..(343): n is a, c, g, or t
  misc_feature (353)..(353): n is a, c, g, or t
  misc_feature (355)..(356): n is a, c, g, or t
  misc_feature (374)..(374): n is a, c, g, or t
cactaagtagtaagatttnaatnaaacacgaccaggtccgaaatgcaggtcatgagtgtgaaantctcaaattnacataaaaagtagaagtatanacagtttaacatttggtattaaaggagaggaaattgtagcagcntttcacgtttcccagtccccatnagagggcttgagaccttgtacctgaacaacccattttgcactcagtgctttctgatgccttaggagaattgtttttttcacaaaagctgggaaggaagaagtccantcngcngctntnanatcnccctcnnagnaaaaannactaactnttntttttgtnnntggctttcatcagtttgtnagatttctcnannttttttaaatataatttnatttctttcaacaaatataaaataacaaccaactttggaaca

SEQ ID NO: 670712 - DNA, 227 bp, Homo sapiens
  misc_feature (1)..(1): n is a, c, g, or t
  misc_feature (5)..(5): n is a, c, g, or t
nctancttgaaacggagatcacaactagcctggggctggctggaattttctcccggcagccgtcagcctcccgtggaagggagcggcatctcagtgtgcgaagccctttgtatacttgcctgcaatgtggcttttatttctgaacaaaggaaatgttttacctgctggtgttcctttaacaaataaatacttggctacaacacatgtgacagaaagcccacaacagt

SEQ ID NO: 670713 - DNA, 305 bp, Homo sapiens
tgctgctggaacctgacgcttacggcgcaagggtatgcgatgagcggatccttcctggccctcgggttcgtggaaggctataactggaacctgacgctacggcgcaagggtatgcgagagcggaccttcctggccctcgggttcatggaatggcctaactggaaccaacgctaacggagcacgggtatgcgagagcggatcttcctatacaggacgtggaagatgtttcgtttggagtcctcgaagtcctcctccatgtaattggccaggtagcttaggacagaaatcaggtagcagctcagggg

SEQ ID NO: 670714 - DNA, 248 bp, Homo sapiens
  misc_feature (162)..(162): n is a, c, g, or t
  misc_feature (214)..(214): n is a, c, g, or t
accctgaccccaccctccggacagctcagggagtgttttcctgtgagggcctcccccatcagtggaccagagggagaaggcccgatggccccattcccgggctttcccgtaacggcacagggacacgtgtgcaattcataggaacgggcccagatcgccctnatgagtgccacctgggtacaggtaggttggcgcttacgttcctgcccaaatncagcccatcgggagttacagtcagtccccccggg

SEQ ID NO: 670715 - DNA, 234 bp, Homo sapiens
cagtcgacccggtacccacttgggaggcgaggaggcagatcaccctgagtcggagttcgggactagcctggccaacatagtgaagccttgtctttactaaaaatataaaaatcaggcgtggtggcaggtgcctatagtcccagctattccagaggctgaggcaggaagatggcttgaacccaggaggcggaggttgcatcgagccaagattgtgccactgcactccagtctggg

SEQ ID NO: 670716 - DNA, 175 bp, Homo sapiens
gatagaacaggctttggtcaatggacatgcaggacagtgaggagacaggccatgccatacaagtgcatgcagctcactgattacatcctcaagttaccgcacagatgcccaccaaaagtatgtccgacaagcctggcagaaggcagacatcaatactcatgtacagccagggagt

SEQ ID NO: 670717 - DNA, 474 bp, Homo sapiens
  misc_feature (83)..(83): n is a, c, g, or t
aattgagtaattatattacttttcttgaaaactcccaactagatcatcacttaatttaatttttctatcttgattatgtgttntcttcccctgttgtattctgctgagtaatggcatgattggaaagcaggtgcccacttaagttaaagcctggctacacaggtgtagccttgaagaagttgtgagccttatcgagcctcaagtttctaatgtctaaatggggccactgattcttcactctgggttgttttgaaataaaggagatgtttatgtatgtccacatacagaaacaaatggatatgaacgtacctcagtggagagttagtgccttccccttacccaactccatgaactctgaataatcattttgtttgaactgggaggcaggacaggcctctgctctcggggaggaaggcactgacccctctgcagtctatccaggcaagtagctctgaagagaactgaaatgagacc

SEQ ID NO: 670718 - DNA, 1002 bp, Homo sapiens
  misc_feature (385)..(385): n is a, c, g, or t
  misc_feature (643)..(643): n is a, c, g, or t
gatttctgttcggggcccatctagtcctggacacggcatgattgttcgtccgactacgacttgacgacggtgttcagaattttagcagagagtctaaattgtctataagaatagctttaacatacatgaagcgcaattcctcggcaaacgtgtaggtggatcgcagaaggcatttccgggaaagcagctgttaaatgaggcttcccgccggatgtgatttccatttccgatattgttgaaacacacgtttagacacatgaacccctattcatatatgtaccatggcgacgattgctgtgtgatactaaagacctagttgcactgcgagtgacagacgccagcttggaccatggataagttcagagaccagcaaagtcgacgcaangacctcaatatatctatatttaacgtagagacatgcattggaacgacaccaggtagaagtaggctatcagaaagaggtatcaccggagtagtcactgagcacatggtcagagtcagagaacattgcccattctataatttccagagacaccctcatttgcaggggctaataggggacaaccagtgtgtgggatagcatgcaagaaattggcttactaggccacgtttgagccaagtagagcaatgctggcacactcgngaacgtatcgcctcgcgtgtcaaacagattctcatggtgaacgccattctcgcatctgtctcattgttagccatccttagagatatggcgcgcttttcgagattacctctgtgcatactgtgctacatcatgtaagtcgtccgatttggctgaaccagtacacggctctagcgcttacctgttgacccaatgcgtatgtctacacagagacgatctgtttcccttggcatgtgaccagttctactcgtcaattatgcatgattacttaccggagtgtcacagacttttgcagtcctccaggtgtttcaaaatcttttccactgaattagactgtgacctctagaagtacaagtcactga

SEQ ID NO: 670719 - DNA, 104 bp, Homo sapiens
tccagcaggtactttgtgatccgcatcgaaaatggaaatgggcgacgggcgtttattggaattggcttcggggaccgaggtgatgcctttgacttcaatgttgc

SEQ ID NO: 670720 - DNA, 1133 bp, Homo sapiens
tgtgtgtgtgtgtgtttttttttttctctctctctgcagcagcgggggggggggggggagagagagggaggagaaaaagagagggtgggggaagagaaaaaaaaattgtgtgtgagagaaaaaagaagtatgtgggggtgttgtttttgtgtgagagagagagagagagaagagagagggagtataaatatagtgtgtgtgtgtgtttatttcacacacacacacacaagtagtggtgtcggcgcactctctctttctagaaagaagagagaggaggaggagggggggggagagaaaaaaagaggggcggcgggggggaagaaaaaaaaaaagagagagggggggcggacccacaaaaacaacacaccgcgcgggggggcgaaaaatagcggcggacccaccactacgtagtgaagaaagagagaggggacgcccacaagagaggagaggagagtattaacaacaaaaacagaaggagagagggcgggcgaactaacaacacgagcggtggaggagaggagaaaacaaaagaaagaaagaggaggagaaaaaaagaggagagaggagaagaacaacaaagagcaggggggaggaggaaaaaacacaggaaggagaaaacacaacacccgcacagaaagaacaaaacacccccccaagcgggaaaacaaaaaaaaacaaaaaaagaaacaaacaacgagtgggaaaacaacacacaacggaacaaagaagaaggagagaacgagcaaaagaagaaaagctggcgcacacaaagcggtgaatagctaaagaagaaaaaaaacaataaaacacgaggcggcggacaaacacgaaacgaacaccaaaccggaacgacaaccacgacgacagaaaaaaaaaacaagcaacccgaaaaaagaaagcaggagaagagacaacgaaagaagaagagaagaaggcaaaaaagacaaagacaaggagaaaaacaataaacgacaaagagaacaaggcaaaaagaacagccagaagaggacagagacagagaagacaggccaaaacagagagaaagggagagagaagcgaaaacaaagaaaaaccaagacagcacggaaaggaaagaaaaaaaagagaaacagaaaaacaaagggagcgacggg

SEQ ID NO: 670721 - DNA, 277 bp, Homo sapiens
gcttttatgcttgtggtcgtctctagcaggatcccccggagacacttacgagcagtacatgcctaagacttcaccagctcaatatgcgtactactatactctattgatccaattacttgaccaacggaacaagttacccttgggactacatgcgcaatcctattctatagtccatttcaacaatagggtttacgacctcgatgttggatcaggacatcccgattgtgcagccgctattaaaggttcgtttgttcaacgattaatgtcctacgtgatc

SEQ ID NO: 670722 - DNA, 221 bp, Homo sapiens
ggtatacttactttgagagaatgagatgtgtcactggcgacactccaagctatctgatggatcctcacactggacacatctgtatgatcacattctgaggctctagcaatgcccagtgcacagatactgtctatccatggctctgctcctaatctacatgactcatgagaatacgccaatgtgtgaccaacgcatcaattagctcacagtacttgcagcac

SEQ ID NO: 670723 - DNA, 150 bp, Homo sapiens
ctaactcgtgtggtgtaagcaatcgttatggtgtctgagagtctgaatcttactgggttggtgaagatccacatacaaatattagaggttatcctcattgatccattccataaagctatcagagcaccagcacgaattcaggactctcag

SEQ ID NO: 670724 - DNA, 491 bp, Homo sapiens
gagcatggttggggccaggtgtggtggctcatgcctgtaatcccagcactttgggaggccaaggtgggcagatcacgaggtcaggagatgaagaccatcctggctaacacagtgaaatcccgtctctactaaaaacacaaaaaattagccaggtgtggtgcagtacgcctgtaatcccagctactcgggaggctgaggcaggggaattgcttgaacctgggaggtggaggttgcagttagccgaaatcgcaccactacactccagcctgggtgacagagcgagactcttgtctcaaaaaaaaaaaaaaaaaaagaacagcatgattggaacatccaattgtgtctgcacctttagacccatgtccccattatcgtgtgtttctgcgtttggtttttctgatcccaaatgtggaacatccttctattctttctgtgcattttgtcacagcacttacagtccagcactacaatgtatgcaggtcattttaaat

SEQ ID NO: 670725 - DNA, 1133 bp, Homo sapiens
gaccaaactcttatccgaattatgcgcgtgatatcggccccccctggtgttccaggtccgccgtcctgcgcaaccacaaaaagggcgcccaagccgggggcaaaagggacaaccaagtgcgacccttggaggcccccacggacatagacccctggccccgcaaaccggcggcccctggttcccggggacacaggccaagcccctaacctggaagggagccccctaaagggaccaaggggccccgggaccccacagggcctgtaaatgggaggagaacctttcccgttggaaactgcctaactgccccagacccctagttgccccccctccacggattgaggattcacggaatataaaggagggaaaaggctcctccaacctttcgggaaaaacccaagacccgcgccaaaaggtaaagatagggcccctgaaccatgaagatttgccccccccacccaggaaactcgcttgaaaggccgaaggaaacccaggattttctctggccttcttccccaaactttttcccccccccggaaccctgagggggaaactaaattctggagtttcacctcccctctctcggttgaataacccacacccccaaagggagaccctcttctgagagtaaagaccgcgttgaaaactcaagagagagtggaccacaggtgtattccaccggaaactttctccacgcacttcccgcagtgagccctctggaataaaaaattggcaccaccacactccacagtggcacgccaaaatatgtatccccgccccaagagaatataaaaagagaatccacatattcttaaaagagaacacgcttttaaagtggcctctttctgccacactttttcaaggaggcgccacaagaataagagatcttggagaataaggagaataaaggctctataggtttcttatacacacaccgagcacttcctcaaccagagtttaagagaaaaaagtttacacaacactaattctagtgttacacagagaaaattcttgtgctaaaataactctttttaaaagttgattttgaataaccactctaaaactcgcttttttttttccagcacagtatcccacccacttggttctgcttcaataaaatctttgggaaaactcca

SEQ ID NO: 670726 - DNA, 339 bp, Homo sapiens
gtggcgcgaataacctagtatttctcaaagttgttcatgcatagatcacccagagggctttgaaaaaaggcagtttgggccaggcgccatggctcactgcctgttatcctagtactttgggaggccgatgcgggtggatcacctgaggtcaagagttcaagaccagcctggcaaacatggtgaaaccccatctctactaaaatacaaaaattagctgagcatgatggtgggtgcctgtaatctcagctactctgggcagctgaacgtgactctgtctcaaaaaaaaaaaattgtatttggtgggaccttattcaagaccaacacaatcaaaatctctag

SEQ ID NO: 670727 - DNA, 140 bp, Homo sapiens
  misc_feature (33)..(33): n is a, c, g, or t
  misc_feature (78)..(78): n is a, c, g, or t
  misc_feature (105)..(105): n is a, c, g, or t
  misc_feature (122)..(122): n is a, c, g, or t
cggtctagcgcggggctggacaaagtcatagtnctgtggacggcgaacacggagcgcttctgtgaggtgattccaggnctcaacgacacagccgagaacctgctncgcaccattggagctcngtctggaggtttcgccct

SEQ ID NO: 670728 - DNA, 115 bp, Homo sapiens
tattcatatttgtcaagccccgacacgagagctcagctctggacaaaacaatgccgtgcgcaatgtttagacttgactgacacctactgtgtgctccgcgctactgcccctcact

SEQ ID NO: 670729 - DNA, 848 bp, Homo sapiens
gccaaaatccatttcatctatacatattccatcgaacgtaaatctaactttcttcccacaacactttctcggcctatccggagatgccccgacagttacgtcggactaccccgatgcagtacacctacatgaaatcgatcctatcagtctgtaggctcattcatttctctaactagcagtaatattaagtaattttcatgatttgagaagccttcgcgttcgaacgcagacagaagtcctaatagtagacagaatccctccataaatcctgtgagtgactatatggatgccccccagcctagcacacattcgaagaacccgtatacagtataatctagacaaagaaaggacggaatcgaagccccccaatagctggtttcaagccaatccccagtggctctccagtgacgcaaagaatacacacaatcaatcaattcagcacgaaacccttgtgggcagtgcgcaagggtcctctcggaacatgcgtttgtgctggaacccatgcttctttggggcccgccgggctgcaccctgggaggttcaagtcgtaaccctggcgcccttgtgccgcgtgatgtcgcccagagagagagacactcgtgcgtcgacgtgttcactactgggtgctggggagtacctctctccacgcctatttctttacaattagtcgccccgcggggggggctacacgcggagacggtcttctttgtacgcccaaccctcccgagtgagggagggtcttctaggggggccccctatgaagcgaggagcctttttcgtacgcggcggggttcccccagagacgaaggctgcggctattctaggtattccgcccggcggcgggttga

SEQ ID NO: 670730 - DNA, 424 bp, Homo sapiens
ttgagggagaacatatcaatatggagaacagatctttgcttctcaaattcaagaaaaaccattaactaatctatcaatttttctccaatacagtgtgccagagtgctctgtgaagaatccttttccatccctaccacatgtctgggtgaagggaggggagggttggtaagctgccagtacactagcaggcactcctggtgatgctctgggctctgctccctttctgccgggagtagcaggcatcttttctagccgctgcagcagcttgatgttgtggggaggaaggggccacccaccaatcacctcttcttgaagctgcatttttttgtgttcatagaagaggtctgtcttaggagctccccaaattgacaatctttggggcagccatctctatccttctcctagatgggtgcactccttaaca

SEQ ID NO: 670731 - DNA, 690 bp, Homo sapiens
taatattaatgcaaatttgatgcgaaattatggtcaaataaagattttctcaggggtcaagaaaatcagcttgaatgtcattcagcattattgaagaaggatgacttcccttccacttattgcacaaactgttggtagcttgtgagacaaatacagtagcacagtccgttcgaagattggtccacaaaaattagtccatattttaggggctcagtgtcaagagttccctcccgtgtgcccccactgttgcttctgcagtgatacgaaggatgaatgcttaatttcttattagtcagaaaacttgaatgcaacagtggggcactcaagaaataattccagagaggtcataaccctatttagccactttgaggtggtggcctcgtgggtggtcgtgctaagaaaaaggtagctatggaaacaaacagctgagagctatgagtggtgggttcacgtcattctagaagccatttcaattttcctcccgaaaaccccccagttggctcaccgagccccggaccttaacccacaagcgtgccacgctcaaatggcgctgattcaaactcccaggtacgtccctggcacccgggagtcaggataagaaaacctccagaagtgaaactgatgaggaagtgacctttaatcactctcaaacggagaattcactggcaaggtctaaaccccagggccaag

SEQ ID NO: 670732 - DNA, 268 bp, Homo sapiens
caggtcttttcccctcaaaaagaaaaaaaaaaacacaacttactaggaatggtgaaatatacctgttagtcccagcttcctggagaggctgaggcgggggaaccccctgaacccaggaggtagaggttgcagtgagccgagatcacctccactgcactctagcctggacgacaggagcaaaactccgtctcaaagaacaaaaaaaggtgattattggattttagtaccctgaaagtccttggtgaattttggcgagagcagctttctt

SEQ ID NO: 670733 - DNA, 504 bp, Homo sapiens
tttttttcaagggttttccaattaagattttatttgaccaacaaaacatactcatatgaaaatataaataaggtaaaaggagcagtgtagtcattatgatctaaaacaatatttttcaaattgtaggttgccagtcattctttgctgggtcataaaataaatttttttggttgggactatactttaccaaataataataacaaaatcaacaggagagaaaaaggcaaatatcagtgtatattgcaggtaataaaatagatgttttcataaaatttttgcagaacaaatgtatgtatgcactacatgtcaatgtaaagtgtatggcttactacaagacagggctaaaaaatgtttgaaagacacaatacagatgattatagaagaaagttaatattaagttgaatgattaaggaaggtttttggaggctgaaagtacataaataaagcttaaaggggatgggatgcctttttagatgaaaagctgcataaaatagttctataatt

SEQ ID NO: 670734 - DNA, 598 bp, Homo sapiens
  misc_feature (363)..(363): n is a, c, g, or t
  misc_feature (422)..(422): n is a, c, g, or t
  misc_feature (426)..(426): n is a, c, g, or t
  misc_feature (447)..(447): n is a, c, g, or t
  misc_feature (450)..(450): n is a, c, g, or t
  misc_feature (453)..(453): n is a, c, g, or t
  misc_feature (465)..(465): n is a, c, g, or t
  misc_feature (493)..(493): n is a, c, g, or t
  misc_feature (507)..(507): n is a, c, g, or t
  misc_feature (512)..(512): n is a, c, g, or t
  misc_feature (526)..(526): n is a, c, g, or t
  misc_feature (539)..(539): n is a, c, g, or t
  misc_feature (572)..(572): n is a, c, g, or t
  misc_feature (575)..(575): n is a, c, g, or t
  misc_feature (580)..(580): n is a, c, g, or t
agacgttttacttggtgcgcgctggcatgtgctccttcctcctctggtcgcgtctcactcagtgtaccttctagtcccgccatggccgctctcacccgggacccccagttccagaagctgcagaatggtaccgcgagcaccgctccgagctgaacctgcgccgcctcttcgatagccaacaaaggaccgcttcaaccacttaaacatgaccctaaacacaaaccatgggcatatcctggtggattactcaaagaacctggtgacggaggacgtgatgcggatgctgaatggacatggacaagtccaagggcgtgagaggccgaccgggagcagatatacaatggtgagaagatcaactacacngagggtcgagccgtgctgaaagtagttctgcggaaccggtcaaacacacccatccttgnaganggcaaagatgtaatgccagangtnaanaaggttctgganaagatgaagtttttatgccagcagtgtncggagcggtgactngaaanggtacacaggcaanaacataacggacntaatcaacattagcattggcggctccgaactgnganccctnatggtgactgaagcactt

SEQ ID NO: 670735 - DNA, 1155 bp, Homo sapiens
gggtagtcacacagtttgtgtatacggcatctattccagctttactgtgcaagctggggggtcacgtcccacggatggagctccccaggcggactcatagcaggtgagtgctgaccgcctgtccggctcggacggagtgtcactggtctggctagggctgggataaggactcttgctgccaggcgatcgtcagattctcttcgtgcattttaaggtgttgagaggagacacaagaagttcctgcgcgcatggatggagagtggatccttagtgacccagtgagcagggaagaacgcagagttcctggtacccaaggaatctggttgccgtgtgtttactcagcgtgccttggtagagctgggttacgggcactggatgacaggaacgtgtaagtactttgggggcaagagaagggacgtctacacttgggaaaacctagtagggaaaccagggattgctttcaattggaaaattgggtgcgtctagtcctgtgtgacggaattgaaaggtcatatggtgactgggacgtttaccaacatggacacagggaacttgcatttttcggcaacaatcgagccacgtaggagtggaaagatcgtcagattggggcgcaagagttgattcagatggcaccgggtattggttcgtggcagtgcactcgaaaatcgccagaggatggttcggctaggggaggaaagacgaattggttagcgaagatgggccaaggaactggggggttaaaggcaatggacgttaaatgggggagacctattatacaccaagattgttgctaccgaagcgtattctgttcaacgaaggaaccccgggacgttcgggggagttaaaagccaaaggacgcttggtaactcgcggatacggtttcccaagaaaacgattcgcgcattcacaaagagaaagagtacacgccgggtatggtgggtctgggacaggaaaaaccggcgatttcacaaaactgaattatattgtgaagttgtaaattttacattgggaagcaaattggcggcatttaaagacatggagtttccaaaaacttttgggggggaaacaccaaaattggtcccagattcgagagatgagcctcggtggaaatgtatcgccgtttagagcaacgtgtggagcgttaattgggactac

SEQ ID NO: 670736 - DNA, 164 bp, Homo sapiens
atgactgaagatgctgtttctgcaaacatatcatacacaaacgccgagccctatctacttactctcatctgctacctccctgacaagctgcctatagcactcgaataattcttctcaccctaacagtgtcaacctcgcttccccacccttactaacattaacga

SEQ ID NO: 670737 - DNA, 291 bp, Homo sapiens
acggtaggggttgtagggtgtatattagtctggtgttggtaggggttgtaaggtgtatattagtctggtgttggtaggggttgtagggtgtatattagtctggtgttggtaggggttgtgtggtgtatattagtctggtgtttggtagcgtttatagtaggtgtttagtagggttatagtaggtgtttagtagggttatagtaggtgtttagtagggtttatagtaggtgtttagtagggttatgtcgacgcggccgcgaatttagtagtagtagtagtagtagtaggcgg

SEQ ID NO: 670738 - DNA, 208 bp, Homo sapiens
ggttgagtgagggggagcaggggatcccaacgcttgcgctgactttgcgcagagcccggcgggcggcccacgtcgcggccttgcttgggtaggagagggcggtccccagttcagttgggtgaactacccttgcacacttggagtttctggtgtctttgcttggaacttacctagttcgtggcaaggggactctgctagcggcccccaa

SEQ ID NO: 670739 - DNA, 380 bp, Homo sapiens
tctcaagatgctgggattataggtgtgagccatcatgcctgaccaagtgctttaaaaatatacgagtttgttgtcacctttgtgatgggtgatttcatacaaaggtccagatttctggccgggtgcagtgcctcacgcctgtaatcccagcacttttgggaggtgaaggcaggcagatcacctgaggtcaggagttcgagaccagcctggccaacatggtgaaaccccatctctactaaaaatacaaaaattagctgggcatggtgccactgccttccagcctggatgaaagagcgagactctgcctcagatctcacctgagatcgggagttcaagaccagcctggccagtatggtgaagcccgcctctactaaaaatag

SEQ ID NO: 670740 - DNA, 891 bp, Homo sapiens
ggcaatatccaggtggaggacattcggattcgagccatcctctcaagctaccgcaccgcgcaccccagttgactggagggctacgtggaggtgaaggaggggccatgacctggaatgcatgactctgtgagcaagcactggatggggcaatgatattcgccgcgtggtctgctggcattgttgtgggcttgccgctggcgtgagacggaccagtcacgaagtaccgacacaaggtgatacagaacagtgtgttgccgtcgacggcacggcaagcgagatgcgtgactggacccatgtctccgatggtacctgcgacgcggcacagtcagggacctaccatctaccaggctgcgaatggctgaggaccccacaagggtgtacacctcgcgacacccgatgaaacgaactgatcagccctggcgcagaacctggagcgtactcgggctgcgtggatcgaagtttgtggtgccatggagcaagggtccttcagaaccatgaccggtagccacagtcgaaaagaatatcccggaacgaagacgagtacaaacgtcgccagcaggacataactcccatgcgaatggctgcacactgcagtgagagtcgggatgaccggtaacaattcgagaggacagaggacgcgggcgtatgcgcaaggattggcataccgacacaaacatggggaacgcaagctgcgcccgtgcaaccgcgcacattgacgacacagagagacacaggacgggagacaacacgcagacccgaagtcagcgcccccaagcatgagtagggggcacaggcccactgagagcatgcaacgcagagactctcagcggccagacacgacgcaccacaggacacggccaagaacacagaaacgcgcacacccgcgaaccg

SEQ ID NO: 670741 - DNA, 280 bp, Homo sapiens
cgaggcagtgaatcgagctcggtgaccatctcgtgacggcgattatacatccagatggcctgaagcactgaagatccacaaaataagtgaaaagagccttaactgatgacattccaccattgtgatttgtttctgccccaccctagctgatcaatgtactttgcaatctcccccacccttaagaaggttctttgtcattctccccacccttgagaatgtactttgtgagatccatcccctgcccgcaaaacattgtccctaactccacctagcacttttg

SEQ ID NO: 670742 - DNA, 529 bp, Homo sapiens
attctaatttacttggcaattttctcaatgtagacattactgttgtttctgatttatctgagctgaaaaaaaatcaagctatagtaagcttgaatgattgatctttgttttaattctggctagttcttgaaggattgactctagaaggggaatcattgggtcagggtataaaaactttcctaagacccctcagcattgtccctagagtaggagagcatggttagggagctatctgtattctgacagtcactttagggtatggggtgaccagggtcagtagctttctttgccaaaggaaaaaactgcagttccagccacaggctgctttgttcaaatgtctttgtgctttatgaaccgtaacagtggatgagaaagggaagacgtatgaagaagtcctgatgagattgttatgtttatcgtaatggtgcaaaatgaatttgctcgtggaaaagagaggccttgtgactcttaactagaaattgatatatgttaatgtcctctggtgatatttataatttctagatattaa

SEQ ID NO: 670743 - DNA, 824 bp, Homo sapiens
gggcggacctctgtactattcccttccctggagggaatcatcagtagcctgaggccatcaaggattctcactttttttgctgccccactacgtgggttgtaaacatgagcatgacccagttttacgccagaaaaatgggagctttgttctgctgaccactggccgaggtttcccattcatggactatagttgatctcacatggcacttgggaccgacatttctctagccttcaagacacctgacctgaaattggctgcctcatatgctaggttcttgcaaccaaatgccttaatcttttagattatctgaacatcttgaggtttctgttcgctttgtgggttgggttgagaacagaattgacgctacgccagtatgaagggaacgaacagctttcgtgagagctccaactatctgtatctctgcaagtgactcagtccggatggcaaagactagctcttattctagtgtcaagctgcacttacttgactgcttcagctctcctaggaacagattgccagtctttgctcaggcctaatcttattggtctatatgtacagatctctcctgctgtaactcgaggtcaccccaagagcagctgggccatctgttgtgcatcatctactacctgtgctctgcggacacaaaccgtgaacttacacgctccccttgatttcccaggcaaggattacctgtactacttccccaaggctcccttgaagcgcagaaatactgaaacctccgctgggacccctgtaacgaactctctagcaagatcaagtcactcacgaagcggccgcacagaatcattgggtatgctctaccg

SEQ ID NO: 670744 - DNA, 624 bp, Homo sapiens
cccctgttgctttacatgcaacaatccccctcgtccgccttttccctttctcccacgaggggtgatctctccccccgcactattgacttctctgtgaaggctacctctcttacccaaagagggatgccccctcaaaaatccgtcccccccccgcgaaacaaatttctccaatacctcaaataggatccccccccgtctgtccattccccacatttttccccgaggcaggtcccatctttctcgctggggcacacacttctctgcgtgcaataaaaaaagtggcctccacaaggcgtgtatccactaatccctcgagatttgttcgaagaggtgtttctcaccgggcgcctccactgtaatgtaccggcggtttcccatatatgaaatgcctccacgaagggagtttcactccacggaatttcgataaaagcgttcctccccaggctcgcatgttaacgcacctgcctcaaacggctccccctctttccccaacatatctgtcgatcccctgttcacaagttacatctcccaccgctgtttgtgttacattaccccttctcgtgcgccgccattgtgcagatctttctaaaacaagaattgtgcccttctctacaatgaacaaaa

SEQ ID NO: 670745 - DNA, 461 bp, Homo sapiens
tgaaagatgtgctgctcttaataagcattaattctctctctcgggcagaaacctacgtgttcctcttccagagagctggtgaagccaaaggcattctcataatgatgcgctacaccgactgacatttaccaactgtgtcaaagctacaggagccaggtagacactgctggaactttaacgggaatcaaacaagtctataagaagcactgagctgtgccactacccaatcagtgttcttccagagcacacaaacgaaagtgggaggagccttccaatgagaactgttgtgtgattaatcaatgaggctgactaaagcacacacttataatcccaatactcagaaagacagaggaagaaggatatcagcgcaaggccaacaaggcttcaaagcaagtaccaacccagtatggaccatgagaccctatttcagaaacaaataataaaagcttgatgaagctgca

SEQ ID NO: 670746 - DNA, 289 bp, Homo sapiens
  misc_feature (211)..(211): n is a, c, g, or t
tactgtgcatactgtttagaaccacatttctaactctccaggatcacccctcgctgagtagctgtattttctttgaaatgtcattcctcgttaccctttctcactagggaaatccttctctatctcttactctaggaaaactgttgtcagtaggatctggtttatgggaggggttggtgaatcaagagctagtctcataaatctcaaaggnggtccatctgggcccagctttggggtacacatttcatagggcctgtctctctctctttcttatccagcagttgggaag

SEQ ID NO: 670747 - DNA, 1174 bp, Homo sapiens
cccagccccagccccttcccttataatcctagccacggtcatatgcttatccttctataacgtatctcatgtcccgtcagtcatcttcgattgctgggacagtgacggaggctggtgagtgtcagacagaaactggcttcgcagccgtcagcaacgactacgacgagactcaagtacgggatatgcatgagctccgtcgtttctaagaaacccaaggatacacatcaagagatcccagcatgctggtctctactctcccatgcaaaaagtgctcatgacatatcgagaagacctacttacaaagtgcgcatatatagcaatttattctagtctacccccgactaccctactctcactcactactcccctcccactacgcacacaacagtctggcaagcgacgtcttaccttcaacttgtaagcaagtgctcacgcggctggctggcccagcgtagtatggctgacattcatctgcatatatcataactgtctcgtattaactctctagttcatggtaatcttccctaacgtttctccgcctaccacactgcacagcactgcaacatctcacgtttggctcattaacaacaccatcagaggcagcacagagtaaaatttcaacatcctcttggagcgctacagccaaggaagccacaggacaccaatccaattcgtcgtgcactatggtcccttccaggcctacccaccattcctctcccacgaatgtctacaacttctcacaacagtcttggaagttccggagtgcctaccttggggcttggcctaccctagggttcggggcccccccactcaccgcctacacgctcggacttccccgcgcacacacccacccaccggacactaccctcaacggcgaaataaggccacactttgaatgggaaggggaaaggggcctatgcgctcgcgctcggaaagcgatacatcagactcgatcgcgcgccttggtcaagaactacattccaggtgcagcctacagcgggaaaaccctctcacacaccgtcaaaccccgaacagcagctttcaactcctcgggactaaacgctatcctatcttacccctctaaggaacacgggcgtctccagcatagagtgccccccgcgtgtgacgcaacttttcgccacacgagccctactttcgtcgaagcttcccgagg

SEQ ID NO: 670748 - DNA, 165 bp, Homo sapiens
tgagggatgagggccgtctggtggacttctggcgtcccggtgccccgggcttttccgtcagatccgttctttctcggtggtgtcctcctccttcccttcccagtctcccttttctctctccgggtgtctctgcccctctctgtgcctgcaaaccttatcctctat

SEQ ID NO: 670749 - DNA, 175 bp, Homo sapiens
  misc_feature (61)..(65): n is a, c, g, or t
cgagcggccgccaactccagcagagcgccggcgcgaccaagaccagggggaccggcggcannnnnggtgcagcgcgcgccgtgtgcatgcctagtcctcctgttgagagcgccgagagtcctggtgcttagtctatgctggtgccgctagccagggtgtcctgcctggcatatca

SEQ ID NO: 670750 - DNA, 326 bp, Homo sapiens
tggccagtcggatgtgcgggccatgtacggatgtggagatcgcctacctaccgcaacgctgctggagggcgaggagctgccggctgaatggcttcacggcgttggacacatgtcaaccatctctgtagtgcagtccaccgtctccagtgtctatggcggtgccagcggtgtcggcagtggcttaggcccgggtggagcgaagcagctactcctatggcagtggtctgggcgttaggagagcggctatcagttccagcaccgtgaagagtccctgcgggtggcctcagcctctcttggatgcggcagttctaccatcaagtacatca

SEQ ID NO: 670751 - DNA, 400 bp, Homo sapiens
  misc_feature (190)..(190): n is a, c, g, or t
  misc_feature (196)..(196): n is a, c, g, or t
  misc_feature (221)..(221): n is a, c, g, or t
  misc_feature (228)..(228): n is a, c, g, or t
  misc_feature (248)..(248): n is a, c, g, or t
  misc_feature (262)..(262): n is a, c, g, or t
  misc_feature (288)..(288): n is a, c, g, or t
  misc_feature (322)..(322): n is a, c, g, or t
  misc_feature (338)..(338): n is a, c, g, or t
  misc_feature (364)..(364): n is a, c, g, or t
  misc_feature (366)..(366): n is a, c, g, or t
aaactctctctttgtttttaaaggaaacatctattatggtaatacaaagaaaagttaaattgtgacagtaatgttatattaacctcttcctactttaaagtgtgaaatgtttcacctcagctgtacaaactccagcattgaggaatttgcctcactcattactcctgtggtggacagttatataaatagncaggcngctcacatctgttttggggcatagnaggaggnggcacctgccatcttctggnaaactccaaggggnaatttcaggtggacatagtggcactnaaacccattagggatacttggacccaatatttgnggcacggccaggctgnacagttctataccggatggggcggtngnaaggggtttttattttcccggccgggggggccga

SEQ ID NO: 670752 - DNA, 160 bp, Homo sapiens
accgtctgagcagctgggaacatgagagcagaaaggtgagcagagcagaaaagcccacctcccgatgcatagctgctgctgggggccaccggtgcttcccgctcctctggtgtccatgagatttcttttttttgagacaaggtcttgctcttgtcaccca

SEQ ID NO: 670753 - DNA, 675 bp, Homo sapiens
aataggatcagattcatgaatcatggtctgccaccttttatcaacaaatccgtgacgtcctataatgagctatacagtgtgaggcatatctcatagcaacgttggttgattgccacggagactctgccaccggttctggataagcacatgtctccctgtaccttggatgctaatagaagggcatacttacagtgcagggtccagagcatgatgctggggtcgtaaagcgcgtatacatctagtcctacgtaatagagatctgaggtggtcctcatagagactacgtgcagtagtgtccattcttcactggccgacgtactaaagttcaaatgataaaacttgaagttgtaggcttggaacagtatcagatcagtatatccttccttgcataaaatacaagggaaaggccaaggaataatcagcattaacctaccaggtccaagggtcttctatccctgacttcatctgagtcacaagatttctctaataagagaaactttgctactactgaggaaaattatcccttatgggagcccccagttcagaggtaagaacagttctttcacgtggaggtccaaaattctggacttctagaaacaagtgaagtgtgctaaagtctcctatttatcgtctctcttccagtattgtgcatcgattcttgcttaaattctggat

SEQ ID NO: 670754 - DNA, 195 bp, Homo sapiens
aagccatggaagtcgggtgtagggttggtcagcacaggtccaggccttttacggacgactgcgttgctggtgatgcggggagttcattggtgtagcggcatgacacttgttcgtccttgtagtcttgcagcgacaggcatgatcttcttgtcgtcatcaagctcatagccgaagcgaccttgcaggtcgtaggta

SEQ ID NO: 670755 - DNA, 345 bp, Homo sapiens
ggatgcaagtgtccattaggggactcaggggcacagggtgggtaccgtgcacactgtggcaaggcactggtgggtgctggcaggcctagctggacatggatagagtgagaatgacaactcacagatgtcctagcttctgctggcccagctgccagccactggccagtcatcctataagcccagcatgtgtgcatagtcacccaaaacatcttgaaacttgccattagagaggcattcaacaacagaagtaagctaagtgagtaggaaacagtgtttcctggaatataccgcactctgcctgaaataggaaaactatgtttgccgggaagcagcagcagcaggaaa

SEQ ID NO: 670756 - DNA, 226 bp, Homo sapiens
  misc_feature (219)..(219): n is a, c, g, or t
ccagctggagccttcctgtgcccctactgtactggcttgcattcctgctggaaactgtgagcttcctcctgagtccaatctacagatatatacctccctttaaccgccacttggtcacactgtcaggtagcacattcactttctcctacaagaaagctcagcgagatctgggctatgagccacttgtcagctgggaggaagccaagcagaaaacctcangaagttg

SEQ ID NO: 670757 - DNA, 140 bp, Homo sapiens
ataccggcgacgtgtacaagcacaggggagttactactgggtttcattaaccaaaccatgcggcatggttagggagccatgggactcgggtagcccagagtaggcacctgggtgatgggggaggtccccagtagaaaagt

SEQ ID NO: 670758 - DNA, 734 bp, Homo sapiens
ggcgtgcggcggcgtgctggcggtggcaggcggagaacaacaaatcccggagccggagccaggtgaggctggacgggacgggatgggcgacagcgggcgggactcccgaagcccagacagctcctccccaaagtccaccgttccccaaggcaggtccgcttcatcgcgtatctcactccgtgggccagctgcgtagcgcgtcgttcaagatgctcggatagtcgttgggaggctcaataagggatgaacacgccaagcagtacgagtaagagtgcacagaggcaagggaggagagtcggcgcaacgagggggacgcgcgctgggagtacatctacaggagccgacaagagccaaagtaccgccagtaaagcgaccaggccacaaccaacacggcaagagcggcgacaaagccccagacggatgacacaaagacggaaacaccatcagaaggcgcgcccccgcgaggacaaacacagagacaggcgcgagcgcctcgggagaaaacccccggagcggagggcggggcgagagaaagaggggacaaccgaagcaaaacagacagaaaacaagacgcacacgacaccccaacaaaaggccagacgaagcgaaaggaacagaacgaaggagaaccagcagccgagagcacaagcgagggaggacaccatagacacagcgagagcagaacgaagacgccacaggcgaggacaagcgacagacaaacccagacaggagcc

SEQ ID NO: 670759 - DNA, 328 bp, Homo sapiens
ctctctctctctctctctctctctctctgtgtgtctctgtctatatctcactctgtgtgcaaagcgatacttctattactaggatgcatatcaatggagacactggagacccataagaggacaagccaatataagttcatacatttggtcattactggaacatttatatcttagctggctgaacttgcacttgacaaaaatgcaaagctgaaaataaaaccacggagactaattaactgagagagttattaaaggcacactccgaggttcactacgatcacatcatggccatgctcaggccagatatgctgagtgcgctgtcggctct

SEQ ID NO: 670760 - DNA, 311 bp, Homo sapiens
tgcagtgtctcacacctgtaatcccagcactttgggaggccaaggtgaacagatcacgaggtcaggagtttgagaccagcctggccaacatagtgaaaccccatctctactaaaaatacaaaaattagccaggcatggtggcgcatggctgtagtcccagctactcgggaagctgaggcaggagaattgcttgaacccggcaggtggaggttgcggtgagccaagatcgcaccactgcactccagtttggtcaacagagcatggctccatctcatactggcctatgagtgactacacatgtcgaccgacta

SEQ ID NO: 670761 - DNA, 198 bp, Homo sapiens
caccagatgagatttgttatacgcgcatccttggatgatgcggctaaaaccgttggggtcgactttattggcggctattcagcgcttgtacaaaaggggtttgccaatggtgacctagctctgatcaaatcattaccccgtggcttgacggaaaccatgatttacgtcatatcaagtcgtcgaatattggctcatcca

SEQ ID NO: 670762 - DNA, 618 bp, Homo sapiens
atccagcctcgtggatgtgagaggctggctctgtctgtttgcatggagctgtggtgtacggcctttcccaggaatcctcccaaaggtggcttcccaagcattcagctgggatgggcctttcaggaatcaccccgagatggctcggggttttcccctgtgccctgaaagcgctcctggtatcagagctgtttcaagggcagacagcaggccgggtgtcttagggatcagtttttccaagactccagaagtgccaggttcttccccttgagctctgtccccatccccatcctccagactgggcaggagctgtgctgggagaaagggtgggcagcgggagcctcagagctgagcccggctggtgccctcccctccggcctctccactgctttcagacactaacaaggcttctcagggcagtgatttgtccaacactcctatggagacctcccagcagcccatggggtcgccatgggtagacacaggtttcttgtgaccctccctgggggcatgggagggtggagtgggactcggtgttcccctgaaactaccctgtataatctgtctaaataaacgggatttttcatgggcggccgcccacccgcattatcactgtgtgat

SEQ ID NO: 670763 - DNA, 462 bp, Homo sapiens
  misc_feature (360)..(360): n is a, c, g, or t
  misc_feature (366)..(366): n is a, c, g, or t
  misc_feature (373)..(373): n is a, c, g, or t
  misc_feature (380)..(380): n is a, c, g, or t
  misc_feature (383)..(383): n is a, c, g, or t
  misc_feature (388)..(388): n is a, c, g, or t
  misc_feature (394)..(394): n is a, c, g, or t
tggaatgctcggatagcacatgaacagcgtatacatccagcgtgcgcagtatctggacggacagaatcgccaagccttgctgctagacgctctggcaaacgccggcgccccgctcccacctgctgtgagttctagcctatgagccgccgcaacggacaactgggcgagcgcctgatcgagctgttcaacgccctgcaatgtcgggaaaccaccttcggccagatctacgccatgtccgcatcgtgcggcatcgacgcgcgcagggtgctcgcagaccactttcaaggtggtgtactccatggctaagactagtacttcgagtgcgccttgatggcgtcgcgttctacactgaacaccganacctcntcgcctngtaccgnacnccggnacaggnttcgcttgttcaagacagaaaactacgggcgcgacaaatccggctggattcaggtgtttgatcgagct

SEQ ID NO: 670764 - DNA, 639 bp, Homo sapiens
tcgagacagagtttcactcttgctgcccaggctggagtgcaatggcatgatgtcggctcactgcaacctccacctcccgggttcaagcaattctcctgcttcagcctcccgagtagctgggaatacaggcatgtgccaccacgcccggctaattttgtatttttagtagagatggggtttctccatgctggtcaggctggtctcgaactcccgaactcacgtgatccgcccacctcagcctctcaaagtgctgggattacaggaatgagccaccatgcccagcctagccgttcttaaaaatagtggatgtcacaaattttctatcatatatgaaatactaatttataattattcaggatagtgagggagattatgctttgggtatctcagaaaaaaaataaaatatgcattatgtaaacaaatgtataacatatttaacatatgtataatgaatcttggaatgattgaacatagcaggaaacactggaatttctgtataactaaaaatctcactagcaaaggcacgaaatacttttattgttctcacaataaaatgtctgaaatcaactctattgtcgtttaagactatgaacaatttgagaattagctacaaattttcataaagagtgccagcggccg

SEQ ID NO: 670765 - DNA, 733 bp, Homo sapiens
  misc_feature (313)..(313): n is a, c, g, or t
  misc_feature (442)..(443): n is a, c, g, or t
tggctaggtacgaggctgggtgttggagagaagcctgcttccccagtgtgtgcagaccagatgcggctctgcagaggctgggcgctgtgctggcgggctatggggtagagctgcgtcaggtgacccgctgagcagctctccacactccgtgaccctggctgcagctacgtgtcccaagggctggcaggcaagaatatcccgggcagggtgttcgtacaagtgctattggaagcgttggagtatctaacgtagacacatcgaagtgagcacgggcggcacgtggtgggacgggctagcagcacagccagtgagnagtcttcacactgccccgcatgcatcctctcctatgacttctggaacaatgcgccaatcgtgcccgatgccgcttatcgcgtctcacgctgaaagtgtccatggcagcggtggcctaagacgcgcatgnntcttcatcctgtagccgctccgcaataggctggccaggatcccgcctggatgacatccatgtgcctgctaggagagagcaagataggctcgcagattgggcgtccaaggagtccatgtcgcgcaactggtgagcataggaccgaggcacacgttcacgccgcgacccaagtcatgacacgagggaatgtatggcttagcacatcgatcgacatgtaaatcacgtacactgggtgtgatgggggatcccagggcccccgttcaacaacttctcccggccgacatccctgat

SEQ ID NO: 670766 - DNA, 236 bp, Homo sapiens
cagcccgttgcgggaaaaaggaaaaaaaagtgtgagggggggggtgtgttttttctattgaacccctgtagagggggggtgtgtgttttctattgaaccccaaaaaagagagggggtgtgttttctattgaacatctaaaaaaaaagagggggggagggggtgttttttattgaacccctattcaaagacctggactgaattttttgggtttgaaataaaagaggcagagctatct

SEQ ID NO: 670767 - DNA, 452 bp, Homo sapiens
cagaagtcctgtgggataaaccatccacattgcagtcaggttcccagtatctagctatcattaattttaagcaacgacataaacaagatttggccaggttataaaaatagagggctatcttgagaattacttatagtatccgagttgaatggcagagcgcacgtagacacatctgaaggtggatggctgtatctcccagtactggaccgggttgctgaaaagactcgcacccgaataagaagcctttatcggtgttgtgtccaggtgggcagaagtcacatgatccaactacagagatattgttgttatgaaggtagacaacctggatgtacttatgctctgccagcccaccaggtactctggtaagcttgttgttgtccaagtgaagctccctcagatgaggcgtgtaggccagagagccattgtcaacagcagagatgctgttgaaactc

SEQ ID NO: 670768 - DNA, 355 bp, Homo sapiens
ccgctgggcgagcaactcatctgaattatgctggtaaacttccctccgtgctaactgcctcctcggtaatccaggagtctgcactccttcagcgtgcacccagatagatcctatgatcatatggattagaccacctctttccccatccaagcatcccagcatctccaaaacagatgcccagcttttcaggcaaccacattacaggcctgaatcttgacccggcttcttgttcctatgagaaagaatagatgcctgtcgtacataggtcccagctcagtcacacctcaaagcatttgcacaaaatggtatgaattcctaaaatagctttctacacctgtttccattggttgccaga

SEQ ID NO: 670769 - DNA, 176 bp, Homo sapiens
  misc_feature (76)..(76): n is a, c, g, or t
  misc_feature (101)..(101): n is a, c, g, or t
gttacccactgccatgcaccaggactggctgtgtaaccttgggtgtgccctgctgtctctctgggctgcagagtcntgcccaaatgtgtgcatggcctctngaactgctcagctctggtccagtgcctgtggcaggacacacatggtgagcctagccctgggacatcaggagactg

SEQ ID NO: 670770 - DNA, 725 bp, Homo sapiens
gcccccagctctctttttcgtgtgtgcttcgtcctcgtgggtcctggtctgtctgctggcgttgctgctgctggttgtgttgtgtctatgtcctatctgggttcgtgtccccctcttccgtggggtgggatcccgcggtcttctagggggttgggggttcccccttcttatattggcctcccatttattcactttggagtttttgggggttttcttggtgttttggtttttctttccattctttctgcactcagattttagccttaccaagggaatagcctctggccgtcacacgttggacgcctgtaaggtcacctcgtggtgaggctgtacatgcctcacaccttgccaccgttgagagggtatccttagcagtaggactcccgagatgagtgtctggagcgcttcagttcagcttttaaggcccggacgggccacacgtggctggcggcctcgttcccgtggcggcacgtccttgggcgtctctaatgtctgcagctcaagggctggcacttttttcagtatacaaatgggtgttatttttatttttttttgtcaagtgatttttggtcttctgttgacattcggggtgatcctgttttgcgctgtgtacaatgtgagatcggtgcgttctcctgatgttttcctggcttggggattgtacacgggaccagctcacgtaaagcattgccagtaacaaagtaataaaagcctctttcttttta

SEQ ID NO: 670771 - DNA, 804 bp, Homo sapiens
taagcgtcaaaaaggtcagagagtcagcccccggggcccgcgatggcccccggacggggccccgccgagtgctcgcgccccccgcggctaatgcccccggctcccccccctgggggtgcccccacggtatcaacaatgcaagctcccggcgtcaaaaaagagggcccgccccctgggtataagcgggcggcggccgccagttctatgcagctcggcaaacccccactctatgtagaggcctccctgcaaagccacacaggggcagaacctgtcccggaaatatacgccccgcgaggggcccaggatccggtccctgaacagagaacccagcctgccggcaaggggttcgcacaaacccggcggacaaccaagcacgtgggacacgacgaaacatccccagacagaccaccactcagacaaagaggcccacagtaagtctacacgccagagccgccaccccccgccttcataggagcagggggaacagagcgtgacttcacgctgtttagctgttccacatgggagccaaatggtgatccagccatatccgagattggggttacaacaagtcacacacacctctgtctcaacccgctcaccagtaagcaagaagcccaactatttgttgggagaccacccgctggaggatttcatttcgccgaggggcccgtcatgtatggatcgagagttgttggtaggaccccagctctcttgtatacacgggcgaaaccacgccgtggccccccacattggcgtcgccaagccttgcgggcccccattccaaaaaacagaccaacatagaca

SEQ ID NO: 670772 - DNA, 833 bp, Homo sapiens
  misc_feature (41)..(41): n is a, c, g, or t
  misc_feature (67)..(67): n is a, c, g, or t
  misc_feature (69)..(69): n is a, c, g, or t
  misc_feature (71)..(71): n is a, c, g, or t
  misc_feature (77)..(77): n is a, c, g, or t
  misc_feature (94)..(94): n is a, c, g, or t
  misc_feature (132)..(132): n is a, c, g, or t
  misc_feature (143)..(143): n is a, c, g, or t
  misc_feature (181)..(181): n is a, c, g, or t
  misc_feature (183)..(183): n is a, c, g, or t
  misc_feature (185)..(185): n is a, c, g, or t
  misc_feature (191)..(191): n is a, c, g, or t
  misc_feature (193)..(193): n is a, c, g, or t
  misc_feature (202)..(202): n is a, c, g, or t
  misc_feature (204)..(204): n is a, c, g, or t
  misc_feature (207)..(207): n is a, c, g, or t
  misc_feature (209)..(209): n is a, c, g, or t
  misc_feature (253)..(253): n is a, c, g, or t
  misc_feature (266)..(266): n is a, c, g, or t
  misc_feature (268)..(269): n is a, c, g, or t
  misc_feature (296)..(296): n is a, c, g, or t
  misc_feature (351)..(351): n is a, c, g, or t
  misc_feature (383)..(383): n is a, c, g, or t
  misc_feature (386)..(386): n is a, c, g, or t
  misc_feature (432)..(432): n is a, c, g, or t
  misc_feature (436)..(436): n is a, c, g, or t
  misc_feature (512)..(514): n is a, c, g, or t
  misc_feature (553)..(553): n is a, c, g, or t
  misc_feature (568)..(568): n is a, c, g, or t
  misc_feature (636)..(637): n is a, c, g, or t
  misc_feature (675)..(675): n is a, c, g, or t
  misc_feature (694)..(694): n is a, c, g, or t
  misc_feature (705)..(705): n is a, c, g, or t
  misc_feature (806)..(806): n is a, c, g, or t
tttgattcacttcattttattattaacagcgaactagaaangcagcccagggtggggctccaacaantncncccaanatgcccagccctgcatnaattcctgggtgggtgaggtcatctggactgggccttngagctgtcctntatttataaaaccaaatgggtccaaatacttctgggtntntncgcgcncncgccgttgntnttntntatatatatatataaaacataggcttcctttccacaaggcgttngtaggtgggactntnnacgccatccctgggaaaaaagaaagtnggctttagcagggactggtcccagagtgagcctaggcactgcatcaatttgaatngctggttaacctggaccctgggcaggtatggngcngcccatcctgcccagccacaggaagctctaaaccacctggatttanaagncctcatcctcgtccaggtcactatttccatcctcagcctcctcggtgccaaaacaagcactgcggatcttcccaannnaaaaaacattcttctgctgccttcagaccttggcctgcnggtgctccagttgcncttgcaggttctcgctctgctccgtctcctcgtccagcgaccgctgcagcttacgtgcctggttgtcnncctcgtccagctcgtcctcagcctgggccagctccttnttgagctcctccacccgcngccgcagcttnttcacctcaccctcgtgctgctccccccgccggttggcatgtgccagctctgccaccttctcctggaactgcttcttcagcttgccatgcacatgcttcangtctgccagctccttgttcttctcgaa

SEQ ID NO: 670773 - DNA, 953 bp, Homo sapiens
ggtcactcttttcccgctgtgttctctgttcgttatttcccgagggccccccttgtacccgcgtttcgctgtggggttttctcttcttcaacccacgccgtgtgtgatggaccccctccgcccgtggtgttggtcaaccacacgaagcgccccgtcgggcaaataataattgggcggtcaccagatttcccaacggtgaattgatgctcccccaagggcgtgtctcccaccaggggtgagttccacagaagagcttacttgcgtgccacccgaaagccctcctgggggtatcaccacaggagccaccacgcttgtcgttgccccacccctacttctcaggaggtatagtgacccaaagacccctccgggggggagcaccaaaaaaccaccaggaggggtgaacgtccccccttccacataataaaagggtctcaaaacaggctccaattaaagtccctccacggcccccgcacataatgattgcatcaccaacgtctcaggtagaagttagtgtatgatagaagatataaaccaagccgcccggccgcaggaggagtccgaacaaaacagatcctagaccccccccacacgcattgggagcactgtatgtgcgaggagatattactactagagaccacactggagattagggactcccgcgccctgtccagacaacatattggagtaaccacccccgctcctggtctccccagaagaggagacaccccaaaaaacacacactccgcgcctagttgtgaggggaagctccaccacgagtaccccgcccacaactatatctcttaggcgagggcccaggggcgacccaaagacaaaatagcttgatagaagccacgcgggtagcaccaggggttccacgcagcgcgtcgagaggcacacccccccgcctgccccccaccgcccgggggaccgacaaggcccccgcccaaataaca

SEQ ID NO: 670774 - DNA, 788 bp, Homo sapiens
ggaataagcgaaccggcctcctagggggtcgtcgtgcgtgcagacagtttatcgagaatcagtgctccgcggctccggggagaaggcaatatgttaaggatacctgtaagaaaggccttagtaggcctttcgtaagtctcctacaggatgtgttcgaacaacatgctcacagcagtcaagcaacttgcattgagtgtatttcgttcgatggtcagtcttgtcatggtggaaccagggaacgatcgtcctccaagacttgtgagaaggttgcgatgcatgatccctcgattctgttatcatgacaggttgtctgttgctggaaactgcaggatgtgccttgttgaaattgagaaagcccctcaaggttgtagctgcttgtgccatgccgagtggatgtaaagggttggcaatatcctaacaaactctagaagaaatccaaaagagccagggcacaggtgtgatggagttcttattacgcaaatcacccattggactgtcctatttgtgacctagggaggtgaatgtgatctgctaggacagtccatgatgtttggaaatgataggagccgattttttagcaggggaagcgtgctgtggaagacaagaacattgggccattgggtacagaccatcattgaccaagatgtataacagtgtactcgctgcatcaggtttgccagtgagattgcaggagtagatgacttgggaacaacagggcagaggcaacctgatatgcagttggcacatacttgaacacgcattgttcctgtctgaacctgtcctgggac

SEQ ID NO: 670775 - DNA, 161 bp, Homo sapiens
gactatatccaattctttaggaggctgagacaggaggatcccttgacgccacgagttcaagaccagcctgggcagcaagaccccaagcaagtccccatctctacaaagaaaaaaaattaaaattagctgggcagtcccagatactcagggggctgaggcag

SEQ ID NO: 670776 - DNA, 200 bp, Homo sapiens
  misc_feature (35)..(35): n is a, c, g, or t
  misc_feature (42)..(42): n is a, c, g, or t
  misc_feature (45)..(45): n is a, c, g, or t
  misc_feature (47)..(47): n is a, c, g, or t
  misc_feature (180)..(180): n is a, c, g, or t
gcgctggaccccaggtctccgagcgaattccagcntgcaggntantnaagcgacggcattagtgagattgagagagactttaccccgccgtggtggttggagggcgcgcagtagagcagcagcacaggcgcgggtcccgggacgccggctctgctcgcgccgagatgtggaatctccttncacgaaaccgactcggctgt

SEQ ID NO: 670777 - DNA, 1016 bp, Homo sapiens
gagcagatccgcgccaccattgagcgggacggctatgcacagatcttgaaggatctggtgtggcattgtcctggccatgtgcttgtggccccatgtgattgtgccagtgggacaggaaggacatccacagacaggtgggagaagaacacaatcgtcatcgtctctacaacgaggaacgttcaccggtgccgccagacgacgctagaccccgaagaccctatgcctgttgtcacgatcctccaagtagcattgtcatcatgcccgtgtgaccgatttgcgtggacacccgtctagatggttcacacccaagtagcaccggactcacgctgtactgcgagcagcggcataggccaatgcaagattccacggcgtgcgaggctcacggaattgcgcagatcgaagctatccctagaaaggcgtgacgtttcgcaacccagggccatgcgacaacgcctactctaggcaagcacacgcgcgatagtggaccagactacggcggggcgaagtcatagttgagtacttgttgacgcgccactaacccgagatcctaggaccgccctagctacggctaccctgtgggaggccgtgtttctgcacgcaagggttgcgcacctggctagatgtgaaccataggcatgtgcactcttgacagtaattcccttcatggcaaagcgtcccaatacggggcaacgtagttgacccacgtgaacccaactattcttccaggcttgctcgggcgcccctggtggcttcaagtttacccggtggcgacaactttgggactacaccaatcgtccaaactaacgcgtgcacctcaatttgggtgcccagttcaaacactttgaacaaaacggggccaaaggcccaaatcctcactgtagcgtccaatttgcccagtcacctccaaggacgttttgggccacccgtacccttggacactagcccgcctacttacaaaggaaacattgggcattcacaggtgcgaggtgggtgatccgggcacgacggacgacaac

SEQ ID NO: 670778 - DNA, 425 bp, Homo sapiens
ccgctcagccaactggtgatgcacttgttcgagaaatttggcaaagctgtgaattatgctattccgccttctccttcacctgaatgtggccatgccatggaatcgcgaccctctgtgaagcaatagtccccatacaccatgtactctgcagatctgtggagctcctctggtatgcaatgaggcttaagaactttgcaagtcccttggcttcgtgcatggggacaataagctagcagtactatgctaccgatgtttatcactcctctatttcagattgtttatgctctagaaggaccatgctataaagtactccagatcactgatggaatattttaagcaaaatgcttctaaagtcgcacagatatcctctccattggtcatcgatggacagaacactccatcccctgtgtctctcaacaacgtct

SEQ ID NO: 670779 - DNA, 256 bp, Homo sapiens
ttccttttaaatgggttggggatttttaaaatgcccaagaaaaacaccctttgtaatttggagaaattttcccccagccttttgttttcagggttttaatgggggagttaacccctcccaaaaaaggaagttggcaaaaacacccttttagcccccttttttaaatgaaaaaggggggcctaaacttaaaatttttataaaggattggaaaattgttttggggaaaattgaaaaaaaaagttttccttggatgcca

SEQ ID NO: 670780 - DNA, 360 bp, Homo sapiens
caagggattagacatgcagatacaggttgctcgtgagattctccactgcacattatagccaatgatgtctaaagtcgaaacaaagagagaatgctaaaacagcaagagaaaagcgtctagtcacctatgaaggaacccccatcagactaacagtagatttctcagcagaaatcttacagaccaggagaaaatagaatcatatattcaaaatactaaaaaaaacttctgccagtcacagatactatactcagcaaagttagccttcataaatgaaggagaaataaagtcttctctagacaagcaaaagcagagggaattcatcaccactacacaagaactacaagaaatgcctaaggaatc

SEQ ID NO: 670781 - DNA, 175 bp, Homo sapiens
gctgcggactactgctgatgcagtgacgacaaaagtatccctgcactcctcatggcgcttcccgccgttcttctcacatgcgtgtatgggtggcggggcgccgctatcggcgtgccgaccctgaacatgattatcggtctgacaacaccctcgtctcaccctgagtcattcgctc

SEQ ID NO: 670782 - DNA, 484 bp, Homo sapiens
  misc_feature (14)..(14): n is a, c, g, or t
  misc_feature (35)..(35): n is a, c, g, or t
cttgaccccctttngaaaggtccgcgcgccattgngttgataccccggaattcggccattatggccggggcggcattcgtgacgctgacagcattcgatccgagatgtctagctccggggacttagctgtactcgtgctaatatctgttgctggcctggaggatatccagccgtctccaaagagtcaggattacctacgttatgcagcaaagagtgcaaggctaaattgcctgaatcgctatgtgtatgatcttcatccatccgacattgcaggtgacttattgaataaaggagagagaattgaaaaaagtggatcattcgctacttggtttaaataaggacagggtgattcgatctctaaggccaccctggagttaccgccactgtgatgagaatcccttgacgttggaccatgtgaattttttacagcccaagatagttaagcgggatcgagttgtcaggtttttggagggttggagttccc

SEQ ID NO: 670783 - DNA, 351 bp, Homo sapiens
agaacacccaaagggccgttgccaaagccctaggagttttttgagccccataattccaaagatagaaacgttcattcatttaagtgatgtagatgttttgggtggtttattaaatgtgtaagtttataaaaactgatggggaaaaaaagtgctccaggtgagggtcgaactcccaacctcggcattggtccgctcgccctgtcatataaggaccgcgcgctaaccgattgcgcccctggagctccggccgcacccctgcgccggggtttttttcagtggtttataaccccgtgacctccccggagggcccccccctgtgttatatatgccaattaaaccttttgcctttca

SEQ ID NO: 670784 - DNA, 281 bp, Homo sapiens
taaaaagatggacgcattcgtaaatgcagagtgaacatgtgttcagtgcaattctggcatgaagttgtctttcttggctaaagaactcagtgatgctgtcaacgtacgagacagaacgatggcagacctgcagtactgcacgcttggaacatgagagagtgacaaagccagtgagctgatgctttgggcgaacttaccctagatgcgtattgaaacttctaaaacgtaggcctatgtaaagaagttgcaatcagcacctagtttcaggaagttcaataggg

SEQ ID NO: 670785 - DNA, 404 bp, Homo sapiens
accagttctggcccccactgctgatgattaccccaaagaagggaaatcagggtatcatagatgataccagcattccgatgttcactgcatgcacggcttcacaaccaccaagattggaatcagaactgagtgtccatcagcagatggctggcacagaaaatgtgggtgcatatacaccgtgcaatattatgcagctataaaacggaatgaaatcctgtcatttgcaacaacatggatggaactggaggcatcatgttaagtaaaagaagccacggacagaaagacaaattttgcatgttctcactaatctgggggagctacaaattaaaacaatggaactcagggagatagagagtagaatggggggaccagagttaaggaaggggagtgggggaccaggaact

SEQ ID NO: 670786 - DNA, 1329 bp, Homo sapiens
taagcatgtgttttctcctacttgggttctcttggtatttactaactttatctctattttcttggtggtttttttttatccctggtttttggtattaggtatagggtggttattagtccctggtcttcattggttcacaggtatttcttgaacccctctgggattccccaccggggctggagatccgagaagatgggcccatgttaatgcgcccaggtctcctcttcctcctctctctatcctactctccctctctggtgtaaaagacacttctatggcgagatggtagacatctggccaactctcccagttatctctccaccctcgccgagaacgaataatacttccactggggcctctcttaaatcccctttaactcgtgaaaaagtgaaagggaatttaaaaaaccatgtgatatttcaccctttgaaagaaggcctttattacagaggtgccgtgttaatagtggctttacactttcccgtgggcgagccattatggggggttattcacaatttttctttttacaaaaaaaaaatttttcccataaaccctaacgggctccggggccctgcgcctgtgttttttttacaacccagaaaaatcccgggtgtttggggacacctataacctcgtggtaggggtggcggatctgtgcacttccaaggggcacaccatcgtggcttccacgtgtggggggggaaataaccccttttgggactgcacaactgaccaaatatttgccccaaggtagaggtttacgcttggttgaactgtttacccccaccagcattgcttgcctttctcaaagttggccctgttcctgtcacactgttacttttcacgcgctggtgttccccatgagctttctaacgtttggctacaaggcgctctaaaacggaggggggcaatcgggtgacagcactacaatttaggaacggtaaatccggccctaatggaagcccttaaaaaggtggttctcctttaccacggcaacgagttgctacctgataattttgttacacaacaccgccggcgttacaaggcggcaacccgcaaaaagaaacagcaccagccaaaaaaaaagggggcgcgcgcaaaaaaatcacccgagagacgacgaatgacacaactcctttctatagaaggaggcaccacggaggtgaaaaaacgaggggggcgcaaaaactcggagggaccgagcagactgtcgaaccaccctggttgtggaaccacagcacctccaccaacagtgtgtcacagtccggtaagctgacacaaatcaacgaagatacaccgcgaaaagaccaaaagacgaacgaaagggcg

SEQ ID NO: 670787 - DNA, 1262 bp, Homo sapiens
ggtcgtcgtctgctgaataggacgccgtcgtcatgtctgcgcttctgcctactgtgatggtcgatagcgtgaacctgctcctagttttccttgatcaagaggaactaagtcacgacctacatgtcatcatgtagcctcatactaaactttgaagagctcactgacatacttccgttaccgcttgacacacagtgaaactgaattacatcacgccaaatgcactgatgtgcgactgctgtgagctcagagtcagtccagtagcggcgtcaataaaggcgatagttacagatagcgttaggggtacattatgaccgcccgcgtatgtactaccctgtgcctcgaaggctgcgcacaaggcacgtggtctcaaccccctacacgtgactgctcgcccgtgcatcgcaacactactcgagaccataggcatatcgtctcgacggcctagagcttcagacatcagatcccacgcacatactatgaatccagcataacgcaacaatagtcactccgcctccagtacacatgcggtcaatcggctacctccatccagctcagtggtcccaagtccgtctcaattccatgccagtccagcccgaggcaggccgtgttgtagtgggttggaacgcacgtgaaacgccggactcacggcccacaatccattgatgcttccattgcactccaactctagccccacatgaaggattgacatagtatcagcagtgttctactccgtaacaaaacactaaaacataaacccaatatacttagtgagattggtaagcttactataaataatttactcccctaaagcgtggcgtaacccggcaatttccgtagcataccctccaaaactttaaaggtcccaagacaagcgagcgcaccccattaacgtaacatgtcctcgctaaccatggaaaacaaagctaagacactgtacttgacaaccccatttaaatttcccattccgaccacatccttcgtccctctaagggaagagccttgtcacccacagggataaacccggtgacttatctgggccccaaagagtagcgagcaccatattggtccggaaaaagaaacattccaccaagaagaaaaaattgataaggcccttcaatagaagtgccccaaacaaagtcattatggcagcccaattcaacacccgcacggttaaccctcttacttgctacacagtaacgccctaaggtcctaagaccgaccgtgaagccagagatacttccccatttgtaaccactgtaacg

SEQ ID NO: 670788 - DNA, 141 bp, Homo sapiens
  misc_feature (10)..(10): n is a, c, g, or t
  misc_feature (39)..(39): n is a, c, g, or t
  misc_feature (56)..(56): n is a, c, g, or t
ggccctcagntgagggaaggtacgagctccctgctggancctgggacccatggcanaggccaggcagcccggaggctgggtggggcctcagtggggctgctgcctgacccccagcacaattaaaattaaacgtgagctgca

SEQ ID NO: 670789 - DNA, 207 bp, Homo sapiens
cgcgagctgcgtcggctcgcggggggggcgggccgggcaccccgggcgcggaggagcgctcctcgcttctctccttcccccctgccgactccgccggacctcccgcggccggccgtatcgccctctctctgccctaatgaacgaccatggcgaatacacaggtcgcgaagggacgccctcaggatcttaagcgtcgcctgagccact

SEQ ID NO: 670790 - DNA, 368 bp, Homo sapiens
ttatgcccagccaaccatggcataccagtggtgcacaaggatcaacgtcacctaatgttctatcctcagcaaagacctttctacagcctccactaacaaccacagcctaagccattctattagtccgttcttgcactgctataaagaaacacttgagactgggtaatttataagaaaaaaaaaataggtttcattgactcgcggatctgcaggctgtacgagaagcatgataccggcatctgttcagctcttgtaaggcctcagaagcttttacttatggaggaaggtaaagcagaagcaagcacatcacatggtgaaagcaggagcgaaagggaaagtccagtgtgtgtgtgtgtgtgtgtgtgtgt

SEQ ID NO: 670791 - DNA, 470 bp, Homo sapiens
  misc_feature (37)..(37): n is a, c, g, or t
catctaggggatcttggctctgtctgcccaggctggnatgcagggcacgatctcgacactctgcaacctctgcttcctgggttcaagtgattctcctgtcaacctcctgagtgtcaggcctctgagcgcaagctaagccatcatatcccctgtgacctgcacatatacatccagatggcctgaagtaactgaagaatcacaaaagaagtgaaaatggcctgttcctgccttaactgatgacattaccttgtgaaattccttctcctggctcatcctggctcaaaagttcccgcactgagcaccttgtgacccctgcctctgcccgccagagtgcaaccccctcttgactgtaattttcctttacctacctaaatcctataaaatggccccactcctatctcccttcgctgactctctttttggactcagcccgcctgcacccaggtgaaataaacagccttgttgctcac

SEQ ID NO: 670792 - DNA, 176 bp, Homo sapiens
gctcaaactaaagacatcggctaatacatagcgagatgtgtgcaaagttcaggggaagcccagcaggtggctccacctaaccaccactacttggtggggcaggtgctgaaagctgcaggactggccacgacccttagtactgtcaactctggcttcctttacaagaaaataggagc

SEQ ID NO: 670793 - DNA, 676 bp, Homo sapiens
gggttacgggataaaagtttgaggccggagggagcgaggccggggagtcgctccagcggggcgctccagctccctcagacgtgggctgagcttgggacgagctgcgttcctgccccaggccactgtagggaacggcggtggcgcctccccaggaaaccggacgactgggtccagccgccgcagggaatgacacctggtgctcctacagccacggctccgggcgtgtgaaggcgagccccagaagccgtgccctgcgacgcccgcctgggcagcaccgataagtgagctgacgtgcaggagcctgcgaccacggtgcagggcccccaaagcgccagggaaccccgtgtgcaagacgaggaacccctgcgaggggtcgcaagggtcactgggattcccaagctggggacaggacacacccgagaggacgatagatcacacagaatgagcccttggacagcggttgattgggttgactttgctttaaaaagcgcaggggggtcgggagagagaaaggggaaaaagtggagcgatttgagagacattcattctctggaagataaatagtgggatgcgccgattattgtgggctagagggcgtgagagagtttagcgtttaaagtcaagagtggcttcaaagtgagaagtgggggaaaaacaagacagcgatggaagaatg

SEQ ID NO: 670794 - DNA, 144 bp, Homo sapiens
tgttatcaccccctcattagacggtgactggacttcagatctggtgatgctggaaatggctcccagcgtgagatgttacactgcacgtggagcacccagctccagagcccatcaccgtggagtggcgggctgtgtaccgagctc

SEQ ID NO: 670795 - DNA, 176 bp, Homo sapiens
tagtgtcttattaaaatcccaaactactgccctcctcctttatagggtcacactttactacttccttttaaaaatgttttttttattgtggtaaatacatgtaacatacattttaccattttaataatgttttaagtgtacagtgaagtggcattaagtacagtaaaaaaaaacat

SEQ ID NO: 670796 - DNA, 383 bp, Homo sapiens
  misc_feature (37)..(37): n is a, c, g, or t
  misc_feature (40)..(40): n is a, c, g, or t
ctctcagggggccccccttttctccctggctttcccnccnaaattcaaaagggatttccggccctggcccccccccccattaaatttaaattttttccccccccggggggcaaaaattttttttgggggggggggcccctttgggcctttttgtcccccttcccccaaatttggttcccccaccaggaataaaatgaaaccggcccttcctttttcccccccaaagggttttaaaaccctttcccgctcctttttgtttttggccccccccggggaatttcctggggaattagccccccggtttttttcccattctttcctaccccaagtttttcctctttccccttttttttttttttaatttttaaatggggccctggtta

SEQ ID NO: 670797 - DNA, 162 bp, Homo sapiens
agatgtgtgctgagctaatctgtcagtctactttacctcctgcctaagtcacatttcaaggcactagtccggaagcagcaccgccagtattaaagatacctcctccgaaaggacgaaggtacttttggcttaccttcctccatgtaccatcttaaggtatat

SEQ ID NO: 670798 - DNA, 429 bp, Homo sapiens
ttcatggttacagaaattaatgatcaggtaatcaagtatacaactagtatgtacaggtatatttatatagttaatacaaacagagagttaataaattactggaacattgagctaaaaataaaacagattttcatgtattcacatactgtctttctgcaagcttatctttctgaaatggaataaacctttcttagactattagttgttccaattgctagctaggcggaattgagcttttcttgtattatttcatttatttacttatttttttgtttttgagatggagtcttgctctgtcacccaggctggagtgcaatggcgtgatctcagctcgctgcaacctcagcctcccaggcccaagcgattctcccatctcagcctcctgagtagctgggactacaggtgcacacccctccttggtgcctctgg

SEQ ID NO: 670799 - DNA, 403 bp, Homo sapiens
gctgaggaaaaaaaaatcagtgatgcttgaatgaaacattaatggaaacttcaaaaacttaaatgcaaagagaaaagaataaaaaagacagaacagaatatccaaaaattgtgaaagaactacaaaagatgtaacagacatacaataggaatgctagaaggagaaaaaggtgagaaacaagcagaaaaatatttgaagcaataatgacaggatttctcacaactaatgacagaaaccaaagcacttatccaggcagcacaaagaacaccaagcagaataaatgccaaaaaaacaaaacaaacaaacaaaaaaccccggaatttaggcattcatattccaactgcagaaaatcaaagacaaataaaaaatattaaaagaagccagaggaaaaaaattgtctata

SEQ ID NO: 670800 - DNA, 412 bp, Homo sapiens
  misc_feature (410)..(410): n is a, c, g, or t
cttgactctgtggacttgccccgaattcttactgcatgaagttcagtaacactgtctcgggggctggattgggacccttttccggcagtaagttaatgtacttaattaaggtcacacagctcataatagagggaggctggaattggaccccaagcctaactcaaaagtggattatttttttttttttgaggcggagtctcactctgtcgcccagtctggagtgcggtggcgtgatcttggctcactgcaacctccacctcccaggttcaggcgattcttctgcctcagcctcccgagtagctgggattacaggtgtgtgccaccacacctggctcatttttgtatttttagtaaagacagggtttcaacatattggccaggctggtcacaaactcctgacctcaggtgancc

SEQ ID NO: 670801 - DNA, 410 bp, Homo sapiens
cgtcgacggcagctccaactgccatggttagacagctaatgcagcagttgctatagccagtgagatggctaaccgggctggacttcagctggaagaatgaaatactttgatgggggatgctctgctctcacacaataacaacaacaacaaccaaaagatgcacctgttggtctgaggattgccatggttaccagaagatgctattcaggcttccaagggagggaagcacaaacaacagaaacagacacataaggtttcatccatatatttttgcatatatgtacttgtatatgtgtatgtaacaataatatacaaagaaaagttatcaatttgaatgggggacatggtggggagggaaggtgggtggagggagaaggaggaaggtcgacgcggccgcgaatttagtagta

SEQ ID NO: 670802 - DNA, 464 bp, Homo sapiens
aggtgattggatcatgggggtggtttcccaattcttatgatagtgagtgagttcttatgagatttggtggtttaaaactgtgtggcacctgcctcctgccttctctggtcgccttgtgaagaaggtgcttgcttctctgttatggtttggctgtgtccccaacaaaatctcatcttgaattttaactcccacaattctcatgtgtcgtgggaggaacccagttgttggggggagggggcggtgattgaattatgggagtgggtctttcctgtgtttttctcgtgatggtgaatgagtctcatgagatctgatggttttaaaaacggtaatttccctgcacaagctctctttttgcctgctgccatccacgtaagatgtgacttgctcctcctcgtcttccaccacgattgtgaggcctccccagacatgtggaactgtaagtccaataaacctctttcttttgt

SEQ ID NO: 670803 - DNA, 229 bp, Homo sapiens
tgatgcgcagactcgtgtcccgaggcttcaaaacccgaacaatcttcctcctgatcgacggttgtagaagatgctgctgctgctgctactgctatatgtgtgtgtgtatgtgcgtgcgcgggtgcacacgcactgtgtgcgtgtgtgtgtgtgtgcgtgtgtgtggtgctgaagaagtggaggttgcttggccttccctactgggtgtggccctgatgaactcactgag

SEQ ID NO: 670804 - DNA, 150 bp, Homo sapiens
cgacgattcgggaactgcgagccgctctcacggaccgactctcagctcatggaggatcgccctgtcagaccctgctgccaaggaaaactgcatgatgcacctgctccgctccctgcccgaccccaacctcatcacctgggtaccgagctc

SEQ ID NO: 670805 - DNA, 1303 bp, Homo sapiens
  misc_feature (482)..(482): n is a, c, g, or t
ggcttaggctgacgcactcaggtccccggggcactgttcgcacacgacggcgggtgcatcccgtctaggtgcgcatcgcccgatgcggggaagtactcggtgcactcttgacacgggccgagcccagatgcgcgacacacacagaatcaggcgtcactatggtgtttcggcgagagatgtgatctgagatgaaccggaaacattggcaactcagaccctgcatacaggccagactactcactgtgggagaacgctgtagacacgtgtctcacaccatgagagtaagagaggctagactgtggtacataacgaaaaagagggaacgaactacgatagcgtgagacattttgagtcgctccgcacatggagagctcgcgttgccttcggattgaaatccaattgaaaaactccgggggtatcccgaattgggagcctcgttgtcacgtgcttgcttgggcctccctctccgagctgcgagcacnctatatgtcggaacgcgctgtaacatagctatatcgataggtctctctggcacgcatattgcccgaggaaccccagaggtaaattcctaagcttggggtcgaaaaaagcgggggccaacgaaagcgagcgtggagggggcgcggcccagcacgttgttgagaactgggcaaccccggcgtgaatccccttcgtgttaaacccgggtccagcgatatcgccaggttgccccatttcggaaaccggtggaacgccccgttaagggcaattgggccgttaggcacggggaacccttttgggggccctcttttttgccctatggggggggggccgtttgtcccccccgagtggtgcatttcggaaaatttgcccggcgaacctgttgcccggcccgttgggagccgttgggggcagcgcattgaaggtcaaattccggtggaagcggaagtttcctccgcgggggaacaccaggtgggggggaagaacttatcccgtttccattcgaagcattattccggaaatttaccggaacggcctttacacacccggaaaaaatttccccccgtgtggtcgcggaaagagagggggcgtagagagcgggtactctctcacacactttcccaacggtgaaaaaagaccccaagaagtggggagattttccacttaagagttgggtggacaaagaggcgcgaaacccgacgcgttgttttccgcaagtggcgccagagtgtttgtggggcttgggaacaaccgccgataccgttgtgcgccgtctctaagaaagtagaggagggttgcttttcacgtagggggaaaccaaatt

SEQ ID NO: 670806 - DNA, 148 bp, Homo sapiens
tcccctattctgagcccataaaagacccagactcagctgcagtgaggagagaaatcaccctgctgtgggggttggggaccactccctgcatcccctctccagtgagagctgttcttttgctcaataaaattcttttctacacatcctc

SEQ ID NO: 670807 - DNA, 320 bp, Homo sapiens
atgtgtatctcgataatagatacttgcttctggttctgagtggatgctgaaagagccgtggagctacgccgatgcaggtgaaacaggaagcaacactgaagcccgaagaatgagttcacttgtaatctcgcctacgctaagcgcgtgaagcatgcagaggaatgggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagct

SEQ ID NO: 670808 - DNA, 407 bp, Homo sapiens
cggtccacgcgcctgtgtgtactgtccgcgtcacagagtgtacagatgtgccctgtacaccttctgacatgtgagaccgagctctacacggtttcagtgacctgacctgtgaccatgtggtgattccagctcagctaccttcctgtggtacaccacaattacatgttacacacacctggtctgtcacagacccttacaccagggcacacacgcaggccgtgtgctgtcagcctctttgcttgtgagaggtctttccagacgtcttgggccaggggtgccctgcggctcttcgtgtaccctaggcacatgcaccagattccgtatgagtcacgctttgtgcacaagggtctagacccctctggactgttccatatagcaagcactaagggtcgggtgtttggtcttcg

SEQ ID NO: 670809 - DNA, 477 bp, Homo sapiens
gatctatcctggagagtcgacacgagttacttcgaagacgtaggatagcagcaattccatgaacgctctgctggagaaattgtggtctgtggtctaggattgagggattctgtagaacctaaaacccacgatggaaaagaagacacattacacacatgtggatctttgtctaacaaatcatttacatggcaaatataaactgcttatactcattagcatataagatagcatagagggcaccaatttttacccacctcagttttcatcaaagaataccctaagaaatctaactcagtgacaggtgagatttaacaccgtcagtgagaactcacatgaatatggacatacaatacataccagattcctatatatatgctcaaacccaccttgctttacccaaatagtgatcaatacatctttatggcaacataggaccaagcataatcaccattatagactgcagacattaaaaaaggc

SEQ ID NO: 670810 - DNA, 364 bp, Homo sapiens
ggtcgctctagagtatcccgctccgacggggtggctgggattacaggctcacgccaccatgcccagctagttttcttctttattttttgttgagatggggtttcaccatgttggccaggctggtctcgaactcttgagctcgtgatccacctgccttggcctcccaaagtgctcacaggcttgagccaccatgcccggccctaatttttaaatttgttgtagaagcaaggtcttgctatgttgtccaggctggtctcaagcgcctggtctcaagtaagcctcccaaagtgctggggttctaggcttgagccacctcgcctggcactcgcaccgtttttctgtgcatgcatctccactcccactg

SEQ ID NO: 670811 - DNA, 1421 bp, Homo sapiens
gggcagcctcacctacgagacctgcagccccgccgaccagctgaggctccccgtgctgtaggacttatacagtctatggccacgtggacagtgcggctgcctgccctccgctgccttccgcccagggtcccttcaggagggtccgtgcgtttttgcatgaacgacccaagaggggcctcctggctgctccacttcgcagccatctcgcattttagtttacacctcttccgtggttcaagcagatgttctttctctatcaggcctggtggcatgttgccatggggtctctcccaaggcaacgtgcgagtggtcccaggaccatgtgaggctttggaatgactacggggtgatccaggagaaatgcacgtggagaggccacgcacgggggccggagcatcaggcctgacatattgcgaggtagcatactgtcctagggatgtcccgttgtcgtacgaatgggactcggtaccggtcggtcgattggcgcgatgcgggggaaagggcgtcaccgtccccagctaggcacccctagagaagcgcggacctgaattccattgccagtaaagggccccaaaacggccctaccacttctcaccttcggcagttctattccactgcaacccccatatttcacccgttaaccccaggcacgccccatgtgtcttctccacaggggaaacgcacttgtggcactgaaattcgcaaagcaagcacgattggacaatcgcaccaatatccctggcgtgccactccggagatgaagagtccccaaccagcaccttggttttgcacaatggttcagcctgtgtggagacaccgtgtggaaagcccccgtggaacctggggcgtaatggcacagtgtccgcaactttgactcatttggttctcacatataccccctgtcggttcacccatacacggcccttcaatgtccggtaatcctggccggcattaccccgtgcggtccatcccttgtcagtttacctgtctgtccacaatgacatatggggatagctgcagaaactcccgccgggatacaaaggggcgaaatggctgccaaagtacacacaagtgtctgaatgccggaagcagcccaacataagggggccacaccacccactgttctggcgggcaatatcccttgcattatttacccacaaagcgaccactgccacccataccatctagtataccccatagtccgcgaacaagcatggcgcgcatccacccttcttaattcattacacgttacgactgtagcgccatgtggacacaagggcaaagtgccactaggtaaataggacgtcgtatagacggacaaacacacgcgaggaaattcacctccgccgacagaaaggcccaagcatgaccggccacagggggtgcaaaccgatctgacacactacctggtttgacaaccc

SEQ ID NO: 670812 - DNA, 1455 bp, Homo sapiens
  misc_feature (1454)..(1455): n is a, c, g, or t
tatcatttacgggggaaggcgcttggtgaagtaggccttatttctcttgtcctttcgtacagggaggaatttgaagttaaatagaaaccgaccgtggattacctccgggtctgaacctcagatcacgttaggactttaatcgttgaacaaacgaacctttaatagcggcgtgcaccatcgggattgtccgtgatccaacatcgaggtcgtaaaccctatttgtttgatatgtggacctctaaaataggatttgcgcgttttactccctagggataactttgttcccgtgtggctcaagtatatgggattcaatgtgagttattagtagtctcgcttgtgaacgtggtgtgaaaagatctttagacagtgttacgtgctctcggaaggtgttgggttctcgtggcctccgaaggctcgccccccaagcgcgaaaaatttttataatgtgcgaggtgttgtggatagattataggaaccgtggtggagttgtggtaagagtaactgtgtgtggctattcatatcaatattaaagtctccccataaggggttctctctgcgatacttgggcggtggtattatagccccgactcttcttacagcgggcgaggttccaatttccagctgggttaaaaaagttaagaagaacaagttgtgagaccccctctggggagcccattctattacgggtcccctaattttcagggacaccccggcttgttttttgcgtaaccttgtgccaccgcgttaggggtcccccggcgggcccgtttaacccttgtggttttcccctggggccagggcggggggccctactaaataaacggcgggggaaaggcccacacaaggcgcgtgcaatgtttgttgttggtggtacataaccagggcgcggcgggggcaaaacacattgtggccgcgaagagtaccccttttgtaaatcttcttgtgtaaaacacccctttcccttttattgtatgaacaactgtccccgtgtgatgtttgagggttgttaacacccaggacgggggggtcacaaaacactgacaccgcggtcgggacagaaatgagtgacaccactcatgggggcggcgacgacaataggttgacacaccacacacaaggagttgataaaacacatgacggacgaagcgccttattcggcgggggaaaaaagaggtgcagtggggactatatatacaaaaaaacaaacatgtccgcataaggggaaggagaaacagaaccccaccggcggaaggtggcaacaaaataatttaggaaataaaaaatgagtgaagaaaacacaaccacacatcacaaacaaagaagaaaagcgagtatctgtgatttataaaagaacgagcagcactgtaatcatacaataggaacgacgagccaagacaccctacctgcgtctttgttttcttgacacttactcatctacagtctataatacactnn

SEQ ID NO: 670813 - DNA, 379 bp, Homo sapiens
  misc_feature (234)..(234): n is a, c, g, or t
  misc_feature (289)..(289): n is a, c, g, or t
ccgctttctttggaggaaaccaccgcatcagatctgcgctgcggcagcagtgcatggctacgaaccgacctgagcgactggcatgcacttgagtggccactgttcgtgcaggagtacctgagtcgacacagtcgtagccagagcgtcgtgcgtgaactgcgttcgtggcagctgccgcccgaccgttgtggcccgtggggtttaccatctttgtggctgtgcttgccaggcctngctccagcctgttctcctggcacccggtgcttatgtctttggctttctccttccngatgaccgaggcactactggtgttttctcctgagagttcgctgctgcactccctctcacggaaaggccgagcacgctgccactgggtgct

SEQ ID NO: 670814 - DNA, 478 bp, Homo sapiens
  misc_feature (2)..(2): n is a, c, g, or t
tnttaagagaagatgaaagtaaactaaatccaatctaattccaggatttaacaagtcttgcagacgaactgaaaacccctaagggtattcaaatgccttgttactcaaattgtggccggcagactggaaggcagtggcatcacctggaagctggcgggaaatgcagaatcccagtgtggtgtaatatgaaatatatttggtccttgtccccaggtcctgccacatagctcctcaaacccttggaatttcctgataggaatgttgtttgttattcataatgagcccatttgatcacacttcagtggatgctaataaggtgacttagggtgggggccctcagatagcccaggttggagctggtcaccaggaacaagttattagaggattagagggttgggatttttgagccccacctgctgacctccaggaaaaggggggccatgggaggctggagaccaagctctataaaaactctttt

SEQ ID NO: 670815 - DNA, 287 bp, Homo sapiens
caacccatcctacttctgactactctgggaacctcatacaagaggaatcatacaatatttgtcctttcgtgactggcctgtttcagcgcaacgtattcaaagttcatccatgttgtaacctgtcaggattcccttcagcatcttaaaaatataatttgaatatagttttttttttttttccaagaaaccaattatttacaacctttacaaagtcctacaatctgccacatcagttttacacggggaagggaattagaagaggggaatccacgtcaatcacagacttc

SEQ ID NO: 670816 - DNA, 1460 bp, Homo sapiens
caactgaacgttgcatgcaaaggacagagcgatttacatggactcagtcagatgcgcagcataatgcagagtagacgtcaatggctgatggtgacaagactgtgtatacgaccagtggagtctgaccgacatgcaatgttccgcaagccaggacctgctcggtctgtcgtgatgttcatgcgatgtaaggcagatgaggggcagagagaaaggcaagagaacctcacacaggagagctcagtgagcagtgtagtgacagtcaactaccgcgagcgatattgcgccgcaggcgcacagaggcatggctgtgatgacttgcaaccaggcactggtgtcgcgctgcaggctccctgcgacagacaaaaggccacacacaaagtggcgcaaggcaaggtatagcgacgccagacgtctctcgctctaagatgtgaggctggacacggaacatatacaccacctacttcttagacgcgatgaagggatcgagagaacgctggcacaagtgtataggcacagtagaccacaatatgggatagcgcaaagcatacgcccttcccatgacgactgccataaaaggcaaccgtggaggcaacttgcagacttgattccatatgtgcccgttcctttccgcaccttgaacccagtaccgcccgaagcaccaagggaaacggttatccccaatcccccgatgggacgaaaccaaaaacgcgagccgcatatcaggggggcgttatagagcacagttatccataggaggccacaaacgtgcgcacaggcacgagttgtggcgccgattgtgcatgataacacttgggattacaaccaacacttatggagcgaccaactttcaatacgagacgtttaacccaaacagatacccaatatacgcctatatataaatcataaccagattaaagtttccaccgaagtcaaacgggcaaagtttacctattacaggcgaccgcaagaaaagacattgacggcaaccttcaccgctcggcgcaggaattaaacggaacggctggaacgttacagacccttaaacggtgatgatgtgtcgcccaacggagaacaacgattaacggcctggagcatacatatcacacggcagctatcacaccacaccgcccgtctaccgatggcgacgacgcgatacacttcacactaggagttcagacgcggattaacacttaataccaatgacaaaagtatcatcagggacagcaccttaaacttaatccctcgccaagcctaaccttggagagggagaacaatcaaaagttagaacatgacccgattaaaaagagttcatgaactactagtaaataaccgacaagatgcacatacacaacactacagcaaagaacgattctcccgatggggtcgtcccacacaatagagacttatggacttacaacagagcactcaatttggaccgccaaacaagtctaagggaactt

SEQ ID NO: 670817 - DNA, 982 bp, Homo sapiens
  misc_feature (322)..(322): n is a, c, g, or t
  misc_feature (365)..(365): n is a, c, g, or t
  misc_feature (368)..(368): n is a, c, g, or t
  misc_feature (375)..(375): n is a, c, g, or t
  misc_feature (391)..(391): n is a, c, g, or t
  misc_feature (424)..(424): n is a, c, g, or t
  misc_feature (427)..(427): n is a, c, g, or t
  misc_feature (455)..(455): n is a, c, g, or t
  misc_feature (459)..(459): n is a, c, g, or t
  misc_feature (483)..(484): n is a, c, g, or t
  misc_feature (515)..(516): n is a, c, g, or t
  misc_feature (550)..(550): n is a, c, g, or t
  misc_feature (580)..(580): n is a, c, g, or t
  misc_feature (626)..(626): n is a, c, g, or t
  misc_feature (629)..(629): n is a, c, g, or t
  misc_feature (631)..(631): n is a, c, g, or t
  misc_feature (638)..(638): n is a, c, g, or t
  misc_feature (644)..(644): n is a, c, g, or t
  misc_feature (720)..(720): n is a, c, g, or t
  misc_feature (844)..(844): n is a, c, g, or t
  misc_feature (936)..(936): n is a, c, g, or t
tatgctaacaaaataattattatattcattgattctaagacaaacttttttttaccttttaaaatccttgaaattggcatgtattatacaatccatggcatgtcataatttaatagaactttctttcataggatacattaaaaagtaatgttgcgaggcacagaaagataaatattacatgttctcactcatatatagaagaaaaaaagtagatctcatgaagatagagaatagattggtggtaccagaggccaggaagagtaggggagaggaggaaatgaaaagaaagtgcatgatgggtacagcttcgatagataaatangacctactgtttgatagatgagtagggtgactatactttacantantctaatngatacttgaagatagntgaaagaataccttgaatgttctagcatagagnaangacacatatttacgatgatggacatccncaantacactgattcgatctttacaaanntatatgaatgtcatatcacatactcctgaanntatatacgtctattattgataataataatacgtngattgcataatcaatgatgccttagacttngatgaaaacaatattgtttagaactgatcaaaggatctttaagaangangnatagcantgccangacacccttgaaggtaatggatatactacttcacccttatagccacctgatgacccacatttttggattggtcacngagaattcagagcttaaaacttggcttgttgaccggtagcgtaataagcttggtggcacaaccctttttatggtttaaatggcagcaatgttcctcaaacactgtaaccgttgaagggcttcgnccaaaatttaaactatttcttacggacactacgtctaaaactctgtataaagattataaaatctctgatatgcctctactccacctaacgtntatctgtgggcgtgcgcctttccatataaattctactgaggtgacg

SEQ ID NO: 670818 - DNA, 360 bp, Homo sapiens
gtgttagggaacaacgctcttggggacgggtgcgagatttaagattagtgaggaggtgccctgcctcccagaccctggggcacttgtttatggggttccaggaaacagttcttggcggttggttcactttcttgattgcagccaggaaatgcagtccctgtggcctgtttttttgcacaagtaggaccttagaaaaaacactttttaaaaatgacttttccttctttttcagataccctcaaaaagttatggattacttagtatggctgaaggcatcgtgacagatgctccaacctatacaacaagagatgaactggttgccaaggtgaagaggagtttagagcataagtttgatatttg

SEQ ID NO: 670819 - DNA, 567 bp, Homo sapiens
agaattgctttaagaccgaatgtgtggttgatctcagaatatgtgccatgtgtagatgagaagaatgaatattctgttttcaggtggagcattctgtcgatgtctgttaggtctgtttttttcaagtgtcaagtttagattctagatgtctctcttagttttctgcgttgatgatctgcgaaactgtcagtggagtgctgaagtctcccactaatattgtgtggctatctaagtctcttggtaggtctctaagagcgcgcttaatgaatctagatgctccaatgttgggtgcatgtatatttaggatagttaagtcttcttgttgaattgaaccctttatcattatataatgccctttttgattgttgttggtttaaaggctgttttgtctgatataagaatagctaccccagctgggcgcagtggctcacatcttaatcacaagacgcagtggtggaagttggagcacgatgcccaccataattaagtccttatcctgccacagagactgacagttagttatctatcttaatggttgcatttctaaaatctctgagatgaaaattc

SEQ ID NO: 670820 - DNA, 346 bp, Homo sapiens
gtttctcctcatgaaaagcagtccctggattttgggccatttgaacatgctttcctgttggggggtatgtcactagggcagtggggagacgttttaactttgctgcttcccaaggatggctgtttataatttggggaaagatagggtgggaggcagggcaatgcaggatcccaatcctcatttttcttttccggccttaaggatggaactgctgcttgtcctgttcaagttgctggagcaggggtcatgttaggcccggcctgtagctccttcctgggggctatttttactttccttttggatttttggtttgtgaaaatgatttaataaaggggactggctttta

SEQ ID NO: 670821 - DNA, 1921 bp, Homo sapiens
tgagaggaggggtaaatatatgtttagagcacctttcccagaatctcaggaatgtatagaccctcacccccaaaagataaaagaaaaaaagaaaaaaaaaaaaaaaaaaaaaacaaaaaaaaaaagaaaaaaaaaaaaaaaacaaaaaagaaaaaaaagaaaagagaggaggggcgggcggcccaaaataatcatctcccgccagggggagcaccgatccccagccaccacgagttactctctgtagctgagaacagagaggacggcgacgacacgaaggagagaagaaggcaacgccatatacaacatcaaaacgcgacagagaggagggacacacatgagaaaaaacaacaacaacaaccacagagaggacgggcgagagaaaccagccgagcaccacgagagaacaaacacaaccaagcgacagaaaaggcaagtcccctgcaccactcacacgtggcagaggagcgcaccgaggaacacgcaccacacaagaagcatacgcgcagcgccaccaaacgacacaacacaaccaactcacaccaaggaacacgacaaacaagaagaacacaccgcacacgcgggcgcagagcgagaccgaaccaccaaccaacacaccccacccctaaccccacaacgagaacagacacacacaagagcgacagacacaacacacaccaaccaaggcccagagacatccacaacaaacacacacacgccagcgcaagcacacaagcaagaaaccaccaacacgaccagagaccagacctacacgagacagagcagcgcgcagcaacgagccacacactcagcagacatcgaaaaacaagacaatcaattaatcataaccgtagaccgacagaaggagcaggacaggaacatacaatacaccaaaaccgcaggaccacccaccgccacccaaggagcagacgaacagaacacaccagacaaacacacccgagcacaacaccacaccaccgaaaaaacaaggcaacacagacaacacaaccacacaccaccagaaaacctgagaacacacagcacagccagacacggacaggtcacagaccaagacgggccagccacacgagcaaactgaacaacagacacaaagcacaacacacacacacagagagaaagaagcaaggaaacgcgacacagacaagtccaccacaaagacgacaccacaaaacacacaacagaacacacaaccacacaacccacaaaacacccacgcacagcagcaaccctccaccaccagaaaacacagacgcacaaaaacagcagaacaccaccagccacatagcgacacgaccacccacacccacacaagaccgacgaaagagcaagatgacacgacagagcaagacgaaaaaagcgcgcgccacagaaaaaaccaagagagagagcagcaccaaaccaggacgaaccgagggagaaagaccacagaaacgagagcacagacacgagacacaagacacacaggacgacagaggaagccgcacacacgacaggagagcagacgcaaaaacaagaacgaagacgaaacacgcaacgaaaacgcacgacagagaacacgaacagacaaagcaaggcgaagagcaagcgcagacgacagaacagacggagcaacgaagagaaacagacgagaaaaaacgcaacaagcacagacgcgaaaccagaagaacagaaccaccaccgaacaccagaaccacaaaaagaacgaaaggaaaaaacgaaaaaagaaaaaaaaaaacagagcgtacacggacgcacaagccacagacaagcgaggtggccacagacacagaggactaaatcacaaaagaacgaccaagaggacacgagaacgaaagaagtacagaacaacaagaggcagacaaaaagacgaagatacaacagcaacagagagtgaaaagac

SEQ ID NO: 670822 - DNA, 134 bp, Homo sapiens
cagtcttctcccatcaggttgctgagaatgtcattatttcatttctttttatggctgagtagtgttccatggggtgtgtgtgtgtgtgtgtgtgtgcacatgtgtacctcacatgttctttatccacttgttgg

SEQ ID NO: 670823 - DNA, 446 bp, Homo sapiens
aggccaatggcctccagccttgtcttggctaaagtccatagcaaaagtattgttaccagggggtccttgctcccagagctcccaagatggtggccggccgcttccaaaatgggggtggccacttccaagatggtgcaagcctcgtgttctctgacctggggttcttggcctcagatattccaaggaatggaatcttgggccatgcggtgagtgttttagctctattagaagccctgggtcacggaagagaactgtggaacccagtgactagtgttcagctcgattaggatgaacccaggcacatagctgtgcaggaacaatggcaagcctttagcctgactgggagtggcagtgggtgcctcgctggttcaggagcacagcagacaccctgctggatcccgagggatggaagtcagcagcgggtctgcaatggcagcaaacagcag

SEQ ID NO: 670824 - DNA, 128 bp, Homo sapiens
gcatcaaaacggctcccgtactatgactttctcattctccctgggtacatcgaggtcactgacagaccaggtggaccatagacgttctgctctgaccaagaaaaatcactcattaaaaccccagtgga

SEQ ID NO: 670825 - DNA, 309 bp, Homo sapiens
gcgaaaccccgtctctgctaaaaatacaaaaattagtcggtgtggtggtgcatgcctataatcccagctactcgggagtctgaggtgagagaatctacttgaacccaggaggcagaggttgcagtgagctgagattgcaccactgcactccagcctgggtaacagagcaagattccctcaaaaaaaaaacatttatttttaaataaacaggccaggcgcggtggctcacgcagtattcccagcacttggaggccagcggcagttcactcaggtcggagttcgagactagctcaccacatgagaacctct

SEQ ID NO: 670826 - DNA, 118 bp, Homo sapiens
tctgcacgaagtgattgttcccctggttcactctacttagtcatgtccctaccgatgtctcttctccactggatggaggaaaaccaagccgtggcttcctcacatccccttcggggca

SEQ ID NO: 670827 - DNA, 215 bp, Homo sapiens
  misc_feature (42)..(42): n is a, c, g, or t
caggggtcagttcccccccccccccggtcccaggcccaggcngaagccagggcccagctttcctccctgttcctgtggaggatgtttacgcccaggcgagctcctcgccctttgaggggccatctccccgacccctgcccagccctttgctccccccccaaagggggggggagggggggctttatattttctttccaaataaaattttcttttta

SEQ ID NO: 670828 - DNA, 341 bp, Homo sapiens
  misc_feature (18)..(18): n is a, c, g, or t
  misc_feature (99)..(99): n is a, c, g, or t
  misc_feature (106)..(106): n is a, c, g, or t
  misc_feature (116)..(116): n is a, c, g, or t
  misc_feature (139)..(139): n is a, c, g, or t
  misc_feature (213)..(213): n is a, c, g, or t
  misc_feature (249)..(249): n is a, c, g, or t
  misc_feature (329)..(329): n is a, c, g, or t
ctattcaaagtcattctnctgctcactgagataaatgcgtatctaattggctcctttggaaaggctaatcagaaactcaaaggaatgcaaccatttgtngcttgtntacctatganctggaagccccctccccactttnttgtcccacctttgcttcaagttgtttggcctttccagaccaaaccagtgttcaccttacatatactgattgangtcccatgtctccctaaaatgtataaaaccaaggtntgctcggaccaccttgggcacatgtcgtcaggacctcctgagggctgtatcatgggtgcgcatccttaactttgggcaanaataaacttcct

SEQ ID NO: 670829 - DNA, 701 bp, Homo sapiens
ctgatgttcgccgaccgtagattatgctctacaaaccacaaagacgtgggaacactatacctatgattcggcgcatgagctggagtcctaggcgcagctgctaagcctcctttattcagagccggagcatgggccagtcgaggcaaaccgttcataggtacagactctatatctaacaacggttgatcgttctacaaggcccatgcaatttgtgaataatgcttgcttcataggtaatacgccgatcataatccggagtgctaaagggcgatcgtgactgagttccccctatataattgcggatgcccccggatagtggacggttagcgcccgtctgtaagaacaactatagagtctgcgtgaccctctttattctcccgtcgtctccatactccgtgctcggcattcatgcgtagtagatggagagcccggtacgcagggaaacaggttaggaaccagatcttataccgtctctctattaggcagggggaactaattcccacgccgggaagacctccgtgaggaacgctaaccagtctgtactccatgtagacgcttagactggtgtcctgcctacgtatcttaaggggccatccaagtttcaatcacaaccaaatttattccaattatgaaatacccccttagcaaggacagtctgaaggaaacccgtgttacggtacaaatctagcactaaaacaagg

SEQ ID NO: 670830 - DNA, 185 bp, Homo sapiens
catgttggcccacgtgtcgacgatacggaaaccacggagtcgggtgtgggggagaggtgtcacacccccgcccgagttgtgcatgtgcagttgactggtgggagtgggacagccatgaggtctagggaacttggactcggggaggctacagacctcggcgatatcctgctgagggggaaagcgcg

SEQ ID NO: 670831 - DNA, 343 bp, Homo sapiens
ctgttattctatcctcctccccgcctcaggtccacggcctgccatggtgtattaggggcagctgtgcctgcggcagcattggcctttgcagcggtggcagcagcaccatggctctgcagcggaacccccagcggcttaagccatggcgcttctcacggcatacagcagcagcgttgctgtaaccgacaaagacaccttcgaattaagcacattcctcgattcccagcaaagcacctgaagatgaccgaaatgagctttccttaagcagcgaggtgtaggtggggaccttgatttccccctttgaacaatcgggttaggggggctaaaaaaaggctaaggcccc

SEQ ID NO: 670832 - DNA, 259 bp, Homo sapiens
  misc_feature (39)..(39): n is a, c, g, or t
aaaaacctttccatttaaaacctcacctgcgggggattnatttaaccctttaaggggggggggggcgggggggtgtgaagccaccagagggggggggcctcagggggccctagatccagagcccctccccatcttcctctctctaaaaacaaccctaccccccattgccaccttcactcctgtgtctccagctgattagcctcagactcttcttttattgtttttcttttgtaaataaaaagcaccgggttccaaagta

SEQ ID NO: 670833 - DNA, 710 bp, Homo sapiens
ggtctggaacctgctcaccccttgctcctacagccgcttgagtcctccaccaccacctgctgcggccccgggaacccctcaccttactcagcaagaccccaccgggagccctttatgggggcaccacctaccgcttgtgccccgccccccggcccagttccccacctaggggccctggccccagactacgggctgacaggtagaggggaacggggggggtcggggcaaagtctccatctccccttcctttaaccaggtcctagggctagaggttagaaagccagggctggaagggccaaaggtcataacctcagccagccacctactgaggtacatggaacctgggaacagaagcctacaaacccccacaagaccaagcatcacatggagtgtagggtacactgggagagcagaggtacacagcctctagagaaagggagaggggcgtgtgcattgggagtgtggctcatactcggggggccatggcgcctcctgaggtacaccttatgcccctggtaagggcctctaggccttggggactgactaccccaggggtcaactaaagccagaaggcaaagtggcccctcccgtacactagcacccaggtctcatgcgctccgaggctgggggacgaagggctcaggacagcgggtccatggtctattatcgcctttaattaacccagacctttgtactttacgggtcctcca

SEQ ID NO: 670834 - DNA, 604 bp, Homo sapiens
  misc_feature (590)..(590): n is a, c, g, or t
atcgtgatgggagccaaaaaaaagaaagaaagaaagaaagaaagtactggcggaataccggggagtaaatgataaaagaaatcgggaaggtaggacataggcttgtgcaaagatttcaggactaaaacaccaaaagcaatcgtaacaaaagccaaattggacaaaggggatctaataaaagagctccggcacagcaaaggaaacgatcatcagagtgaacaggcaatctacagaaggggagaaaaatttggcaatctaaccacctgacaagggtctaatatccagaatctacaaggaacttaaacaaacttataagaaaaaaaaacaactccataaaagagggggtgagggatatgaccagacttatgtggatgggtcatatatccagaatccatcatatttaattctttcaaaataaggagctattacaagaatagtttacaagtcagctcggactgcacaaatactggacacaggaaaccatttttacaaatacatatgtttccttataatacggtaatacagaaaataggtctgtatacttcctacgacaaattgggtagtctcttttgcccaatcaaccatagtgngtacggagctcgaa

SEQ ID NO: 670835 - DNA, 490 bp, Homo sapiens
gcgtgatctgcttgtccagctggatccattcatgggacccaggctgttccttcatctgcagggtcttgaggcaggcaatggcatcgtagtacttggcagcagtctgcttcacatgcccctggcggtacaaccggctgccctactggtggataagtggcactgccttcgccttgtcttcgtctgccatggcccatgggtcctgctggtacgtgccagggctctgcaccttcagcatctgcatgtgtaagatgaggcgctgagggttctgatgcagggcgtgcacgtcagcatggtccactgagctgtgttcacgcatctgtgcaacaccgcagcatgagccgctggccctacacggggtcctagcccaccgcgatgttgcggagactctcgagcaccagcgggtacaggaccacatgctagatgtcacagatgaactggacaatctccccttctcgcatggtgcacacgatggtctcccacacatgcagct

SEQ ID NO: 670836 - DNA, 934 bp, Homo sapiens
  misc_feature (490)..(490): n is a, c, g, or t
actaaggtccttccacttctgcgtcctgatggtgtagcggcccttctcacctcctgagtggcgagagacatttgggttgcacagggtgtgctgatggactactggcacagagattcccgacatctcaggtaccgttcctccagggggctataacattcgtgggactgcggccaacggctatggtagttgtcgctaccgtatgctgctccttcgaggacaactgggcctcttgactagcattatgtgtatcatcccgttcctcccttgtaccatgtgtgcctctgccactgcatggatgaactacgactggccgctgtgtgcgctcttgtgctgtccagtgtgatggtgtggtcagtgtcctggacgggccggcagttatttgcggctgtccatagcctccgtctcccgtttgactgcctgagtccacacgaggttccgaacaggccccggactgtccgcgtcctggatggaacgtcgtaagcacggccantattgttccccgactgggccgtcccccgagaatgtaacggaaatgcccatgttgcagaatgtctctggccatgggcccacatgacttgagggaatcaactcctcaaaaacatgtcaagcgtccaacggttgcagcatagaaatacttggagggtactttgtaattactacctactatactaggtcatgtccatagagagaagcccccaagcttgaaagcgcgcgagggggccctgtgtgaacccatgtgtcccctgctcggtcgcgcccgggtaggctctcaaggccgttgtgcgccgtctgtgtcttggtgcgggacggggggtggaccacctgcttcggcgtagccaggtgatccagccaaggcatcggggattgttgggggggcttgccttgaagcctcacttgagggcgagactgtgctgaccggccgtggtccccccgg

SEQ ID NO: 670837 - DNA, 388 bp, Homo sapiens
acacgatccctacacacttctccctctgctctggacgaatattaggccagcggcgccctgacgccacgctgcaccagatagcgctgtgccctgcactgccttaaccccctcggtgtgtgtgcccttctcactctgtctgctctctgtacatttggtaccgtggagcagggcaggaaccagatttgactcatggtttaccacaaatctcagctttgctcaccgggcggctggaggctctcctccctggagccccagcttctgctactccttgacccaagcccggctgctaagccttcagtcctcccaagccctcacagctgcttcagcaatcctcatgagtttggcatgtgccctttttgccctctgcagagcccctcccattcctttg

SEQ ID NO: 670838 - DNA, 1123 bp, Homo sapiens
gcatgcctgtaatcccagctactcaggaggaggctgaggcaggagaattgcttgaatccgggaggcagagattgcagtgagctgaaatctcaccactgcactccagcctgggtgatggagcaagacactgtctcaaaaaaaaaaaaaaagatattattgggtctttcatgagttgtacagggggatttcccagaggctacattgacattgtgttttttaatttgggttgtttatatacggacagaggggtctggcatatgtggcccagactgggtcttccaactccgggcctcaagtgatcctcccgccttcacctcccaagggggctggggattataggttgtgagccattggcgcctgggctgtttggtgacatgtgatgttgaaacaggttggagtatagaagcagatatgggaattaaaccagaatattaacccagacttggaagagattggcaaaaaatacaaaaaaataccactggtttacacttacttattgggttgggaaaaatggtagtatatttttcattaaaagtatgtggtgtgggcggggcacaggggtcatgcatggtaatctcaacgctggggagactggaggtggggaggatcacttggagatcaggagttcgagaccagcctgaccaacataatgaaaccccatctctaataacaatttacaaaattagctggggctgggatgagcgcaggtgggatacacgcctggtaatcccaggcacatgggggagggcaaagggcgggaccggatcaatgagggtcaaggaagatcgaagacccactgcggggaaaaacatgggtgaaaacccacatatctaattaaaaacagaaacaaaagaggcggacagacaaaaaaatatcccgcgaggggggagccaccaggaattacgcaggcaaccgcaggatagacaggtgtacacagagggggggccccaaaaaggtagagacgatatataaagactaagacacgggcccgctgcgttataacaaagagcggaaacgggaaaaaacgtcaggagggaggaaatgtgggggaggaacactaataagcggaggggggacacaagggacgaacacgacagaaatgaaaggcccagggaagaaagat

SEQ ID NO: 670839 - DNA, 432 bp, Homo sapiens
  misc_feature (26)..(26): n is a, c, g, or t
  misc_feature (144)..(144): n is a, c, g, or t
  misc_feature (311)..(311): n is a, c, g, or t
  misc_feature (324)..(324): n is a, c, g, or t
  misc_feature (361)..(361): n is a, c, g, or t
tgaaatatttctgagctttgtttacntatatgtaacttttagtaagaaaaaatatcatttcaattggaattttagagaattttctcgatgaacgggctattttattaaaacggggtccgcggcactggtgaggggtcgctgtangcccctcgctctgcttggggttggacttgggtgccaaaactttgggattcaagaaaaatcaatgagtgatttcggttttgggtaaatcccctgctttgcccgccggacccgcttgtagtgtctaaggtaacctgttggggttgcgcacagcccaccgcgtggatccnccgcaacgctganccgaacgagtaggaagcctttctccccaggcacgtgncttcagggcgtttcccattgaccagtttgaccctggtttgaataaagagaagtgcgtttggattaaaaaaa

SEQ ID NO: 670840 - DNA, 1560 bp, Homo sapiens
aacttaaccccctaataaaattaacttaaccactcactcatctgacctccccaccccactccaacatctcctgcatgatgaacacttcgtgctcacttccttgcccgcctgcctgactcctccaacatcaccacgagcgactactcccctagccactgccccgtacctcacctcgcacgcccctcacaccgccattccacatcaactcgccccacactcactcgagacctgctcacactatatggcatagcacctcactcgcgcacaccttcaccgcccaacttgtgcgcccttccaactattcgtcacacccctgcccctctataccctacaacactcgcggccgagcgccctactatctaccgtgatccatcatcatcttaccctcaccaaccaccctgcacccccattcgacgcactacactcccatacccttgcctctgccaaccctactacaccaaacaagccccttccacctaggccctactgtcccatcctcgcctgcagtgcccccacactattccacttccttgcccagcgcgccaccaccgcaaaccactaccacacacccctccccccctcactcccccgcacccactccccacaaactaacaacccgcccgcccaaggaacacccacaccccccccccaccccgcacaccccaccgccccaccacgcagcacaccctcgacgccacacagcaacaaggacaccacacacccaccccaccacaacgacactcactccaccacccgctctccaaccccatccagctcaccaggcccacccgctaccaaactcacacgaccggacaagcacaccaccactcacacgcaacgaacaccgaacaccaacacccatctcccgtaaaaaccatcactggccaacgccgacaaccaccctgcggccactacaacacaccaacgcctcaccccccacacggcgcaacacgccaccacccatcacccacctaactgcgagaccatcaacaaacccacaacgcgccacaaccacacccactcacactacacaccgcacaccacaaccacccactgaccctcactcgtgcgctaccaccattcccttccacctcctctccaccccttcccccttaatacactgcgaacccatcacaatcaaccccacactccctacacacaagatacccattcactaccccccaacccactaacaccagcctcacaccaccacctacactcacaaccaaactctacaacacccacacccccccactcacactacaacctcaccaccacttcgcaccatcccccacacacgccctcactcacactctcgcaacctcgaaccacacaccaatacacagcatacacaacgacccataccatactctcacacccactccttcacttcaacccacgactcccacacattccacacatccacacatatatctcgccacaccacacctcaacctccacactaccataccgctatcctccccctactgcacgctcacttactagcggtactcatactccctcaccatcatactcctatacatatcttctcaaagttgt

SEQ ID NO: 670841 - DNA, 422 bp, Homo sapiens
tcagctggtaccggtgttccttgtctatcttaaaattagaaaaaaaaaaaggcaggcgtggtggctcacgcctgtaattccagcacttggggaggctgaggtgggtggattacctgaggtcaggggttcaagaccagccgtggccaacatggtgaaaccccgtctctactaaaaatacaaaaattagccaggtgtggtggcacacacctgtaattccagctactagggaggctgaggcaggagaatcacttgaaccgaagaggcagaggttgcagtgagccaagattgcgccactgcactccagcctgggcaacaaagtgagactccatctcaaaaaacaaaaacaaacaaacaaacaaaatttttttaaaatctgctctatggaagactttgtcaagagaatgagaagacaaggggaaaca

SEQ ID NO: 670842 - DNA, 530 bp, Homo sapiens
  misc_feature (12)..(12): n is a, c, g, or t
  misc_feature (206)..(206): n is a, c, g, or t
  misc_feature (215)..(215): n is a, c, g, or t
  misc_feature (232)..(232): n is a, c, g, or t
  misc_feature (234)..(234): n is a, c, g, or t
  misc_feature (236)..(236): n is a, c, g, or t
  misc_feature (257)..(257): n is a, c, g, or t
  misc_feature (267)..(267): n is a, c, g, or t
  misc_feature (269)..(269): n is a, c, g, or t
  misc_feature (271)..(271): n is a, c, g, or t
  misc_feature (287)..(287): n is a, c, g, or t
gaaccgtgtcantccccacacagggcccagaggggtgagggtcccctggctgggaatggtgtgtgttggagctgaccagcctgagcttgtcttgtctcttcttcagcctggtgcctgctgaagccagtcctggagcccatacctcacccctgcctggtgaggatgtcttgttcctgagggaggccggtgtggaaagcctcgcacantggtgcctncagctgttgaagggtancncnggcccttggaggctggcactngctgacagcntntnctctctgcacctgcgntctggtgactttgggtggacgcctttggctttacttgaacaccaaaggtgcttctattaaataatgtacccaagaagttcctggcctttttgtctcttgaaccttgatgtgtgtaaggggtgaatggaaaggcttcattgccccaagggtgcaacccaaaaggggaggtggggcttgactttcttcctttcctggggaaccagggccccccttttttgccttgggggcttggccccttgtttc

SEQ ID NO: 670843 - DNA, 301 bp, Homo sapiens
tggtcggtaccttccaggcttgattgaggccaggcatggtggctcacactgtcatctcagcgctttgggaggctgaagtgggaacattgcttgagcccgggagttggagatcagcctgggcaacatagcgaaaacctgtctctataaaaaaatacaaaaaataatctgggtgtggtggaacacctcctaatcccagtttcttgggaggctgaggtgggaggatcacctgagcctgggaagtcaaggctgcaagtaggccaagattttgccactgtgcttcagcctgcaatcaagcctggaa

SEQ ID NO: 670844 - DNA, 1012 bp, Homo sapiens
  misc_feature (733)..(733): n is a, c, g, or t
  misc_feature (786)..(786): n is a, c, g, or t
agagcttcctatgaacataacgtcaagttcgccgtatcgtcgcagtaatgctacacgatagataccatggctcgatagactgatacttcgaatcgacgcattgcctgcgttgcagttacatcaagtcgtctcttagcattacgtaccatcaccatctcaatcatacactgcgcgcgagtcggacacaacacgtgactgttctctcgaagctcaagtacgataactggatgtgtcgtagagagctcatccacatggtagtactatctaagctatgcgagtccaatgtcaaactgcgatgtttcaaacttattcagtgcacagttctcgagatagcattaagttattgtagcaacttaaagagctattacaaaagaatcaaagatatgagagctttcacttccgagctaagtcgtattatgtaaacgagaagattcagctgtgggacaactaccattgaagaaatacgaaaatagagtcaaattagtactcattatgaggacaaatttatgcgacacattgttcgtttcacattattagcacagctcaccatttcacacacgagtccacttgtactaacacgcatggagattccactttgtacaccacgtttacacgaccgtttcatataaaggatattgcgaacaccagtatttacacaacgatctctacatacggcattggctcgccacactactacgagtgaagccacttcccatctatagcactcagtggngaaacaccagacacgacatggcacttccataaattcgttcagtctacttgccntggagcaccttgctcattagcaacatggttcacactattacacgtcgaactcacagtacatctgtactttagagaaactttggtacatccacaagacactatatatgagaattggcaaacgtggttataccaggatcatttggattgagagtgcatatgtcatagtagacacaacatcatcaattgtaaattgcaaacagaaatcatagaatatacgagatacaca

SEQ ID NO: 670845 - DNA, 533 bp, Homo sapiens
  misc_feature (437)..(437): n is a, c, g, or t
  misc_feature (444)..(444): n is a, c, g, or t
ggccacagagccgcggcaccatggcacctgctgaacgcgcgggggccaagaaggtgagtttcgccccctcgatcctcgcggagctcctggccgctgggctgcgagcgactccgttcacacccggcgtacattcctagacaagccctgtggcctcggccacttggaccggatggtcctgagcctcaatttttccctgtcacgggttggatagcgtttatggagcccttactcggtgcctggcgctgtacagagtgctgtgctcaaggtatctactcatgttcacaattatgcccatttcacaggtgaggaaactgaggctcggcgagtcaggcgaatagctcagggtcacgggtccagaccagcggggagcgaggatcacaagtctagcttttggacgcatgtcgcgcacacatatattgtcactaaccgaccctcanacgtagntattttggctaatacgcacgggaactcttaggactgtaccctcgcgctttggctagtccttggcaggacgcccccagagctgtcggggg

SEQ ID NO: 670846 - DNA, 908 bp, Homo sapiens
gggcaccgtcaccgttgcatgcgttactacacaaaggtgcctccagtgctgatctccactcccatccactatacctgtgatcggcgattatgatagctgcctcgggggcccgtgagcgtatatgaccgcaaggatgtggtaagtgcgaacactgaccacctacctaattaatagaccgggagtagaggcgccttatgccttcgtgcaatagggtgtacatgactgatgtaccatcgatgttagcaccggaaagttcgagaccatgacgcactgccgcgcatagagacacgaatgcaccataacctccctgaaggacgcctgaatggacgcaccactccgatcatactatagccaaagatacggtgcgcgaacgtagttccctaaggattgacggtcgaagggcacttacacggaggctcggattggatgggccctcgtcccgtgccattatgaccatttgtgtaccctgcgacccaatccccatcatagtctcggggcacgcatagccctcttcctttgcacgcaccttggtaaattatgagactatgtttgtaattcccgataggcggtcacgctgcttcgtttccggtcggttgagatctttcatatctttcgaagggccccggttcattttggcaggactccgtatgacggcacgagcgtgacaaggccgcactggaggtcccctactggtggggccaagcttcttggcccttgatgactctccggaaatcgctttgctgcctggtctagagaatggctccccccacggaaggtgaaaccggcttgctgttccttccgtcatgggaagtgactaacttgggagctatctcgtaccagtgaccctggtcctgctcgcgatcccgacgtgagttggccttgcctgggtgtggccgctgtttgtcagc

SEQ ID NO: 670847 - DNA, 1122 bp, Homo sapiens
  misc_feature (623)..(623): n is a, c, g, or t
agcggaagcggcacgggtgctgtccagacttcccggtgcttgaatacaccggaagtgctcgtcatccagcattaccatgtatgtggaccactgagaagggctcatcctggtcgcagggcgctgttgtacatgagtagggaggacttatctccatgtctaatgcacgctgcgcgtgttgtgaagattccgtcgcgacacgcgcgactagtgcaaggtcaggagcgtaccgagccacaggagcttcatggagacgtcatgcaatgtccagatatagatatgcggggtcctcgacccgtgtgggtcgcgtaaggaaggccttgctggtgatggcctgcgcattgacttggggagacgagagcgtaggtgtcccgcacacggatgttctctggctcgatgtaccctacctggacttgtagtagcgttctcctgttggctcgcgacatggaattggcgcgctgggaagatcctactctggcgctctttgcggaccagagattgtgtcccgttgggaacacgcctgttcgtgatggcctcaacctggcatttggcttttggaatgtgcgctgcatgccctgctggtgagacactgccatgcatcccctctgaggccactcctgtggtcnacccttcggagacgtgccatgtgccagcagatgagcacggcgcctcacgccaacacgctctgtcttagcgctgggctgttgcgtggccctcgtcagagggttgggtctatgtcgctcatggccaattgaattgtcacgacgcgtgcaccaccgcttcgtggcgcgagtagaaaatagtacttcaaaggacgcaagttgaccgtgcggagggaaaagaccaggtggtacttcgcaaagaatcggaacggttgccttggtgcgaacggtctggcttacgtacgtgggggcattcgcttgtagggtggccggttttgtctggccccagtggtttctaagcggtagtgacttcccttgggctgtgctcctgcggagggacctgctttggggacctttccgggggaatccgggaacgtggagggttccccctctgggatccgggtggtaccgcgttgtagttgcccggacgtgtccctttcgcccggtgtaaacatgcccagag

SEQ ID NO: 670848 - DNA, 586 bp, Homo sapiens
agcggggggctgcggcgctggcctcggagaggtgacccaagtcacgtggttccgtcttggcatggctcttcgtgacagaagttggcacactccgggagctgaaaaggaggatctggggacccggatcacgctgaccggggtgagtatcaagggtgagtgtgcatatgattagcagaagtcagtgaatcctgcctagcatgcagagcgcgcagggctgattaccaggtggataagctatctgaagacatgactgtgaaatccaggatccagtgagtccgcgggatcttcacgtatcaccggtgaattacagacttaagcagcagtggagagatcagtgtcctaagttgcttaaacagttgcaggagtttccactgctatgaagaatatcatgtgcattacagagaagaagtatgtcctggtgctcagcgtctgaagaggacgaatgctgaagtattaaatccagaaaatgcttgattaaaatattgaatctctcgcatggagctcaaatacagaaacagaccctactttatcaccttggagaagagtggagaagctgattgtatggaagttcccacatcaaaagatc

SEQ ID NO: 670849 - DNA, 1498 bp, Homo sapiens
tttttttcttgtttcaaaattacaattttttttaaaaacaaaaagagggaatgtggattgcaaaacgcccgttcttgggcttctctccggtggagttcgcccctttcccaatgtggcagatggccgctctccctgtgtgtggccttcagctttcctctccggtggaattgaaggggctccagggtgacaccttctcctctcgaagagggtgtggggcgtgtgtggccttatggcgctctcccagagtctcggccgagggtgctctcggccctgtggctctcagaagagagaggtgtgtcttctcactattctacacgagtgtggtctcgcggggtgtggcgcgtcttgtgggccccgttgggtatagcgcgtgtgggtgtatagagggtctcgcgggagaagagtctcgcctgctgttgagcggccgaggtcttgtagaggcggtatagagagagcggtctctttgtatacagcgtgtgagagtctctcgtgcgcacagagagccgagcctgtgtgtgctcctctccgagagagagagcgcgcgaagcgtgtgtgtgcgcacagcgccgtttcgagagaacaaccccaggcgcgtctcctgtgcgtgtgtctctgtgggaggccctattgtgtcctgtgtgcgcccccttttttttgagcgcgcaccacaacagcgcgcgcgggatctcccaccacgttttgacagaagtgtctctttttaagagcccctatgaggagaggggtgtgcggcctctccccaagcgagaatgtggctcttctgtgtgtggaggcactattctctccctctcgggtgtgtgcttttaaggtctccccagcgcgaaggggaagtttcgcggggggagtttcccccccccccaaaagggggggcggggtattagtgtggcggggcccaaggctcttcgttgtctacgacggcgttacccgtggggggagaggtacctcccacggggtgggggccaaggctcttcctaagagggaaggctcccccagtggaactttgtttgccccggggttcccgctctccgttgggggcccacgtcttttggacaccgggctccacagggtgccccacttttttggatggaccccccacgggggccccgagaccccttattctatgggcggcacggcttatgtttagcagctatctgataaccccctgctgtgctgggggcgcgcccccccggggtggggccccatttggtgggaacaaacacctttcccttctctcgggcccaagatgccggggatacacgcggggagtgtgtgcccatgctccagtggtcgcccggcccaagggctcctttcttgtgggcccaaagggggtccccggcaccggcgccccgcgcccccgcgtgccttcgcctttgagtctcggacatccaattctccttctgaggatctttgttctgtcaattatctcggtgtcggtgaagtctacccacgcgggcgggcgcgcgagcacaatctgtgttgg

SEQ ID NO: 670850 - DNA, 401 bp, Homo sapiens
tggtgttctgtggtcatacaggtagccaggaagtgcgggacacctggcagtcacaggcctcacccagctctcacacagcctgcaatcctaaaagcgggtttcacttcccccatgcccccgccaacatcactgagtctatttcgaggcagccggtgaccagggctgagaactcgccccagaccacgaacctccctgttgagagagcaagcaggctcacagtttttcagtgtctcaggagtttgtagcggtaatccagttccttcaaaggatctctggattttcttggctttcctggtgtgttcctgtggtagttcttgggagcaaaagttcacgaagtgagtctccacacactgctctatcagtctgaccaggagctgcaagctagtcatgccttctatcca

SEQ ID NO: 670851 - DNA, 318 bp, Homo sapiens
  misc_feature (312)..(312): n is a, c, g, or t
gaggcgatcagcattgataagaatattcacactgtctggtaatgtaataatctatctaatagtacctgagtaaatatttatcacatcctgttacggcttaccataactgtttagatttcctgtgtgtaattgtcgtatactaacaaatcagtaagattcagtgtccaccccaatgaagttcatggtcctacatggaaaactaaaacaagtgcacatgtgattatactacattgtgcgtgagatcttgacagaaagactaataatcctcgtttcccattatttttacttaatttctatgtgtcgaggcacttntgcttg

SEQ ID NO: 670852 - DNA, 307 bp, Homo sapiens
atctctcaggttcctgtcgtgcccagcagacggccatttcaccttaggtttcacaaacagttgccacatgactcatcagcagcacatgagtttgcatattgagttactgcattcgctaatgtgacatggtcctctaatggactcttgtaacgatggtgagccaaggccatccactccgaggctttcagctttctcttctacatgatctttacaggcgatgagcaacctctctagtgtgtgcatctcggcgaaacacacccatgtaataatgcgatctacagagtgatagcagggaaatagaggtgac

SEQ ID NO: 670853 - DNA, 490 bp, Homo sapiens
aatggcgaacgcatagtagtgccagtcacggcggatttttacaggcagattcatggcagctccgttaacgaaaaacaacatccttgcatattctgcaacaaccgtctgtggtgtagacaacattttcgtaattgttaataaatttaacttaaggttgccattttgtgactcacaacgaagattcacgcttcgggaatattcccaacatcaatttaccatgattctgatattgacaatctaaatgacctgtcagacttgccataagccgctggtatcacaccagaagagaagcagatgacttccggaggtttttatggctgatttcaccctgtcaaaatcgctgtttagcggaaaatatcgcaatgcctcttcaacgcctggcaacattgcctatgcgttgtttgtgctgttttgcttttgggctggggcgcaattgctgaacctgttagtgcatgcgcccggcgtctatgagcgtttaatgcaggtccag

SEQ ID NO: 670854 - DNA, 583 bp, Homo sapiens
  misc_feature (4)..(4): n is a, c, g, or t
  misc_feature (9)..(9): n is a, c, g, or t
  misc_feature (52)..(52): n is a, c, g, or t
  misc_feature (116)..(116): n is a, c, g, or t
  misc_feature (130)..(130): n is a, c, g, or t
  misc_feature (139)..(139): n is a, c, g, or t
  misc_feature (459)..(459): n is a, c, g, or t
ccanccttnttgccccaaccggtattgtaggttgaacccactgtgccaaggnactaattttttttatgtaagaaaaccaagttttaggtatttaatagttactcccttatgaccantatctcatcaagantctaggccntatctgaatatctgaactccatacgtttataccgtgtaagtcaagccattcccagatagaggtccatttgagttacttaagtgtttaccagcacttgtttactacccttgcggatgatatttacagtgtatttttgggtatggttttggggttatttggttgttgttaagatgcctgtggtcccggcgctttgggaggttgaggcgggtggatcacctgaggtcaggagttcgagcccagcctggccagcatgcgaagccctacctctactagaaatacaaaaattggcctggcgtggtggcgggcacctgtggtcccantacgcaggaggctggggcgggagaattgcttgagcccgggaggcggaggttgcagtgagccgagatcgcccaatggcactccattcagcttgagtgacagaggtgagactcccatctcaaggta

SEQ ID NO: 670855 - DNA, 640 bp, Homo sapiens
  misc_feature (315)..(315): n is a, c, g, or t
  misc_feature (319)..(319): n is a, c, g, or t
  misc_feature (328)..(328): n is a, c, g, or t
cggtttaattaagtgggcctaaaggctcttccttaaaaggtttatccggggcatttactcatggaaaaaccatgataatccttggattttaaattaaccattggaaaaaacctttcaaaaaaaaaaaaaaaaaaaaaaaaaaaaaaaaaaaaaaaaaaaaaaaaaaaaaaaaaaaaaaaaaaaaccttgtggcccgcttggcccaagcgaattttaaattgggcaaggttattcattggggccgaatttggggttaattggccaatttgcccttatggggggcggtttacaattcaatggcccgcgttttaaaanggtnggactgggnaaaccctgggggtacccaacttaaatggcttggaagaaaatccccttttgccaagttggggaattaccaaaagggccggaccgaatggcctttccaaaaattggccaaccttaaaggccaatggaaattggaaggcgtaaatatttggtaaaaatccgggtaaaattttggtaaatcaggtcaatttttaaccaattgggccgaattgggaaaattcttattaaatcaaagaattccccgtggggttgagggttggtcaagttggaacaggagtccctttttaaggacggtgactcccgtgggcggttttgg

SEQ ID NO: 670856 - DNA, 89 bp, Homo sapiens
tcaagcttctaacgatgtacggggacatgatttttactaatgtattactgagactagtaaataaatttttaaggcaaaataggaaaaaa

SEQ ID NO: 670857 - DNA, 369 bp, Homo sapiens
cgtgtacagtctagtgagtcttagtgatgagatgtgctgcatgtgccgagtaccatagtgatattgtatggcagacatgagtagattacatatacattatctgattcacacatctaccttttcacacatgagaactagctcagagaggtcccagacagctatactaggtagaaaaaggttccaggattcaatcccactctgctgacatactgtgaagtctggttattaacttctccaatctcatttcttatctgcaatggaaacaggtgtgtgcgggttaatgacatatgtcccatgatggatatataagctcagaatacttatgtaaatttcttattctaacagcatctgctaggtaaagggatgggc

SEQ ID NO: 670858 - DNA, 726 bp, Homo sapiens
  misc_feature (401)..(401): n is a, c, g, or t
  misc_feature (405)..(405): n is a, c, g, or t
  misc_feature (414)..(414): n is a, c, g, or t
ctttatggccgggttgtggggaaggagcccaaaattcctgccaattgaacttttgccaattaaaagggggtggggttaggttccatcgggttacggccctgggaaaataattttaatggaaatggccttccagggggttttaaaattaactgaagtttttaggccaattatgaatgtggcctaaatttccaattaaactggttaatccaaaaaaaaaaaaaaaaaaaaaaaaaaaaaaaaaaaaaaaaaaaaaaaaaaaaaaaaaaaaaaccttgtggcccgcttggcccaagcgaattttaaattgggcaaggttattcattggggccgaatttggggttaattggccaatttgcccttatggggggcggtttacaattcaatggcccgcgttttaaaanggtnggactgggnaaaccctgggggtacccaacttaaatggcttggaagaaaatccccttttgccaagttggggaattaccaaaagggccggaccgaatggcctttccaaaaattggccaaccttaaaggccaatggaaattggaaggcgtaaatatttggtaaaaatccgggtaaaattttggtaaatcaggtcaatttttaaccaattgggccgaattgggaaaattcttattaaatcaaagaattccccgtggggttgagggttggtcaagttggaacaggagtccctttttaaggacggtgactcccgtgggcggttttgg

SEQ ID NO: 670859 - DNA, 939 bp, Homo sapiens
  misc_feature (18)..(18): n is a, c, g, or t
  misc_feature (32)..(33): n is a, c, g, or t
  misc_feature (42)..(42): n is a, c, g, or t
  misc_feature (58)..(58): n is a, c, g, or t
  misc_feature (66)..(66): n is a, c, g, or t
  misc_feature (69)..(69): n is a, c, g, or t
  misc_feature (79)..(79): n is a, c, g, or t
  misc_feature (86)..(86): n is a, c, g, or t
  misc_feature (109)..(109): n is a, c, g, or t
  misc_feature (118)..(118): n is a, c, g, or t
  misc_feature (133)..(133): n is a, c, g, or t
  misc_feature (138)..(138): n is a, c, g, or t
  misc_feature (148)..(148): n is a, c, g, or t
  misc_feature (163)..(163): n is a, c, g, or t
  misc_feature (182)..(182): n is a, c, g, or t
  misc_feature (192)..(192): n is a, c, g, or t
  misc_feature (201)..(201): n is a, c, g, or t
  misc_feature (203)..(203): n is a, c, g, or t
  misc_feature (614)..(614): n is a, c, g, or t
  misc_feature (618)..(618): n is a, c, g, or t
  misc_feature (627)..(627): n is a, c, g, or t
cattatggccggaccagncaccagggccgganncgttggttnggccgccttcccaatngttaccancangaagttgttngaagaancggggctactcttaaccatttgnagccttganggagcttgggttcgnagacnggcaaggganccatgtgtgatgganaaggtcaggagcccaaagnttaaggccgnggccaagtntnactttgaaaggtcaagggagcagttgacacccttgatcaagagggttgaaccggaactggttaacttctggagctatttcggggaactgggaccacagcttgccacccagggaagggtccagaccatggctttccaacccaagttggcctttagaccaccaattggccagtcttagagttcctgtccttaccaattttttgttccattaaaggctgattgattccaaaaaaaaaaaaaaaaaaaaaaaaaaaaaaaaaaaaaaaaaaaaaaaaaaaaaaaccttgtggcccgcttggcccaagcgaattttaaattgggcaaggttattcattggggccgaatttggggttaattggccaatttgcccttatggggggcggtttacaattcaatggcccgcgttttaaaanggtnggactgggnaaaccctgggggtacccaacttaaatggcttggaagaaaatccccttttgccaagttggggaattaccaaaagggccggaccgaatggcctttccaaaaattggccaaccttaaaggccaatggaaattggaaggcgtaaatatttggtaaaaatccgggtaaaattttggtaaatcaggtcaatttttaaccaattgggccgaattgggaaaattcttattaaatcaaagaattccccgtggggttgagggttggtcaagttggaacaggagtccctttttaaggacggtgactcccgtgggcggttttgg

SEQ ID NO: 670860 - DNA, 895 bp, Homo sapiens
tctttcctcccctccccccctattcaccatttcccctcggaaggcgcttccccggtgctggggcagagccggtctcacccaccgataacaaggacgaaaaaatgcaaaggaagcccaccacacaaaacacgagcatcacacaggagagacgaacacacagagcacagagagagccacagagagtatgaatacacacgcataaccgcaacccaaggaaagacctgagcacgatagaaatacccgcaagcaacgcgaacaagcaacaacgaaccacaaaacacacaccgagtaccacagactgaccacagtgaacaaacccaccacacccaaacaaaagacagaagacgaaacacaacagaggccaccacacatcagacaactccacatagaacaacaacaaatgaaaaataacacaagcaagagataggaccccagtgacgaatcacacggcaacagaaaaacacacacaaaaaacgaagaacaacaataaagaagagaaccagcacagaataagagcgcagtggaaaagaaacacacaaatcaagatagaaagaaagaaaaacaagcaagaacatcacaccaacaaagaacagacaacagaaacaacaaagaaaagtagcaaagaaacaatgatgaataatccaaaaaacgacccaaaagatagaaacaaatctaaggaaaaaaccaacaaagggaaaacagaagcagaacaagacaaaagactcctagcgccagaggataaagcaagaacacaaagccaagacaagaaacagagtgacaacaaacacaggagaacactagcgaacaagagagcacagaacgaaacaacgaacaaaacgcagagaaaaagaccagagacccaagacgaacatacgagacaaacgagaagcacaac

SEQ ID NO: 670861 - DNA, 939 bp, Homo sapiens
  misc_feature (18)..(18): n is a, c, g, or t
  misc_feature (32)..(33): n is a, c, g, or t
  misc_feature (42)..(42): n is a, c, g, or t
  misc_feature (58)..(58): n is a, c, g, or t
  misc_feature (66)..(66): n is a, c, g, or t
  misc_feature (69)..(69): n is a, c, g, or t
  misc_feature (79)..(79): n is a, c, g, or t
  misc_feature (86)..(86): n is a, c, g, or t
  misc_feature (109)..(109): n is a, c, g, or t
  misc_feature (118)..(118): n is a, c, g, or t
  misc_feature (133)..(133): n is a, c, g, or t
  misc_feature (138)..(138): n is a, c, g, or t
  misc_feature (148)..(148): n is a, c, g, or t
  misc_feature (614)..(614): n is a, c, g, or t
  misc_feature (618)..(618): n is a, c, g, or t
  misc_feature (627)..(627): n is a, c, g, or t
cattatggccggaccagncaccagggccgganncgttggttnggccgccttcccaatngttaccancangaagttgttngaagaancggggctactcttaaccatttgnagccttganggagcttgggttcgnagacnggcaaggganccatgtgtgaaaagccgggtttttaagaacttccagacggggactgactatggaagggacctgttggcaagggagcagttgacacccttgatcaagagggttgaaccggaactggttaacttctggagctatttcggggaactgggaccacagcttgccacccagggaagggtccagaccatggctttccaacccaagttggcctttagaccaccaattggccagtcttagagttcctgtccttaccaattttttgttccattaaaggctgattgattccaaaaaaaaaaaaaaaaaaaaaaaaaaaaaaaaaaaaaaaaaaaaaaaaaaaaaaaccttgtggcccgcttggcccaagcgaattttaaattgggcaaggttattcattggggccgaatttggggttaattggccaatttgcccttatggggggcggtttacaattcaatggcccgcgttttaaaanggtnggactgggnaaaccctgggggtacccaacttaaatggcttggaagaaaatccccttttgccaagttggggaattaccaaaagggccggaccgaatggcctttccaaaaattggccaaccttaaaggccaatggaaattggaaggcgtaaatatttggtaaaaatccgggtaaaattttggtaaatcaggtcaatttttaaccaattgggccgaattgggaaaattcttattaaatcaaagaattccccgtggggttgagggttggtcaagttggaacaggagtccctttttaaggacggtgactcccgtgggcggttttgg

SEQ ID NO: 670862 - DNA, 121 bp, Homo sapiens
tattcctttgttgcgtcaacgaccctagcctggagactcaatgctgccccctgttataatgtgccttctcgtctattctggtgtgattcatggactttagtgggtcagtaaatgacctgag

SEQ ID NO: 670863 - DNA, 664 bp, Homo sapiens
  misc_feature (39)..(39): n is a, c, g, or t
  misc_feature (65)..(65): n is a, c, g, or t
  misc_feature (141)..(141): n is a, c, g, or t
  misc_feature (145)..(145): n is a, c, g, or t
  misc_feature (162)..(162): n is a, c, g, or t
  misc_feature (169)..(169): n is a, c, g, or t
  misc_feature (180)..(180): n is a, c, g, or t
  misc_feature (205)..(205): n is a, c, g, or t
  misc_feature (292)..(292): n is a, c, g, or t
  misc_feature (380)..(380): n is a, c, g, or t
  misc_feature (398)..(398): n is a, c, g, or t
  misc_feature (409)..(409): n is a, c, g, or t
  misc_feature (475)..(475): n is a, c, g, or t
  misc_feature (482)..(482): n is a, c, g, or t
  misc_feature (549)..(549): n is a, c, g, or t
  misc_feature (562)..(562): n is a, c, g, or t
  misc_feature (564)..(564): n is a, c, g, or t
  misc_feature (590)..(590): n is a, c, g, or t
agagttgggacgtagaatatgggcagccttggagatcgngttcccatgagcactgtacggtattngagagagacccattcgtttttccttaccgccccccgccccgggcgctttctgctcaaagcctagatgcccgtcacncaancccatccggtggcagcnctctagngactggacatncctggaagacccctcagcctctttngctgaacgttcattccaggagcttctccgtcccacagacatctgacacttgcccgacactgccacccgcagaagcctggcgggctcnggtcaccatgctctatctgaagttgcactggccagcatgggcctgtcccaagcgagaggggagacacagtggactgaaaggactggtngaaagtggccaatctctntcagcttaatntggcagagaaaatttgtaacaactctgagcacatgctgggtgaagtcacagctcaaggaaagatanagctggncggaaggaggtgtgcgtggcttctggggtgggacccagaggggaggctctgggacaggggctggggntcagtgccagggncntgaggaagaaatggggactgatctcnaaattccagaattcctgtacatctgttcacgtgcttgtgtccaggtgtgacatggtaatacgtcctaggttgca

SEQ ID NO: 670864 - DNA, 375 bp, Homo sapiens
  misc_feature (76)..(76): n is a, c, g, or t
  misc_feature (318)..(318): n is a, c, g, or t
  misc_feature (352)..(352): n is a, c, g, or t
  misc_feature (359)..(359): n is a, c, g, or t
gcgggccacttgggatgccgcgaccactacttcggatgccgtcatagaaatccttctgttgagttgtgcgtgggcnctcgcatcacgcggcgactgccccggcccaagggccggagcaggaacggcatcacgctggcgaggtcacgggccatgaacgtacggagggtcaagccggtgcgataggacgcgagctttccggcgtcgaagtgaccgccgatcgacaccgcttcggccagcccgagatgggttcgatacgcgatcgtcaacggtaccccgtgactcgcggcgctgaacagcttctgcgcctcggacaaccgnttcgattccaggggccgaggcagttcccaacttngttccgngtttccagggccagtt

SEQ ID NO: 670865 - DNA, 155 bp, Homo sapiens
gcatgtacctaggactctgccggtgcagaatatgagcaatgccatgtacttgcagaaaacgctatagcctgagtttcataggaggtaatcaccagacaactgcagaatgtggagcactgagcaggacaaatggactgtctccttcacatagtcca

SEQ ID NO: 670866 - DNA, 469 bp, Homo sapiens
ctagaggtccctcgctattagaatcctcataataataatataataataataataataataataagaagaagaagaagaagaagaagaagaagaagaagaagaagaagaaattatggagaaaatggacaaaatgggagtacagaagtggaaaatcacatggtgaaggagctagtgaattttctcccttagttatttagctggaaatatgaatccactgataaaggtggatttgctgggcccccgaggcagaggtggcagtgagcagaggatgtaacactgcacttcagcctgggcaatagagctagactccatctcaaaaaacaaaacaagaccgaaaacaaaagaaacaaggacctcactttttactccatatacttttttttcctgttgtggcttttttaaacaatagatgttggtaatttatatgacaataaagagtctcattaaaaagtatttcaaaaattttgtg

SEQ ID NO: 670867 - DNA, 616 bp, Homo sapiens
ggcggcattgcaattggggaatacccggcgcggcctccttaatctgtccggggcagaaacccctcttcttatgtggcaagcagggggatacctatgcccctttgcggccctggatcaatttgggtgtcataaacctgccactttttgccgggaccccacctattggagagtgcttcggcagaagacatatctcacatgtacctccgcgcgtcctcctgttttctccaaaagaagcagcactcttctccactcgtgggagagttctcattaccaccacgactgtttgtacagttaccccgccagttctttctccgcggcccacaaccaccgcacgacagttgctcctccctgtggacacaccacgcgaatggcgtgaattcccaaaacagtgggactcgcagagaaacattttttccctctacacagcagtattgcttctgttatcccaaccacaataatcttctccccgctgtgtgcgtaacttcacacacacagcggtgtgcaacgtctgtttctttttcgtcgctccgtcttttcaactttgtgtctcttcttcggaacaccaccattttttttggtgccaacaaaaatccccctgggttcgcccaacataaca

SEQ ID NO: 670868 - DNA, 110 bp, Homo sapiens
ttctagagatccctataggcgctagtgttataggcaggtgtggttataaatagttttaaatctggtttaacatacagagaaagatacaattcaaacaattagtcctataa

SEQ ID NO: 670869 - DNA, 278 bp, Homo sapiens
gcgtctagtggcgtctgagccccccgggggccgctcagtgacaggtgctgcccgagctggagggggatccagcgacaaacagaggatgcactgaccgccctccccccaggcccaacctccactggcctcagatcccggggttcctggacggagcatgtgcagagtatgcaggcgacaacatatactagaagagtaagatagacaccaagaaagcaagaaaacaaataaacaaaaaaacaagagacaaaaccaagatataacacaataagaaagaccag

SEQ ID NO: 670870 - DNA, 181 bp, Homo sapiens
atctctgagggaaggataccaaggctactgcagtgttacttcactcataagctccagtggacccagtggctcatcaggtcgagtagaaccacccacttctttctgcttaaagactcaccccttctgctttcttatagccttattgcacctctggaggtcaaaagccgcctggcagcttagt

SEQ ID NO: 670871 - DNA, 371 bp, Homo sapiens
ccttttgagacagggtctccttctgccacccagactggagtacagtggcacgatccgtgcaacctccatctcccgggttcgagcgattttcctgcctcagcctcccaagtagggggactacaggcacccaccaccacgcccggctaatttttgtatttttagtagggatggggtttcgacatgtttaccaggctggtctcgaacccctgacctcaggtgatccgcctgcctcgtcctcccaaagtactgggactacaggcgtgagccaccgcgcccgacctccgcccggcttacttctctatccaagaaatcgccaactagactgaaacgagcctctccccgaaccctccagcatgtggccggatcaggca

SEQ ID NO: 670872 - DNA, 311 bp, Homo sapiens
cagtgagacccatctcaaggaaaaaaatttggctgggtatggtggcttatgcctgtaatccctgcactttgggaggctaaggtgggcagattgcttgagctcaggagttcgagatctaggcaacatggcaaaaccccatctttgcaaaaaataaaaaatcagccgggcatggtggtgtgcatctgtggtcccagcctcttgggaggctaaggtgtggaggatggcttgggcctgggaggtggaagttccagtgagctgaaatggtgctgctgccctccagcctggatgatactgccagcccttgtttttta

SEQ ID NO: 670873 - DNA, 366 bp, Homo sapiens
tatgtgtttcatattataacagtctggttgcctttaacacagaactgacgaagaccactgcgtctgctgctatcggttctctctggacattactgttagtattcaaatattttaagtccgcacattccgcagggtgaatcctcttccatccctctgagagtattgcctgttctctttgtctgactctgttatccctgttcttcttggacaacccttgcgcggtctttagaatctctttccttcctccccttttgcccccgtggggctcccggcatcctgaaagccagcaaagcctccagcatcttttccatcctgaggtgcctcccagtggcctggcttgtcggagcaagtttcatcagccctagg

SEQ ID NO: 670874 - DNA, 1084 bp, Homo sapiens
  misc_feature (529)..(529): n is a, c, g, or t
gactgtgtcccggtcttcactctctgcatgaggctcgtgagaggctcctatggatcgtgacacacttgaacgtcgtgggatcatgagtcgcgagatgggctgtagcgtgtctacggcactctatgcgtgtctacgtggataggatgactatagggcgagcaagcggtacttcttgtgtaccattgcggtaatccagacatcagaggtcgcattcgtactcgtggcgcgcgatgatagactgaggtggacgtgattctgtatgcgatgcacctatgtgtacgtatgggccacgtgtgcatcgtgatgtccacatggacggcagatggatcttgcgtcggccgttcgatggctcgatgggctatgacacaatgttgcaaacagctgcgcatgcgatgcatagtgcaaaggttgctcaagtgactacgcatacgcaacgacaggtcatcgtagcgttcacttaaaaccgtggtcctagattgcgagtgacaagtgactaagccactgcagcgagtaccaatctagtgaatcngtctccgcgtcacacacctgtgggcaatgcgagaggaatctatccagattcactttgagcgagtccagtgtccgagatagagcccatagcactcgcgactgggattgacgcgtcgttgcgtttcccacggcccaccgtggcggtcttgtagggttgaggtttcaccataggacccacgaccgaaaagtggcatgaaaccaccatgacgatgtttgtttctgacatcgacagtgggagcgttttctaatgcccggggggaccgtatgcttaacacaagattgggcgcctggtagactagactcagcacaatggagctacggtccctcgttgccagaggtagtgtgggtgggatcggatgtgaccgcaaattccacacaagtggcgatcccgaaagcgacagggaggagaagcgtacaagcattcgagtatgagcgggtgtcgagcacgatggcgttaggcatttgacagtggggtgaccgtgtccgacggaattcatggggggggcccaatggtcctgtaggaagaaaaaaagttttaccacatggagtggacaca

SEQ ID NO: 670875 - DNA, 591 bp, Homo sapiens
ctcaacgctttatacttcatggtggcctatgactggagcaagggtagctcatcacagttatgaggaagaaaggtcggatgaggggcacagatgcaggtaggtggctaattatcctggtggaagggcatggggtttttccattgcttctaatttctcagtgaataataataagtcattagccctaagttactcagtagttgtgtaaaagtttgcctcattaggagtaagaacttcactgaggcagatggatgtggatttgaatcccagctcctttacattctattgattttgacattggacaaattacttatcttcattggtcaaatgaaggtactaatagcacctacctcagagggttgtgaacattaaaggtgaggataaagcacttagcagagtgcccggcatatccaatcaacatcagtctttactgttagggtcccttaaagtaaaatatgaacataattccctcacactggggagtttttgtagctctcttatcttttcagtctggtggacagcagaggttaccctttggggggcaggtcaaaggttaagttccctatggaagatacaactggggggagtcaaggg

SEQ ID NO: 670876 - DNA, 893 bp, Homo sapiens
  misc_feature (893)..(893): n is a, c, g, or t
tgtgtaactcatacatcccacaagcatctactgtgtgcagaatgtctcgtatgtgaaggacacgtgtgggcatataactgtggcttagatgggcttgctaacccctgagaagataatatatcagcagagaacaaggaacatgtagtatgaactgccagtcacacaacctatccagaattccagcaagaagaagtatgggtccatagagctaggaggtgttgaaggaaagattacctgcaggagaggcaatgccgatgatgatagaagattctgagctatggagcgaggcggagccagatgggaattcaggttatctcgggatgtgggacccgtaaccaagcttcttatacttatccaagcaatccattttctcattttaaaaagggagataactatgtggtaagattgtcttaagaattatgtgagatactagttctcaatagtaatacgggtgatggtttccgcagcctggagcgatgttaaagccggccatgtgacttctgaactacgaagcatgcccaggtgcatgcagagattgtaatataacggtgtggggtgtgggtctagaaatgtcttgcaggcaggtggtgcatggtgaggatgccaaggagggagccgagtctattgggtaggaaggagaatgacaaggggggttctcatgaattggccggactaacggggaggatacagggtgtggctgtgttgtccaaacaattcagggtttgttaagaacatcttcgactgtttgtgctggtgtttcacaataggattaagctgttgggtggcggttttccccaacgtattgtgggtgtcaacttggggtaaaaaaggggtaatagtagagaaaagaaagggcttaaaagaaagggggtaacaaaaaacaggataggttn

SEQ ID NO: 670877 - DNA, 218 bp, Homo sapiens
  misc_feature (44)..(45): n is a, c, g, or t
  misc_feature (134)..(134): n is a, c, g, or t
  misc_feature (156)..(156): n is a, c, g, or t
gtgttcagaacgtcaagctagacttttcttccactgttcacagnntaatggcaacctgcaagacttaaaagtaggagatgatgttgaatttgaagtatcatcggaccgacggactggggtacccattgctgttnaactggtgaagataaacaaggnatcctccctgaagaacgaatgaatggacaaggagtgttttatctgattaaaccctgagatgt

SEQ ID NO: 670878 - DNA, 690 bp, Homo sapiens
agcgggtctgtccctcctgtagccgccgccgccgccgcccgccgccctctgccagcagctccggcgccacctcgggccggcgtctccggcgggcgggagccaggcgctgacgggcgcggcgtggggctggccgagcgctcctgcggctgcgactcaggctccggcgtctgcgcttccccatggggctggcctgcggcgcctgggcgctctgagattgtcactgctgttccaagggcacacgcagaagggatttggaattcctggagagttgcctttgtgagaagctggacaatatttctttcaattccatctcttagttttccataggaacatcaagacaatcattgaaccaacttgggtacctgaacgagtttgactgccacattcctcgatgaaaggttttaactgccaaggacattctggacccagaaaaattaattgaacggttcttctatctgactgactagggatgccttctatgtggcagaccttgggagaccattctaaagaacagcatctgacggtggttaaaagctctccctcgtgtacaccgccttttatgcagtcaaatgtactgatagccaaagcccatcgtgaagacccttgctgctaccggggacagcgaattggacttgtgctagcaaagactgaaatacaggtggtgcaagagtctggggggtgctccagaga

SEQ ID NO: 670879 - DNA, 222 bp, Homo sapiens
  misc_feature (59)..(59): n is a, c, g, or t
gtgagctgaggtacaggcagggcgaggcaggacaccagcagggggtgctctgaacctanccgcccaaggagactccaccctggggtccaaatgcgtaacgccagacgcatggatgcaccccctaacctgcctccatctactggagttctttctctcagagtgggggcagtttcttggcccaggggctctgacgctgcggcacgccccagggcaaggggggcc

SEQ ID NO: 670880 - DNA, 832 bp, Homo sapiens
  misc_feature (515)..(515): n is a, c, g, or t
gacgagagcttggagggggaaagccggtatctctttcgtcgatgccgacacagcgctcaccaagcgccatgctcgactccttgggcctgaccatacgaagattgcccaggccgttcgcttcatcatcctggacgacgaggatgaccacttaccagcgcgaatctggaggatgctgatagctgagaaggatcacagagtttctgtacacacgctttcctgggaggggctaaaatcagacgctcccacacgtggtagtgaagcttcgagtgacgctgcacagtgagggacttgggtgacaagccacgtgctgtcacagcgtcgcttgctgtggtgacataacctgtgtagcatagtacggttgccctatctgtgattgcaggacataggacatcgcgtcttatgttcgcacgctgtctcttgcctgatgcgtggtgctccactgaagacatgaggtttggcgtcacgctgttgggggaattgcattgggacgcaggagcaacggtcacaaggcaccngagtgtcaagacacgatcagctctctcgagcggacagcactggaaagtcgcgactgggcaccacggaggcgagattgccggcaatatagggcaccgagcgttgcccgcaaccggtgcgacttaccattaccgctagatcgcagggaccggccgagcacgcgggcaatcccgatggacctctccgggagacagcgacgcatagggcatggagtgccgaaggaaaaatccgacggaagaagcaggggggccacggcatcgggcccggggcctgacggcgaagccgaccacgggggaggaaccgaaggggccactggggg

SEQ ID NO: 670881 - DNA, 354 bp, Homo sapiens
  misc_feature (149)..(149): n is a, c, g, or t
  misc_feature (171)..(171): n is a, c, g, or t
  misc_feature (181)..(181): n is a, c, g, or t
  misc_feature (325)..(325): n is a, c, g, or t
cttcctccatcctggtcctcagtccctgaactcccaggacagaattcctgacctccttggtcaagccttggttcgagaaagagaaactattagtgtaaacaaaccaatcaaccccaaaaccaaaactgtgcctgccaatagcccatttnttggccattgatggtgcatgangagaaatggntccaattaagaaaatcttaaaatcttaaggaataagaaaatgtaataaagagaaagacaatgtcatgctcagggagctaatatgaatcccaaaggaatattgactgttcaggctcaagttaaaattacagcagatcgaaagtgnaggagttgagtggcatcttcttttctgtt

SEQ ID NO: 670882 - DNA, 426 bp, Homo sapiens
ccatttcctcttctggactttgttatcccccaataatgagttggctattctgggtcttttacctcctcatgtaaacagtagaatatgttggttgatatccacaaaatagcttgcttagattttgattaggatagtcttgacatagaacaaattgggaagaggctgggaatggtggcttatgcttgtaatcccagcactttgggaggccaaggtgggtggatcacttgaggccaggagttcaggaccagcctggccatggtgaaaccccatctctactaaaaaaaatacaaaaattagctgattgtggtgcacatgcctgtaatcccagctgaggcagaattgcttgaacctgcgaggtggaggttgcagtgagccaatatcgcacctctgcactccagcctgggcaacagagcaagactctttctc

SEQ ID NO: 670883 - DNA, 1199 bp, Homo sapiens
agcggggtgatgaacaacccggcgcgcaggcggctggctctgggcgcgcgccagacaaatcctactcctgtgagccctgcggaccccgagcacgcgccatgactagcccctgctggtccctggctgcgctggctgtcgcccatggccgagcttatggacccaccgaacacaggtggcacgcccgagcacctgccggcctcagggacaccttacccctgaacgctaccttcacctgcgagacgagggtggcccagtcgcctcacgggatgcgcaggcagctgcgtgtgcatagatgagtcgacccgtcaacggtgctaacaacgactcacgcggaggcttcaaccctgcccgcgccattccaaggggtgacgcctctcacgcgggatcaatcactgtcaccgtatcgacccgcgagcccacgcgtaatgccccagccgacgtcctcccgctattgacttgcgcccgctttctccacagttccacagacaaacgggggacccatctggctgaaagaaaacataagttatgcgaacgccctcgcgtacatacaccctgggacattcggaggacgcaacacgcttggcttcttcgccacggacacggccagcggtcccacaaggggagttatgagaaagaaccgcgcgtaccccgacatgggaacgatttatgaagcggaacggccttcggacccacgggaagtttggacgactattacctgaggtgaaagcccttgagagtgaggacaccaaagccacgcttggagacacagccgcgacgcactatggggcagaccttccactcatacaaggcggcaccaaaacgccaccttgattacctcacacgacgtacgcgtggacccatcggctcacgccacacctggacactttgacccaccgaacttgacgtcatgcccacatctgcaacaccgacccacctccgcgactacgcaacagagcacagtaggaagcccaataagcaacgccaccctatcacaacccgcagacgcagccatccaacagcggcgacaaaacaccaaccgaacccgcatcaaaacccaaccgacacgaccataaccaccgcacccacactcaccccacggaccggacacagacctgcgcccctaggacctcaaaccccatggccaaaagcaaataaaacacacggccacaaacaccggaactacgggcgacatcagacgc

SEQ ID NO: 670884 - DNA, 1700 bp, Homo sapiens
  misc_feature (194)..(194): n is a, c, g, or t
  misc_feature (935)..(935): n is a, c, g, or t
ctcacagctgtctgtgtaaatgtaggacgaatcgaaattaagacaagctgttcaatgtcatcaacatcgactagctaaatagcatgcctaagtaatagtagagctagatactacctaccactacccgtaactgggtagcgaatcgttatctacacgcgtaatagcatagaacctatattgtgcacgtattgaangtgaacccatcgataacacaatccttgctctcccgaatcacatcgcatgcagtcaggaatatgagagaatattggagagctgacgaatataaccagcctctaactacatcgtacaatcaaccgctaaatagaaggtcagtgtattgtatctccgtcaacgtcgtcaaaactcccagagcgagcaaggcaagtgcttcaagtaaacgcgaagatggtttatcacacataaggtacacataggggaaaccttctgcgctaaaagtaatcttactcaacggcgcaatgtagtaacgcgaaggatacacataattaaacaaaaacacacaaaaatagataacataagaacatatatacaagacacgcacaaggggagagaggtggggaacggtataaagtacatacgctcgcgccatgtggggcgcgcgccaatttaaagccaaattttgccacccacaggtccgcagtcttggccgcacgaacaagtcccgtggcgctgcacacaaaacataagctcccaatatgggtacctaataagagcccccaaaggcaaacccgaggttggcacgacccctttgacacgatccccgttggttggtggccagtggaaaaagatatccattgtccttgggggtccgggcaaagacccagttgagacggatggatcaaccccaaagtattaattcataacgtgaacagctggtgcaacaacatcacaggccgtgcgcggaccatagacaattnaatccccacttgtcaggactttttcccagcggcggccttatccatgaggccgtcacattaggcacaacaataaaacacaccccaggccgggacggatggattccgctgtgcgattgcaccacggccacacggggccccctataatgtggccccatgccctgtggagacaatgaacaggggcgacaagcgtcccagaaagagccccccagaggtgcatggccccaacgaaacaacagatcaacgcagggagaaagcacaacaaccaatcaactcaatacacacaacacccacagcagacgcaccaacacacaagcgcacaacacacaacaacagagcacgaagagacccacgccgacaaccgaacgaagcatgccaccagcaagcactgcagcaacgacacaaccacgatgatcacacctgcacagaaccacgagaaggcagcaacaacaaagccaccacacgacacgcacaacagggcagacaccaagcaagaacgccaaagaaaaacacaaaccgaagaccgacaaagcggaagcaacgaccagcagacaaccaaccaagaaagagcgagagcagacaaaaagagaacagacaccacacacccacaccagccacacagcacaacaccacagaaagcagcaacagaagagacaggaagaaaacaaaacacgacgaacacaacgaccaacgcacacaacaaacagaagaaacacaaggcgagacaacagacgacaagagaaagaaaaaacaaaacagacagtacaa

SEQ ID NO: 670885 - DNA, 160 bp, Homo sapiens
  misc_feature (54)..(54): n is a, c, g, or t
  misc_feature (121)..(121): n is a, c, g, or t
  misc_feature (124)..(124): n is a, c, g, or t
  misc_feature (152)..(152): n is a, c, g, or t
ggatctgccccctttactcctcggggaaccaaggccccactctcgctctggatncatttgggtcagcctggctggtcccaaggcattaggatgggggagcaaaaagcaacttatgtatttnctncacccccaccccaaattaaaatgttaanctgctgga

SEQ ID NO: 670886 - DNA, 1032 bp, Homo sapiens
gttattatactttgttgaatttacttgtcattcccatgtgataggtttcttattttgcttttatgggcacgtccacatgtgagctcgcttttctttgtgccggaatttcggcagtctccttctcttcaaggactggagatgcacctcgaggttgttgcaccttttcgaagttcgttctgattgaatccaacccaaggcgtgtgcgacttgggctcaggcttcgggggatgagtgccctttggaactgtagacgtccaacaaggtggcaggactgctcttatccaactggaggccgccgggaaggagaatcaccccggtcattctaacccgtcaccccaggaatcggggtgactcgcacaagacctcatggaaagggtgacgactaggggcaaaacagcagggtggcagggcacgacacatgctccccaccaccaggtctggcatccgatgtcattcatcactcaggacgcagaggtgaccagtagcggattacagagctgggaggacagggccaagcccaggaccaggagcgcctcatcttgccaggcctcagccacccagggtaaaaggtgccagggaaacttgtgggcacactgagaaggaggaacagatgtggaggacctgagggctgctcaaaagggccaggactcagcctgcaagcagtgttttcacttgccaacacgtaacatgtacccactccgcagagaccccgctgggcctgggcccacagggccacagctagcctgcatgtgtgtactgcactgttacagtttgcaaagctcttcacatacccactctctcaccgaagccgtgaattgaggctcttggaaggagtcaggcaaggattgtgcttcccccattatacaggtgacgtaactgagtcctggggaaagtgactggtccgtggtagagccgggacccaatcccctctcttctccttccctgttgctgctgttcttcgatgcccaacacctgtttctcttttctctcaaggggtttcggggcaggagccattacctccacggcccgttt

SEQ ID NO: 670887 - DNA, 618 bp, Homo sapiens
gaactcctgacctcgtgatccgcccgcctcggctcccagggtgctgggattgcaggcgtgagccaccatgcctggccccacataaagtttctgagcacttgaaatgtggctagtgtgactgagaaactgaatttttaattttgtttgagactgggcacagtggctcacgcctgtaatcctgacactttgggaggccgaagcaggaggattgcttgaatccaggagtgcgagaccaccctgggcaacatggtgaaatcctgcctctaaaaaaaaaacaaagtaacgagcccagcgaggttgtgcatacctgtggtcccagctgcgtgagaggctgaggtgggaggaatcccttgagccaaggaggtcgtgcgtggctgtgatgatctgtgatcgtgccgctaaattctagcctgggcaacagagcgagaccctgtctcaaaaaaaaaaaaaaaaaaaaaaaaccctttaaaattttttttggggagaccggggtccctccgttgtgtgttcccccggggtgtggaccccggggggtgttacttattgcccctggcgggtgttgaaacttttggggcttaaacaaatttttcttgcttgggcctccccaatggcggaaat

SEQ ID NO: 670888 - DNA, 224 bp, Homo sapiens
gaggctggggttacgggtgcccaccaccacacgcagataatttttgtatttgtagtacagacggaaggttaccatgttggccaggctgactttaaactgctggcctcaagtgagcatgctgtgtcagacttacaaagcgctgggattacagacgctagcctccgcacctggcatgtgattgctgcttctttgggcctgccacagatagaacgtctgtgtgctca

SEQ ID NO: 670889 - DNA, 587 bp, Homo sapiens
ctaagcagatatagcgttaacctaaataaatgcatacataaaatcatggcatatctatacaatcgaatattattcatccattaaaagtaatgaaatctgtccacttgcagcaacatggaagagcccagaggatattatgttaagtgaaatacaccaggcacagaaagacagacattacatggactctctcatatatggagactagaaagagctggtctcaaggaggtggagagtagaacgggggttgccagaagctgtgaagggcagggggatgaagagaggctggttaatggattcagaaatacaggtggatagaagaaacattagaaggttctagtgtttgacagcacagtagggtaaccacagttatcaatactttatggtaaatttaaaaagagctagaagagggttgggcacggtggctcacgcctgtaatctcagggttgcgggtatgagccaccatgccctacctcttaggatttcaaaaatgcgttaaacaataggtacacggtcaggtacaatggctcacaattgtatccaaacttgaaaggtgaggcaggaggacactgagccaggagcgagaccag

SEQ ID NO: 670890 - DNA, 729 bp, Homo sapiens
aggattggctctgagagaactggctaagattcaggaagaaacaaaaaattcagaatccttacgaaattttggccctaattgtcatcaaaacctgtaggattctgatgacaattagggccaaaattttaggaggagatgtaggatgcaggagaaaattaaagtgttttctttatatcagaggaggaaatagtagaggtcagtgaaggtctggggtagggaaacattcagactgtccatgcatggctgtggagtgagactgcccttagcctgggtcagccttcctgggccataaatgggcatccgtgatgctaggtaactgtgggaacaaaatgacagcttagagcagccatgggtgatgtttggtggtaaaaaacctacaggcgtttggggtcccatgattgttccagaccatgactcttcctggttgtgggttgttacagagcaggagaagcagaggttatgacagttatgcagactttccccctcctttttctcttttctcttcccctgtgcttttccactgtttcttcctgctggcaccgtgggccttgaattcctgggctgtgaagacatgtagcagctgcagggtttaccacacgtgggagggcagccagttctgtcctctggcttcccactttgggatttgggggccctttatcctggtggggtggggggacctggggtaagccaaggaggtttcttagggggcccagggaaagggacatgggg

SEQ ID NO: 670891 - DNA, 130 bp, Homo sapiens
tacatgatacaattcgagctcgtgtacgtcgagaactgaaacgcagctacgttagtttagatatttctgttaggtcttcacatgtatgtatcccactgttccctagtttgagtgggaaaagaccctgggt

SEQ ID NO: 670892 - DNA, 397 bp, Homo sapiens
caccatctcatcccatcaatatccaacatctcatggatccttccaacctctcctcgctccttccaacatctcatcgaaccattccaacatctcatagcgccttccacatcatcatagctcaatccaacatctcatctccccttccaacatctcatcgctccttccaccatctcatacctccttccaacatctcattactccttccaacatctcatagctccttccaacatctccatctctccttccacaacatctcctgccaacttccaacatctcatgccccttccaaacatctcatagccccctccaacatctcctagcccacatcaccctccttcaactctacttctccctccgccctgcagatgtaggcaaggggtctgcagcatgtttggca

SEQ ID NO: 670893 - DNA, 578 bp, Homo sapiens
tgtttatcgatgccacctcagcagcatcttctgagggtggagcactttttgtgcaggggccctattaaggcggacactgctggcagaaccctctagctcctgttgcccgggaaccatcagtgctgtacaccttctgcaaactacttgaagagtcatgtatctttggatgcctcagcatcagtgacttggagctggttatagctgtctgctctctgggcaccgtggctggctggaagacataaacagcaggagcatggtctgcccagagttctggcagggctgggctaaggccacacctgcgggaagccaccgtgcctctatctgccttgtctccgactgtggagatacttaagcttgcctgccagcaggcaggtcacttctttgattgccttcttcctcagggacctctggcagtaaaagcggtagggataaccataggcaagctctcaaaagtagactgtcagttgcagctcggatgtggagggtgtaagtttccggtgggaggtccaagctggggacagcttgaaaatgatttacttaacatgacttttcatggtggcatcgataaccacggggac

SEQ ID NO: 670894 - DNA, 769 bp, Homo sapiens
ccccacccgcgagccgcagcgtggcccacagcttctgggcgctgtggccccgtgcagccgggcaggccgtgtcgtgaccttcgacctcctgccgtgtcgggcccgagcggtgagtccagcccggcagtcgcaggacccggccgccagcctcttccctccacctctccctgcccccagcgccatggcgctggtgctgcagctcggtggcggcggcggtggcccttcaggcggcctatgtgcggcatgtgctgccggggccggtgtccgcgccgcgctgtgctgagggcgctgagcgagccgctgagcgcggtgcagctgcggcgactggaggagcaccgctacagcgcggcgggctgtctcgctgctcgagcctgcgctgcaggctctactggacctggctgctccagtgtattcccgctctggatggcccccaactccatcacccttgcttggggctcgccgtcaacgtggtcaccaagctcgtgctcatctcctacttgtcccacggccaccgaagaggcaccatacttggacatacctttatgtgcactgggactatggattaaccagtcactggatgctattgatgggaaacaagccagaagaacaactctggttccccttaggggagctctttgaccatggctgtgactctctttccacagtatgtgtggcagtgggagcttcaattgccgctcgcttaggaacttatcctgactgggttaattcctgctctataatcgggatgtaagagataattgcgctcata

SEQ ID NO: 670895 - DNA, 353 bp, Homo sapiens
  misc_feature (178)..(178): n is a, c, g, or t
  misc_feature (180)..(180): n is a, c, g, or t
  misc_feature (230)..(230): n is a, c, g, or t
  misc_feature (275)..(275): n is a, c, g, or t
  misc_feature (308)..(308): n is a, c, g, or t
  misc_feature (324)..(324): n is a, c, g, or t
gaataattcacagagcataaaagtaactattagccattttaatgtgtacgatacagtggtgattcgtaccttcacaatgttatgcaaccatcacttctatttagtcaagacatttctgtaaacccaaaaggaaaccccatactcatcagagtcactccccattcctctgtcctcctangncctgacaaccactgatctgctttctgtcactatggatttacctcttctangatgtttcatctaagtggaatcatatatttgcgacctttgtgtcngggttccttcattggacataatgctttcaaggntcatccacgttgtggnacgtgtccggtgcttacttccctttggtg

SEQ ID NO: 670896 - DNA, 208 bp, Homo sapiens
cgtgtcgcatcccccttcgttcataaaaaaaaaaaaaaaaaagtaatttacacgtagcgacaggtcagccacccccatccgcgaagtgaatgctataaaatatggccggggcacatttatggagcacccactatcgggagctctaggaggggactcacaaaaggaacaaacttggaagagagccctgacaccaagggggatggacacc

SEQ ID NO: 670897 - DNA, 142 bp, Homo sapiens
cttgggggcccccccttcccccttttttttcccccaacttaaaaggtatgaagggttttggtttccctgggaggggggggaggcaaccagggttttcctgttccctgattttagaccagttgaataaaaggggcccccttta

SEQ ID NO: 670898 - DNA, 776 bp, Homo sapiens
gtagagatctagcgagtgaatcagacgtggacaagccgtgtggtggtgcgccatgatacggggcaatgatcccgataacagcgtggatgcgtcttcagacagaatcttataccaggaggctgaggaattcctcggtacagattcttgcctcggaaaatcatatacctctgaatcctagactcttgcaagaggactccctcaatgtggctgatttggcttgcctcttccgggccccacgtggatcgatccccatcccagagcttcctacccaaggatgatgagatggaaacgagataagcaggaggaagaaagaagtccctaagtgtggattactccgcggggaatgagaaagtcctgtccctgcttgccctggtttggccagaagtctggactctcagagagaaatgcattctggtgattacatggatccaacagctgatccccaagattgaacgaccggaagtgatttggggtagccatccaggacgaaggtgctggagagggtgaatgccggcaatgaccaaagtgggagctttcagacaatccattttccaagtacttctcagaacgttggggcatgctgtggccacaggctccaaggagactcatgtaatgtattacgggccttggtggcatgagcgagatgaggcagctatggggagttcagggccaatggtgctggaaccttgagggcttctatgcatgagctttatccatatcatcagcagcaacctggtggcaaacttgtccccccacgggtggactgacaagtccat

SEQ ID NO: 670899 - DNA, 210 bp, Homo sapiens
ccgctgaattagcgcattttacctgcgcgtatttccggccgcggaatactccgtgagcgccccggggcgcaccgtgaagaccgcggagaccacgccggcgacgacttcgccgtcgatggccagatcgaacggcagatctgccgcctgcagccggaccgacgtcggcgtctgcagcccgatggcctccgagacctcggtgcggccggtgag

SEQ ID NO: 670900 - DNA, 215 bp, Homo sapiens
gaccctccacctccaaggttcaagcctactgagtagctgggattacaggtgcccgccagcagcccagctaattatggtacatctccagtagagacggggttaccatgttggccaggctgtactcaaactcctgagctcacgatccgtcttgcctcggcctcccaaagtgctaggctaacaggcatgagccgccgggcatggctgggacacagcta

SEQ ID NO: 670901 - DNA, 166 bp, Homo sapiens
  misc_feature (75)..(75): n is a, c, g, or t
  misc_feature (93)..(93): n is a, c, g, or t
  misc_feature (110)..(110): n is a, c, g, or t
  misc_feature (157)..(157): n is a, c, g, or t
gataactcaggcccggtgccagagcccaggaggaggcagtggcaggaaggacaggctgagaagtctgcggctgantgggagcaaatcccccancccctacctggggacanctctagtgagactggtgaagggtggtcagcaggcagggaaaggaganggtgctgtg

SEQ ID NO: 670902 - DNA, 296 bp, Homo sapiens
ccccccccctttttccttttccgggttttttttccccaaagaaaggcccttgaagaagcccagcccgccctggcatgtgcccgagctatcatttgagtaaaagtaaacagggggtaaaaatcatattaagcatcagattcaacttaaattttttatttcatttttttcctttcccttctccccccttttacggggcaaaattatattttaatcaaaaatggaaatgggcaacaaagggtatttgttaaaaacgtttgtttttattgcagagcaaaaataaatcaaattagaagcca

SEQ ID NO: 670903 - DNA, 197 bp, Homo sapiens
acgctcctctgtgggggttcgccaggctctgggggtgaaaatctgctacacaccggggttatgctgctcagcaacggagcggatgtctgacctccctgcggctttgtgacagcggttcacagaccagagtagttctcaaaccactccgatgttgggattcatgttctgcctgagcccgccccacagagcagcagcgt

SEQ ID NO: 670904 - DNA, 130 bp, Homo sapiens
tatgttccttgatgcttcaacagtcccacaaagtagtgccatgaccacttggcccaggtgaacaggtgccagtgtgataaggctggtccctgcgacaagttccctttcttgcctgcctctattcagtttt

SEQ ID NO: 670905 - DNA, 111 bp, Homo sapiens
ccacaatttgcatcatccatcagctccagcatcctatcacctcatgtcatccgacacatgtgttctttatatactccggcagtcagtcaacagttcaccaatcatggggca

SEQ ID NO: 670906 - DNA, 390 bp, Homo sapiens
ttgccacgtaactatttctgggtacctattaacaataccccctaaccccaatacccttcccagcggcgggtaaccattactctagtctctatctcaaaaacaaaacagaacaagaacaaaaaactaaaaatagagctatcatatgatccagcaatcacagctgctaggtacatacccaaaagaaaggaaatctgtgtactgaaaagatatctgcatgcagtcccatgtatatggcagcactattcacaatagccaggattgggaagcatcctcagtgtccatcagcagatgaatggataaagcacatgtacaggtacacaatggagtactatccagccatagaaaagagtgagagcttgtcatttgccacaacagggaatgggtaccgag

SEQ ID NO: 670907 - DNA, 265 bp, Homo sapiens
caactgggccagcacactagtggtcaatcagttgctctaatcacatacatcggccttttccagactggccagcgcggaagcactagtaggacttggggtgctcttcaaatagcgggctattgatagggcattcccagaagacggtgtcactaagtaaatctgtgtgggaccacttttgcacggggcagagattttccaaacagagagcggccagctttcaagaggtcagaggtgctttttcatcccaggggaggagctgcgggga

SEQ ID NO: 670908 - DNA, 591 bp, Homo sapiens
gtgaggccacataggggccccacggatcaacaaggaattcgcctgtgccagagcctcacctacagctacccctgtggcaagcgtgtcttggcagcgcctcagaggctgttctgaaggccctgatggaccagtggtttagtgagcacgacatacggcttgtatagttctgttagcgcggagactgcggtatgcaaagcacagagcagtcctgcctttgactgtcagtgcaggccatcccgcttgctagcaaagatggcagctccctactgtgggtccaggcaatggagttccccttcgccgcccagtccagtggagggctaggtagctcacctccccagctgttgctgtggttgagccgcccgctgacccgacccccctcaggtcataagagagggctgttcacactgcactcacctaggccagggtggcccccagatggtcaggaagccccaggctcacgaagcctctttcagtgcaaaaggcatcaggaatcgcaaggcccagggtctgcagcctggggctggcctgccctggaggagagcgccagggggtggggcgacagtcttcggctatcctccctcccctccagct

SEQ ID NO: 670909 - DNA, 1008 bp, Homo sapiens
ctcaacgctaagtgtgagcggtctgttgtgagtcaggacagcgatgctctgtcccatttggatgataagtgccggctgaccttgcagaggtggatgcgcatggccatgcatgtggacccagaggtggttactctatattagaggccggaaagaaaggctgtacgcggaactgcgcgggagagttgggtggcggcccgtggtagcttatcgcaattgacgtctcggtgctctgtctggcgaccttgattagtagaacggtcgacgagatgtggccggggaggtagtatcctcctagtgagtttagcccagtgtgtgctctatcgccactaaactcttgagcttgctcatcctgtgcgtcacttagtgcgcgagagcctactgctgcaaggtacctgtgcgcagctctaaaagggcatttacagcattgtggcccttgagtgggttgctcatgccgtggattcgcttggaatgggactgtcgcttctgcaggtttgcgttaccctactgtctcagctgcaccatgactttttggggcatccaattagatcatgaaccgagttggtccgggtcgggcggggccgccgcatgggccctccaagctttattatttggactggagcgctgtcctccgggcgctgactaccccggttcctcccagtgcgtggtaactgacgctgggatgttgcttggggctggggtctggaaggtacccgattgtcagtagagatggccgagtaccatacggtgggagggtgaccaaggaccttgtgtagggggttggagatacgagagggagggctggcaaaggagaaaggagttctcggattaaaggaagaggggattaaggtctgcacacattgagacttttatatagcggtttttagaaagaaaaaaaaatgtgcgggggtggatatataatatggggaggaatgaaaattctcaaattatgttttgaaacaaggggcatatttttatgagagcccatattgctgattggtaattgtagtg

SEQ ID NO: 670910 - DNA, 204 bp, Homo sapiens
catacacatgctacaggcctgatgttggttatgtccaagggatgtccttcattgcagcagtactcattctcaatttggaagagggcagatgctttatcgcatttgccaatctcctgaataagccataccagttggcatgagacgatcgatcacagcatggatcttcacactatatagcaaatcactaccacttgatctggcctg

SEQ ID NO: 670911 - DNA, 1018 bp, Homo sapiens
  misc_feature (248)..(248): n is a, c, g, or t
gtaccgagcgcccccaagtggttcgagaccacggcgtcgccgagagaacacgctggtcgctggttgggtggcttcccctcttgtatggggtacgacgtttgagcccttgctgatgctcctccagtggagggacatgccaattgccgcgatatgcttctttggagtggacgttacagtaccaccactgataggaaaggctcagaggacgtcgatcctctttcgcatagtgcatgaaccctgtgcggganccgctctatccttcctcgggggacaccaagtgcagttggtgcaaccgcgaggtgtaacgaccctgaacgttccggaatctgaagctcgcgtcagaagcccgcatggatccttgggaacacctgtggtgcggcccctccaagcgtactcagcgccccacaggtacccctggcgctgcaatccctgggagttccccattgaattgctcccgggggcccacacgccggtatgagcacacgcacggctcggaaggtgcccccagacgcccgttaggcccctgagaggcgagtcagcgtccactacgctggcgtccgagcgaaacgaaagcgatcaaggaaccgggcccggcaggcactaccctgcgctgcataatgttcggcacttctcaagcgcatcgtgggcatggcgtaaagagcttggtattcgtggcaccgcgacctacggtctaccgcaggcgcctctgacatgtccattggggacttgcctccttgtccagctggctggaccacctcgaacgcagacgcatacgaggcccattgtgcaagtatccctggtcaattacatggtcaaattgcacagtatcccccaaagcctgttgtgtgcaactactgaactgagtgccatctccatgctgtacatggatgagtatgataaggtggtactgaacaattatcaaggagaatggtagtagaaggtatatgggtgcccgcctgagaaacaggcaaagtccttgaggatagacagatatacacaccacacacacacaccacat

SEQ ID NO: 670912 - DNA, 299 bp, Homo sapiens
cctaaacaagctccaaaatgcagaggaagaaattgttcccccgtggtagagtttttaatgaatatccatggccccagttttgggtttcaggtaagtcttggaagaagttaaacaccgttttaggcaaatatttatctctttgaaaaaatagggggggggtgccccggaaaaaataaccccttttgaatgacacgtttgtacttcatggatctgtcatcaagttttaaaatccgaatcatttgggctttttaaaaaccattttatactcgtaataaatatatttcatctaattgctgtta

SEQ ID NO: 670913 - DNA, 323 bp, Homo sapiens
atccaaagaattcggcacgaggggagcctgcttgttgcagctgtggggtgaggacggctctagctagttccctttttagactatggcgacataacctcgagttcatccagcagattaaggaccggattggtgttccgtttaagtggggaccgtttggccttccagccgctctggagctctcacaggatatggtgtgtacccctggtctgtgctctccctacactcctttgagaagagacgcgcacagactctaccctctgtatcacatttagtgacccctgtcgtcttgtagacgcgggacaatctttagtagacgcttttcc

SEQ ID NO: 670914 - DNA, 304 bp, Homo sapiens
gaaaacagctggaggtccttcttgattattataccaccattcgctacacctactttgaggtagtctgccgatcagagaatttttgacagaacggggagggtaactctacaccttatgagcacacaacagcaaccactgcacctactactcctacctatgtgtatccccgtggccttccatagcgctcgctgttaatcaaaatcttctagaagcctccttagttcctccttaaagcccttcccccgaacgcagttttatccgaaaaagcgaatgattagaggtcttggcgccgaaacgatctcaa

SEQ ID NO: 670915 - DNA, 487 bp, Homo sapiens
gatcgtctctattgaaacattaagaccgctttataattaacaaatcaggggtgcatgtatagtggctttagaatacatccagtgaaaatccttaaaggagtttgctatagaatctacggataaagacagcactccgaccactatacatccagaacattctatcatgtaaggtcagcatgtttgaacagcttgggacttgattagcctcttagaagactaacgtctaagtggtggttactacatcagcacacaaaatcctgtttaattcataaactaaactgtaataataactgcgtctacgttgttcatatgggatttttattgactaaacagcttccagcctctttcttcatgcatgccaggataacagtgataccaaaacctatcaaagattagaccatcctacccccaaaatataacaataggccaatatctctaaacaaatatgtaacaacagaaaaaaaatgctaaataataactagtagaa

SEQ ID NO: 670916 - DNA, 363 bp, Homo sapiens
  misc_feature (281)..(281): n is a, c, g, or t
cagtaactgtgatcgtccactgcctccagcctggcagcagagtgagactcctcaaaaaaaaaaaaaaaggggagaagaagaaatatggtaatgaaggttagtagatgtcttcaaaaggagcaaatctcctattggcctaatttcgtagcagccatttgttatgattataaatttaaatgagttttagctatagtaatctgcccttttccttgaagataggttccaggacccctagtggatgcctgaaatcacgtacactgtttttttcctgtactatactnatactatgctaaagtttaatttataaattaggccaataagagattaaaaataccaatataaatagacaattatagcaataaa

SEQ ID NO: 670917 - DNA, 980 bp, Homo sapiens
  misc_feature (222)..(222): n is a, c, g, or t
  misc_feature (290)..(290): n is a, c, g, or t
  misc_feature (415)..(415): n is a, c, g, or t
  misc_feature (430)..(430): n is a, c, g, or t
  misc_feature (444)..(444): n is a, c, g, or t
  misc_feature (452)..(452): n is a, c, g, or t
  misc_feature (454)..(454): n is a, c, g, or t
  misc_feature (497)..(497): n is a, c, g, or t
  misc_feature (505)..(505): n is a, c, g, or t
  misc_feature (522)..(523): n is a, c, g, or t
  misc_feature (533)..(533): n is a, c, g, or t
  misc_feature (548)..(548): n is a, c, g, or t
  misc_feature (568)..(569): n is a, c, g, or t
  misc_feature (612)..(612): n is a, c, g, or t
  misc_feature (615)..(615): n is a, c, g, or t
  misc_feature (620)..(620): n is a, c, g, or t
  misc_feature (630)..(630): n is a, c, g, or t
  misc_feature (952)..(952): n is a, c, g, or t
agcgggttttgtgggccccccgagatgaagaggtacggtcgaagccaggagccaggccgagcgggagctgaccaggcttgactcgggtacagaacgaggcaccagtccccttgcgaaccgaagggcctcgcagtggatggaggaggcccagccctgaggtcaacgccaaccaggctagcctggcacggggcctacagggtgggtaggcgggcgtgccgcagnccgtccagggccttccctcaggtcccgggcgaggggcctacgctgcgggccggcaacaaaggcccgantcggcccctcgggaccagagccccacccgatcggaagcggatcctttaccagaggccataggccagtgactaggccgggcctgggcctcccatcggggccggactaaggacgaggccccggggangcccctggcctaccngacccttttctcangccgacancngccaaaagatgcaacgtgccctgccaggcgcccgccagcactngggggccnttctggccagcgccagnntggtggtganggctctgtgtgcggnggtactattcctctacctgnnctccttcgccgtggacacaggctgcctggcggtcaccccgggntanctctntcctcccaanttctggatctggaccctggccacccatgggctgatggagcagcatgtgtgggacgtggccatcagcctgacaacggtggtggtggccgggcgtttgctggagcccctctggggggccttggagctgctcatcttcttctcagtggtgaatgtgtctgtagggctgctgggggccttcgcctacctcctcacctacatggcttccttcaacctggtctacctgttcactgtccgtatccacggcgccttgggcttcctaggtggcgtcctggtggcactcaagcaaaccatggggggactgtgtggtcctgcgagtgccccangtgcgcgtcagtgtgatgcccatgctgc

SEQ ID NO: 670918 - DNA, 346 bp, Homo sapiens
tgtgcctgaaggtacacagaacgactgaggggaatgagaggttggacgtggatggctcacgcctataatccctgcactttgggaggctaagtcaggcagatcacttgaggccaggagttcaagatcagcctggtcaacatagtgaaaccccgcctctcttaaaaatacaaacattaggccgggcacagtggctcacgcctgtaatcatcccagcacttagtgaggccaaggcggatggatcacaaggtcaggagttcaggaccagcctggtcaacatggtgaaaccctgtctctactaaaaatacaaaaattagccaggagcggtggtgcacacctgtaatcccag

SEQ ID NO: 670919 - DNA, 217 bp, Homo sapiens
gacacctgctgcaacagatgatttcagtgaatagaatagaatgtagactgcgcatggtggctcacgtctgtaatcccagcactttgcgaggccgaggcgggtagatcacttgaggccaggagttgtagaccagcttggccaacatggtgaaaccccgtctctactaaaaatacaaaaatcagctaggtgtggaggcacttgcctgtaatcccagcta

SEQ ID NO: 670920 - DNA, 524 bp, Homo sapiens
tttttttttttagctgcaggagcttttattttattttatttttccatatcccaggggcacctggaacgccagcgagacagaactgttcactcccctggaaagggggcctgaagccagggagccaagtggtctggctcggcggttcccacccccatggagcccaggaaagtaagatccactggtttgaaattctcgcttccagcacagcagcaatctgagatccacctgggacggtggcgcttggtagggggaggggcgtccgccgttgctgaggcttgagcaggcggttttaccaccacagtgtaagcaaagctgctgggaagttcaaactgggtggagcccattgcagctcagcaaggctgccgtgttcagactgcgagattgctcctccctggacagggcatctctgtaaaaaaggcagcagcccagtcaggcttgtagcagacttaaacgtccctgcctgatggctctgaagacagcagcggatctcccaacacagcatgcgagcctgctaagggccagac

SEQ ID NO: 670921 - DNA, 694 bp, Homo sapiens
ggagaaaggaagacttgcggagtggctactgttgtttctcactaacactgagaacataaagatatttatgggaataaatgtgagagagaagttgtcagcaggagagagcattagtgtggatgaatgcaagtcattgtgccaggttttgacgaacccactggcaagactctggtattggccgatgctaggatgttcgagtttagctctatctgtccgtgtcgagacatagcgggagtttaagagagctgtgaaagtagcgaacgaggacaagaactctcaatacaagtatttgtggagcacgtgtctttaaggatgctttgattatggagtggtggatgaactgtcttgagtcagtgaagagtttcttgagggtgttgaaacaacatgaatgcattcgaggtttatgggtaccacaagatcagagtatacaagaatactggaagtgtgtgaagaaagaaagcatgaaaggagtaaaagaagtctggaaacaagcgtggaaaaggtctgttgtaataaaagatataatagtatggcaattatagttgttccagaatgtcaaaatttgtggattgttgaaggaaggtactggctattgtatcttgcttaagtcttcatggatattctgtgtgaacataagcagtgtctggtgacttgcgttgctgatgcataatgttactgagagaacttagtagaa

SEQ ID NO: 670922 - DNA, 429 bp, Homo sapiens
  misc_feature (38)..(38): n is a, c, g, or t
ccgccatccccatatgagctgctttcctatcttcacanctgccacctcatgtcacacctatctttgctcaccttttttttagagatggagtctcgctcctcttgcccagcgtggagtgcaatggcacgttctcagctcactgcaacctccgcctcttgggttcaagcaattctgctgcatcagcctcccgagtacctaggattacaggcatgtgccaccacgcccggctaattttgtattttcagtagagacggggtttggccatgttggccaggctggtctcgaactcttgacttcagatgatccatctgcctttggctcccacagtgcttgggattacaggcgccagccacaattgcgccggctattttctcacctttacacctgtcttcttatccctcagtgtggggaacagggggagatccctct

SEQ ID NO: 670923 - DNA, 856 bp, Homo sapiens
  misc_feature (16)..(16): n is a, c, g, or t
  misc_feature (132)..(132): n is a, c, g, or t
  misc_feature (646)..(646): n is a, c, g, or t
  misc_feature (746)..(746): n is a, c, g, or t
  misc_feature (812)..(812): n is a, c, g, or t
  misc_feature (831)..(831): n is a, c, g, or t
  misc_feature (837)..(837): n is a, c, g, or t
ctatcaccttttcttncccccttcaaccagagtcccctcctgctcctctccgctagtccggcccctgacccctttccccagtacccacttcctgcctctctcattaacccttccgtagctgctcaccatgancccatcagaatccagttaaaagactcttccaaatttcccagcgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccaagccatcagtcaagctgtcctccctattcatcccatagtccataacccctatccacttctctctctcgtcgctaccaacaccaccctctacactgcaattgacctgaaggatgccttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaanatgtggacgaccttcttctttgcagcccctctctaaaagactctcaaactcacacgggcactgctctcttaaactttctcgctatcaaagggtatagggncttccccttcaagggccaactttcatcttcatgatgacttacttaggaattaactttccctggggnccaggtatgactcagccanggcagnattaattgaaaattacccc

SEQ ID NO: 670924 - DNA, 326 bp, Homo sapiens
gccgtgatcatacttggttgggtaaacctcatcattatctaaaatacaaaacttagccgggcgcttgtgacgcacacccatagtcccagctaactccgcgaggctaagacaagagaatcacttgaacttgggagacagaggttgcagtaatcatgagatcactccgctgcactccagcctgagtgagagtgagactgtgtctcacacaaacaaacaaaaaacaaacaaaaaaatttgcattgtaaattgtacctcaaatttgagcagttttggtgtatgtgtaaattaaagtaaaaagcagtccacaataatgtattgtaatactg

SEQ ID NO: 670925 - DNA, 1010 bp, Homo sapiens
gcaccaaatggctggatgactgccgtgtgcagctgtgggtggtgccctggggtgccctggtggccctgggatggggaaccgcggtggcttccgcggaggtttctggcagtggcatcctggggcctggggtctgctgtgcctgtggactgtgggcctgggtggcctgaggcctgcggagctctgcggagtgcaaggccgaggataagtgagtggatgcccgtcaccaagttgggccgcttgtgtcaatggacatgaatgatcaagtccctggaggagatctatctcttctccctgcctattacaggaatcagagatcatttgatttcttcctgggggcctctctcaagggatgagtgttttgaaggattatgccatgtgccagaatgcatgtcccgttgcctggccagggcgcaccagtgttcacaggcattttgttgctaatcgtgggactacaagtggccagcgtcgtgtctagggtgttacggttgctccaaggatggttggtcaaccgccattccgtgtgggccatcatacctggccaagctctccatcgtaccccgtgcggcagaaggctacttgggggaacaagatcgggcaagccccacactgtccttgcaaggtgacaggccgctgcgggctctgtgctggtacgcctcatccctgcacccaggggcactggcattcgtctcctggcacttgtgcctaagaaggctgctcatgatggctggtatcgattgacttgctaacacctcatgcccggggcttgatttgccaccttggcacttcagccatggcacctttgatgccatatctaagaacttacagttacctgacccgcgactcttgaagcgcgacgtgtattccccacgtctccctaatcaggagttcacttgaacaccttggtcagaaccaaccaggatctccgggccacggactcagggtccagtgtggtacgacataggattaaacccgcaaaatacgtaattaggtgtccattccacatccacaat

SEQ ID NO: 670926 - DNA, 240 bp, Homo sapiens
tctgaaacaggaaaatggcttgaccccgggaggcggaggttgcttgacccaaaattgccccattgccctccaaccggggtgacagagtgagactcggtctcaaaaaaaaaattaaagggaattcacatttttggccccacgatttcccggcgggcacagacagacaacgcttgtgctgacaacatagcaaaagcttctcttgcacaaaggagcaccttcgaatgtgcccaagggcccgtg

SEQ ID NO: 670927 - DNA, 192 bp, Homo sapiens
tcccccacaccacctgagtcaggaggcagcgtgctggacctatcagtggcctctctagactctactgatccatcccaaatgaggatttaaacagtccagaaagcagggatcaggaatgaggacagggaagtggactcccatgatgttctacaaggttcaagaggattctatggaataagcagatcaacttta

SEQ ID NO: 670928 - DNA, 1079 bp, Homo sapiens
  misc_feature (863)..(863): n is a, c, g, or t
gtctaaacacgtgcgtaaaacactattggggccctgtctcgataattttatagtgtttcgtagccacccgacccctgtgtttgtggtccccttatccgcccgtggtgtgttactgccgacattgcgctctcgtggatatccaactgggggggggttgaggcacaacttgcaacgaaagctctccagatagtgttatagcgtcccccttggaaatttcgcgccggccaacacttggggggaggagcaacgtttattggccccccctcatgccaccaagttgtcttcaacataagtggtagagggtttcacaccccctttggcccacttcatttttttgaactatgtcgcagcccttttgaccgcaaaataaaaagtggcgtcttccctcttttaagcctttctctccggcccccccttttgtttcacgacgacaactaccacaggggaaacaaccccctctctggatttataactgtcgctcggccaacttaccagtggaaaccccctctgggggcccactcaaaaatatttgagatgttaaatctctcccacaacgttatgcccaagaggagccctaccgcgtgacacccccctttctgagccacttgtccacgaaaggggggagagtctccgagacataaggtctctctaaggcgtttctaacaaatctgagaatacccgctccgcaaggcgcacacctgtctgcgccctattttttctttcattaagcccgcgaataacaccacacgacttatttatataattatacacccctttcacccacactacacattctttcctatgggaccacaacactattgagacgcaccttctccccctgtagaactttaacaccacaacantatttttgtgcacaccagaccctacattctaacactccctgttctttatgtaattctgtaccagctatacaccccgattctccgcttacgacaccaacatctataccacctccttatgtgaaaaaacattctctacaccactcacacctagccattacattatatgataagtttccataccccattaccatttccagcatttcccctcaaacctta

SEQ ID NO: 670929 - DNA, 144 bp, Homo sapiens
ggcctggtttgccagcctgcccagtggtgatcacctctaggagggaggacgcggtcctctcaggaagtggggtgtgcattcggggcacttgggtttctaaaatgctgaaattctttaaaaagagatagaggtccaatcttccgg

SEQ ID NO: 670930 - DNA, 1153 bp, Homo sapiens
  misc_feature (1)..(1): n is a, c, g, or t
ncgcagcgtgctatactgtcgggacgtgtggtttttctgccctggtttgctgtgtcttgtctgtgcgcttgtttttcggttgtctcgtctttttttttgtgttttgccctcgtgttggtgtgggcgtccctgtttgtcgctgtttgccctgggcccatgccccctgttgtttgttcacttgtttatatagaagttggggtgagatatttttgtccatgctcaccggcctcgctcttttggtgttaattcccctttttaagtctgtggctctgtggttttcgcgctttgatgccttgtttgtgcccggacttggtccgtcccttggggttgttatgctcggggtagctttgcgcatgcctccacctttatgtgttttactaggttcatacggtttggcaccgtatatggcccatccctgagctgcatgccgagtttgccattttgtatgtttccctggcccagaaggcttagttggttgtgtgactgttgtataagtccgcgtttctgtagcctaagatttgagtgtttcccctactgtacgttcccctggtatgacctccctgagttaatttgggttataactggagctccatttccacccgctttgctctttgttccacatcgctgatgagagaagccttagtatctgtaaatttgaatttgaggcccttaaacccccttttaaataattaggctctgtaattaataagtgtaattaaggcttgtttttggtggagaaaaaaacttacgcttaaaccctcacggtaaactctctatgaattatgcgccacgcttccacggtgtatttttgtattctctaagtgatatggatcactatcgtataaaaatatgagataaagttgggaagatatatttgaattaatgctcgttctgcttgagcggaaaggtcacatgtaatttatgaaaatttaaaactctttggttatattgtgttcaccactcactagtattccagcactcactttatagtttggttttgagaactctttctggtattacgctttatggccacaatgtatataaagaaacccagttttggttatatttttataatttgtaaagtaagtttggttaaagtgatccctgttctttttttattttattgtcctttccattaaaaatatttgaaaga

SEQ ID NO: 670931 - DNA, 381 bp, Homo sapiens
  misc_feature (45)..(45): n is a, c, g, or t
  misc_feature (57)..(57): n is a, c, g, or t
  misc_feature (62)..(62): n is a, c, g, or t
  misc_feature (82)..(82): n is a, c, g, or t
  misc_feature (85)..(85): n is a, c, g, or t
  misc_feature (117)..(117): n is a, c, g, or t
  misc_feature (128)..(129): n is a, c, g, or t
  misc_feature (147)..(147): n is a, c, g, or t
  misc_feature (151)..(151): n is a, c, g, or t
  misc_feature (161)..(161): n is a, c, g, or t
  misc_feature (176)..(176): n is a, c, g, or t
  misc_feature (221)..(221): n is a, c, g, or t
  misc_feature (233)..(234): n is a, c, g, or t
  misc_feature (237)..(237): n is a, c, g, or t
  misc_feature (252)..(252): n is a, c, g, or t
  misc_feature (264)..(264): n is a, c, g, or t
  misc_feature (274)..(274): n is a, c, g, or t
  misc_feature (284)..(284): n is a, c, g, or t
  misc_feature (292)..(292): n is a, c, g, or t
  misc_feature (296)..(296): n is a, c, g, or t
  misc_feature (313)..(313): n is a, c, g, or t
  misc_feature (315)..(315): n is a, c, g, or t
  misc_feature (341)..(341): n is a, c, g, or t
  misc_feature (350)..(350): n is a, c, g, or t
  misc_feature (371)..(371): n is a, c, g, or t
ggaagaacgaaaggaaattgatgtggaagtgaggaaggagattgnggatgctgcccngtttnccgcggccggtcctgagccnccnttggaagagctgggctaccgcggtctactccnggcgacccgcnntttgaagttcgtggtgcngatncagtggatcnagtttaagtcagtcngttaaggggaggagaaggagaggttataccttcagggggctaccngacagtgttctnnacntggttaaggaggaanaaaacccggtcnatgaaattcnatgaaattcntggaaacnccgntaagtgtgtagattgancnggtagtaattgcatgcggtttgtacnttagtgcgntaaaagatgaattattgagtncgtaaagatt

SEQ ID NO: 670932 - DNA, 849 bp, Homo sapiens
  misc_feature (79)..(79): n is a, c, g, or t
  misc_feature (81)..(81): n is a, c, g, or t
  misc_feature (118)..(118): n is a, c, g, or t
  misc_feature (143)..(144): n is a, c, g, or t
  misc_feature (209)..(209): n is a, c, g, or t
  misc_feature (214)..(214): n is a, c, g, or t
  misc_feature (258)..(258): n is a, c, g, or t
  misc_feature (268)..(268): n is a, c, g, or t
  misc_feature (292)..(292): n is a, c, g, or t
  misc_feature (295)..(295): n is a, c, g, or t
  misc_feature (310)..(310): n is a, c, g, or t
  misc_feature (336)..(337): n is a, c, g, or t
  misc_feature (358)..(358): n is a, c, g, or t
  misc_feature (381)..(381): n is a, c, g, or t
  misc_feature (389)..(389): n is a, c, g, or t
  misc_feature (395)..(395): n is a, c, g, or t
  misc_feature (405)..(405): n is a, c, g, or t
  misc_feature (430)..(430): n is a, c, g, or t
  misc_feature (487)..(488): n is a, c, g, or t
  misc_feature (490)..(490): n is a, c, g, or t
  misc_feature (527)..(527): n is a, c, g, or t
  misc_feature (542)..(542): n is a, c, g, or t
  misc_feature (565)..(565): n is a, c, g, or t
  misc_feature (684)..(684): n is a, c, g, or t
  misc_feature (834)..(834): n is a, c, g, or t
agccaccgcagaggccaaagccatgccaggggggggggcgggagccaggggaacaaaaacagccttgaacaagaaaacncnggaggcagaatgcaacagcccggcccccccaacaccngagccaggggaagggccccggaaannggaaggaggcacaagtgccaagggtacgtggcagcctcccagtagcattggatgcaggaaaaaanacatngacggggaaaaacaagccgaaccagggggagggggagagccggnggcgacacangaaccccaaaccaaagaccagggngcngaaaaagagccaacncaacacaaggaggatgaaggcgaaanncaaccagaaaacaaagaaganagcattgaaaacgggagagaganagacagcnccaacngcggagccanaaaccagaagcctgacatgtttggnagtccttttcaataagcacaggaggaggggggggagaggggcaagggcgggagacanncngcgcggggcacgggaggcagaagacaggggcggggcnggtggcacgggtggnaggagcaactataaacataagtnagctgtttagcaaaacacacattcctagtaggttttggttttttgatctttataaagatgaggtttttttcctagttactgtattaagtatgacttcttttagaaggttacaaaaaaantcagatgttgatacctttttaggaaatgtgcataccactcatcaaatggaatgctgaaagtttgaggtgcttgtatataatcggataaacaaaactgatcaacccaatgtgattttaaaagccccaaagaagcttctgttttgggtctgntctcttgatggagaa

SEQ ID NO: 670933 - DNA, 396 bp, Homo sapiens
  misc_feature (20)..(20): n is a, c, g, or t
accctgcttgagccaggagntgagtccctctcccactcattccagcccaacaaaggaaggaggagggggcccatttgtttgtcccagagcttattggccattgggtttcattcctaagtggggccagggtgggagggagggacaagggggaggaaaggggggagcacccacgtgaaagaatttgcctgtggccttgcccgccagcctaagtgccacttgacattctttgtcaccagcaacatttggagccccctggatgtcccctgtccccccaattttgcattccatggcccccccgtgccacccgtaggcagcctttttgttataagaaaagcagacgcagcagttgggacccctcccaacctcaatgccctgcattaaatccgcaaacagcca

SEQ ID NO: 670934 - DNA, 112 bp, Homo sapiens
ggtccgtattgagtggcatgtgatacagaagagggcaggtgcagtgactcacacctgtaatcccagcactttgggaggcgaggcgtgagccatcgcgcctggactttttttt

SEQ ID NO: 670935 - DNA, 384 bp, Homo sapiens
tgttctacgaggatcccggaggcaactgcacattagaaagagtattttcactccttaagaaaaaaaaaaacaggcctggtgaagtggctcatgcgtgtaatcccagcacttggggaggccgaggtggatggatcatctgggggcaggagctcgagaccagcctggccaatgtgaaaccccaactctactaaaaatacaaaaattagccagccatggtggtgggcacctgtagtcccagctacctgggaggccgaggcaggagaatcccttgaacacagaaggcagaggttgctgtgagctgagattgcgccattgcactccagcctgggcgacaagagtgaaactgcgtctcaaaagaaaaaaaagatgttcccaccttaatgc

SEQ ID NO: 670936 - DNA, 328 bp, Homo sapiens
gagaggtgtcacagcaaccccacaatgctggtagcctgagcggagacttccagactcaggaactggagaaagtcagtctgttgtttaagccaccagagtggtgtttttgttatgtgcagctggagcagactgagacaggtggcagccatcgaaacacgcattgtaaagctacaactgtgtattttcccgtagcaagtggtcgcatcctgtgactatccaggacccatcagcctctcctttaatgccatccatcaacaatcattgcctgagtcagttatttcaacagaggttgcaaaatggcagttttcctatactcccatttctctta

SEQ ID NO: 670937 - DNA, 496 bp, Homo sapiens
catatacatagaaacagtcgaggaaacaacagagtgctggagaacaatgtggcgacatagagaacacttacacactgtaaaatagggactgtaaactagaaagctatatgtaataataagccatttgtactttaaaaataactgtgagcatagtattattcatcataatcattattatcatcaaaggagaggacctctagtgaatttatgtagatatgcccatgtagcacagaaccatacaaaaatagctagcaaaaatagcctacaccttttgaaactgtttcccatgctaagaagtatagaatggaaaggggtcacagacctaagatagctagatatcacatagtagccacagccaattatcagggagcactcccaagggacaggcgaccttagatcatccatactctatgtcagcccatgtaacttactgtgcctatctcaaagttgcaaggatccatgtctaatatcatacatgctattcctaattttctgg

SEQ ID NO: 670938 - DNA, 594 bp, Homo sapiens
taaacccgagaataaaggagactcctttatctagtaagacaagctttaaatactactgactgccctaagaataaagattactaagccatgagtccatatagaaacgataccttaggtatacctatagcttaacatcccatggaatactgccaagaaaatctccagatggaggagccaattgctgtggtctcttcagatctataggatcggcctccatctctgtccctagccttccacacacttccaagatcacaggggaaggaggagccagaagcaaccgcttcgccattcactcaccctgaagaggcttcccttctctatcccacaggcgaatgaggtattactatgactagtcaagtatcttccccttctgcccttaaactacactgaggccaaattctgacaagaacttgcacatctatatacataacaaataaacatataaatacattacgtaacaaactgaccatttacatgtcaagatgaagaagcagatctacttcaagaactaaataaaatctcacatctaagttaacatgaaaatccagtgattccactttagcaggaaaaatttgaacacaaactaaaaatccc

SEQ ID NO: 670939 - DNA, 168 bp, Homo sapiens
gccggtaccccctgttggaaagtttctccagttacgcggtggatgatacggcactcaaacgttccaagaggctgtcagggttcacttcaatattgataacaccttctagttcaatgccaagttcagccaatgttttgtccaaggcatgagcttgttcaattgtacgtg

SEQ ID NO: 670940 - DNA, 107 bp, Homo sapiens
tttgtagggggatcggttcacagcatgaggaagtggatgcagctgtacagagaagcaacctattgacaacaacaggggaatttccaattaccatcgagtacacacgc

SEQ ID NO: 670941 - DNA, 458 bp, Homo sapiens
ctcttgagttgatgaggagggtagagtggaggaccaggtagagtgggggatcctagatcatgtatttgtcttacttttataaaaaggaaaaaaaggaataagagtacattttcggccaggtgtggtggctcacgcctgtaatcctaacactttgggagaccgaggcgggtggatcacggggtcaggagttcgacaccagcctgaccaacatagtgaaactctgtctctactaaaaatacaaaaattagccaggtggtggtagtacacccctgtagtctcagctacacaggagactgaggtgggaggatcgcatgaggccgggaggtcaggtctgcagtgagccgtgattgcaccactgctttccaacctgggcgacatagtgagatcctgtctcaaaaaaaaagatgaaaaaaagtatattcattttagttgcatattgtggacaaccaagagtgtcg

SEQ ID NO: 670942 - DNA, 872 bp, Homo sapiens
tagagcagccctgggaacacggaaatgaccctgtctctacacacaataaacgagttagctgggtgtgctggcacacacctgtagctacttgggaggctgagtgaggaggattgctcgagcctagcaggtcgaggctgaatgagctatggttgcgccattgctctcctagcctgaacaacagagtgaaaccctgtctgaaacagcacacacacacacacacacacacacactcacttttgacataaatatatataacactatgaactcaccataatgaatagtatacactctgaactcatgcttatatcatacaggtgttacgaagtacttttcatgacccgtgttttcaataattcttcatatcattatttataaatgtggtggtaaacatatatcttgtgttaattacttagaaccagtcttctatagctgggagtatatagaccagtataaatatttcattattacaaataagtgccacaaatataaactcttgactgaacttgcctgccattaatattgtatccctcagagatctgcggtagcaatgtgctcattaccccttattctggccaaagaatttacaatgtacactgttcctgcccaggtgcggagggtacataccaaaggaccagcacattggggggagcagaaggcgggtgggaacgcttggacacatcagttcgaagaccagcgaggcaaatggacaaactagctcattaaaagaacaaaaatactgaattggggtgaacacggcaagaagccggcccgcgacagcaattcggaaccccgagtagaggaacagagccccaaaaccgaaagataaaaaacgaacggggcaagtaaccgattcgcgcccaaagaagaaacac

SEQ ID NO: 670943 - DNA, 125 bp, Homo sapiens
cccccttgcgtgtctcatagatgatggtgaaaccccagaagcatgctgctctccgggagcttgaagaagaaactggctacgaagggggacatggccggaatgttctccagcggtctgtatgagac

SEQ ID NO: 670944 - DNA, 121 bp, Homo sapiens
gcggccgcctactactactactactgctcgaattcaagcttctaacgatgtacggggacatgagggcttccaatgtgctgcccccctcttaatactcaccaataaattctacttcctgtcc

SEQ ID NO: 670945 - DNA, 1723 bp, Homo sapiens
  misc_feature (316)..(316): n is a, c, g, or t
  misc_feature (327)..(327): n is a, c, g, or t
  misc_feature (1723)..(1723): n is a, c, g, or t
tcggtcccagccaccgctaacactacaggctggttacccccgaccccctcactactcctacctccgtgggcggtctgcaggcgatcgccggagtgaggcttgagagctggtgaggcggaatctgctcggactagtagtcatagctggtggtcgggcggtcgcaattctaggaattggaacagacaggaggtaagcacgcagtcgagcgctgcttggccactcggcgtgaatcgcgcgccccctgtagctgctagggtgagctcttgaaccatttaggcacccgagtgtgggcggtcgcaagcgctgcgtcaatgantcgcttgtcantagtcttgcgtatgtgttgtcagctgtgcgacgaggcacggccactgggtcagggtagtcgatgatcctgaatgcctctgcactgcactcgcagggcgcagcgagcgcgcacagggagctagtcttgtcagcccgggtgagccaagtggaccacttcacaatgggcattgagggagtcctaccagcagtgggtgccaattgtcgctgtctaagtggccccctgcccaatagtgggtggagacattggccgaacggcccttgcattgggggtgttcacagtaagcgagcccggcacatttgactttgaccccttcccctaggattaacccttgcgagttgggggaacactcggcagtaggccacggcccaatgcacttgcaatttggcttcgcgcctttaattggagcgaacgggggcgcctagctcgaaaatttaggggaggaaccctaaaaagtgtgtgcctcctgtggggacgacttttgcacatcggctcccggacctcccgagattagtatcttgggaccccttgggagggacacgctggcacctcggaaacttgattgccttccaagttaaaattggaattccattccaagtgggaccgttgtacccccactttggtgcctatgaccccctgtggaaccaccgtttttaagccgccgggacccctatgaggccacgtttataacacacggtaaacgcctacacttgggggcacttcgatcaaagaaccacacggcgcgagagggttacacacaagggccacaacttccattaggggggtggtcggcacgacaaaaagtatcaagacttttggtggtggtaggaagccgtatgagacgtagggcgactttaatacaaattccaatcgggttgttaaggtgtggaggacacaacgagaggacgtttggtttaatcaattatagtagttttagccagaaatctagagcgtttgggacacagaaacgccggagaaaatgcgaggagtccgtatatcccttgcgcgggatagaaaagagacctagggacatggaaaggcccttataagaaaggacaaaccctatggcgttgttagccagagcgcgtccgtctttactgtgtgtagacattgtggccctccattgtgtaggccaacgccggacaaatttaccggaatacttcccaggatgtttaccctggaggacacaacgctgtggctgtatgaacgtgaacttcagtcataaccctcgcgttccaaggatgctgacacagacgaaaactttctgcgccccgtgtggtgtctcgagagaaaccctggtgataacgcacacgcatctgtgacgcgcgcacccttggcgacagcgcccccagtgtggcttaccatcacagcatccgacacggcaacagatcggcgcgn

SEQ ID NO: 670946 - DNA, 749 bp, Homo sapiens
agcggctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtcc

SEQ ID NO: 670947 - DNA, 599 bp, Homo sapiens
aatttctattcttttctattctttaatcatctcatcaaacaacctcacaaaccccaatcaacccaatccaaacacccccccccacaaaaccatccatgtataaccaacttaccccacaaatccaaccacccctcatacaaaacacctccacctacacatccaacaataacataccaactattataaaaatatccacaacccacaaatcactcaccccccaccccccacaaccaataaccacacacccatccaacccccaccctctacacacacaaacaccatcctcacacctcccacctaaataccaaccctcctcactatctcactcaacacacacaatataaccccactaatacaacaccccacacctccccacgctaaaaaactccctaccctcaacatccaccaacaaaacttcccccaacaacacccctacccacaccaactccataccccaccaaactccacccttacaaaaccccccaacacccaacactacccccaccctcccttcctccatacccctcaaatcccccacaacaacacaccctacactcaacccacatcacaacacacacccacactcgacacacactact

SEQ ID NO: 670948 - DNA, 865 bp, Homo sapiens
  misc_feature (339)..(339): n is a, c, g, or t
  misc_feature (342)..(343): n is a, c, g, or t
cggcttgcagaaggataagcagagcatggacggtggccccagtgacctaagccactatgggctactagaaaagcaaggctggcaaagtgacatttccagcggtcaactcaggaccccttccctgcagatacaatcgagagcagtgagtaagtcatagcaagctcttccccacaggtataggggaaacactggtgatgggagtagctcttcttgctcttagctgcatgacaaccatcgtgccagccaggtagctgaagcctggcagaggacgcccagtggcgccttttcagtaggttcttgggaatgctccgcagccaacttaagccgactgagttcctntcnncatggggaccagtgtgcgatggctgcacacagcagcttccttggtagtgtacgcagcctgttggttgtatgggttgctctaagggaccttggagacaggcctttcaggtggatgttcatgtttctgaccttgcactaccccaatgtaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtcc

SEQ ID NO: 670949 - DNA, 529 bp, Homo sapiens
catcgacaagttccacatgcttacgatctctatctctgtgaagaagcagctgacggaggagtaagtcgtgacctagtgacaacctgggggtagaattgtcctaaggcagttgaccccaccttccaacatgttttcactttatttgcccctccctacatttgggttaggttccatttggatttgcagcaataatgactttatttctctcttggtcaggatttggcacataaaatccttttattatagaactagctattttagttacatagtaatgtaactaatggagagatttatagagaattttgtttttgctgtcatatatgtccattttggagacagatatgatagaactagaaattaagttgcatttctgcaagtgccatttgaatgaacttcaagtatcttcttaattattaaattttctgatgaaggcatagtaacaaatatatagtattattaaatctaattaatatttggaaatattaataaataggtattttatttactgtaaaaagtcaaacttcattat

SEQ ID NO: 670950 - DNA, 445 bp, Homo sapiens
gcgtcgacaaaggcacctcgcatgcctgtttggagcctgtcagccccagcacaggacaacatcttgttgaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtcc

SEQ ID NO: 670951 - DNA, 756 bp, Homo sapiens
taaatgattgaacagaattattgggctgtcttgagtgtcttgggtatggctttggcagggctgtctgggggttcccccgcttggcttgtttggggctgctgctgcagcctttaaggctcttcttcgcttcttcagctttggagtctccgggaaaacccgaatgcacagagccttctgggtcacaaatcggcggtgggctcttcggtaatacagaggggggaaggtgtactcaattcccagcccccagaatatcttctcaaagacatcatagtggtgtacggaggtcagagcatcattttatcctctggcttcaaggctcattagcagatagcgttggggggcttggcccatttcgatgtttctccaagtgttctttcataactgcggatcttgacagacaaggcaataattcgagccctccagggatctggtgtcccgtgggttggccaacaatcttcttcataacctgtcttgctgattctaagcatctccttctggtgggccatttccaaagacaagagtctttccagcgaatatatcagccttctcacattcccaggggacaatccggggaaagctttagagcacggtaaaaggagcgtgggcaatcaatccagccatagactggggcggattcccgaacgcacatatccgccccccgggctggaacgcagcgaaactcgaggcagaccgccccccggtctgaacgcggaacctgggggccccacggccgcacgcccgggacacagcctggta

SEQ ID NO: 670952 - DNA, 869 bp, Homo sapiens
agcggctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccaaagaaaaaaaaaaaaaaaaatgtgttgggggtggcagaaatttaaacatttggggggcaagatagaaataggaaggtgcaagaagacgagaaggtggtcacaaaccggggcggtgaacg

SEQ ID NO: 670953 - DNA, 1260 bp, Homo sapiens
  misc_feature (260)..(260): n is a, c, g, or t
ggacggtgatagccgtccgaccgtagcctgctgctttcttgcttactgtttcggcttcccggctacctcgcccgggcacggtgaaggcgggccaggctggtggattggtcggatatgcccttgtctcccgtcggccaatctctgtgcccctagcagacactggacgtcgactacgtggggctatgctagtcgagcagtcgggcgaggacggatagatagggcgggcacggcctgtcgagtctgtgctgggtgggcactgntggacgacggggagtgatacaagagatctagcgatatgcactggtagagactacaggaagcgcacgagctttgagtcattacccttgcctgctggattgccatattaagagcagctctgcggaagagtggtgctgactcaatgcatcataccggcagggcatgctgtgacaacggtgggtgattgcaccataggacattacttcagtctgggtgagtaggaagccatgtatgaacaatcgctaacattgtgctgcagaaggtggccagagtcccgcgcgatttgtcattacgttcgcatagcacttgggcggacttcaattgtgggaccaggagtctctcctttgggatgccgcaggttgcaatgctgtaatagtggtgatttgtaacatgcgcgacgtaactcttcgaaggcaccgattggaatgttcgggaactacgtagtccgaaaagccatgctctattttgggcattagctaccggcaaggaaagagacacaaggtgcggaattgattcacttaggccctagatataggtgaggaattgctacctgtcaccctcaccctatggcagagaggtttgcttccgttgcccctattggattacccctaagggcttcggaagccccacgggcacttggggcctttggtcgctcttacgttcttggcgaataccgttggtggacactcgtcacagggacccggcggacgatcacacgacgtttaagaagaggaggggaaggcagtccaggcccaaagcggggtcaaactacttgcgctggtgggcctctcaaatgtctgggtaccaccatcaactgatgcatagtcccccgtttgtgtccatgtaccaaagaggtaatagccggagaacacgagaacggttcgccaaattaaaacaactttctatggccaagagcttatcgacatcgtaacagaagctctacacataccctggttgataatttatggcgccccaaacgtcgtgtttgttttacgccatcac

SEQ ID NO: 670954 - DNA, 448 bp, Homo sapiens
atacggtaagggtaagacaaagacataaaaatcaaaattaaccagaaaataaaacagtcttctctcccaatgacaaaaaatagcttcaataccaactccatatcagaatagcttccaccgctgacatgtcctgctgccatacacgcgggtcaagtgggtagggcagcagaccccaaggagccatcacgggcaagagctggagtttgatacgtcaaatctgagtatgtgtgtgtacgtgtatatatgtgtgtaagaaatatatggggtgtaactagatatgagagagtaccctttaggcagctggatatgaaagatcaatgaatattttgtctggaagaggagaggggaattgtatagaagagctacgtgtattcttggtttgtgaaggactctgtactcaactctcactaccccctaagcacttgagatttctagcaaggactagaca

SEQ ID NO: 670955 - DNA, 899 bp, Homo sapiens
  misc_feature (339)..(339): n is a, c, g, or t
  misc_feature (342)..(343): n is a, c, g, or t
cggcttgcagaaggataagcagagcatggacggtggccccagtgacctaagccactatgggctactagaaaagcaaggctggcaaagtgacatttccagcggtcaactcaggaccccttccctgcagatacaatcgagagcagtgagtaagtcatagcaagctcttccccacaggtataggggaaacactggtgatgggagtagctcttcttgctcttagctgcatgacaaccatcgtgccagccaggtagctgaagcctggcagaggacgcccagtggcgccttttcagtaggttcttgggaatgctccgcagccaacttaagccgactgagttcctntcnncatggggaccagtgtgcgatggctgcacacagcagcttccttggtagtgtacgcagcctgttggttgtatgggttgctctaagggaccttggagacaggcctttcaggtggatgttcatgtttctgaccttgcactaccccaatgtaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccgcaccttaaggggggatcctctataatcgccgag

SEQ ID NO: 670956 - DNA, 365 bp, Homo sapiens
  misc_feature (30)..(30): n is a, c, g, or t
aaaacttaggctaggtacgaggctgggtgngggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtcc

SEQ ID NO: 670957 - DNA, 892 bp, Homo sapiens
  misc_feature (419)..(419): n is a, c, g, or t
  misc_feature (448)..(448): n is a, c, g, or t
  misc_feature (467)..(467): n is a, c, g, or t
gaatctgaacatgctggtgtgtccatgggacgcacggctccgttccgatcgtcaccggtattgtacatcaatcaacgtccgtagcctaacgtctacgcctgtactggccgaatgtgtaccgctgattggcgcaaagatatccgcctttgtagagccctgaggagacgtactcataaggcgagatagtgagatgagatggtccgattatgtagttactcactggtgatcgtagtgaaatagtgatgacaagactgatgcatctagaagactctggaaggactgggccgagatttaggtgcgcaatgtaagctacagtgagtgagaatagtatgttgtggctaaaagaagtgggcatttgccaatattacctggagttgacagggctacgcataccacacctttacacaagcgatacaatnctcgggcaatacaaatcagaagaataggngttgttcgctagctaggcntcgagggggcgttgatccacgcgtctgcgcgagaacctatggggcaatagtccagaggggtcgaccctatttgggatacatgtccccgatgggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtcc

SEQ ID NO: 670958 - DNA, 137 bp, Homo sapiens
tcctgcgggcgtcgcactggttgtgacagggcgatcgtgggacatggtcgtgatcggcgtatagctcatgcacgcctgatctaagaaggatcctgacagattatggcttcgagggacatcctttccggaaagacttt

SEQ ID NO: 670959 - DNA, 290 bp, Homo sapiens
ggacgaccaggggacaacctcatctctgcctgtctgcgccgtttaggtctaggtattttcatcggagttggcgtgaccgaggtgggggatcactggttgtagaataccggatggtgagctgcagcatctgcattttcatgctgattcagttcctcttggggagcggcggggatgcggtcttcaaactggtcggcaatagctcttatgcaggaattcaggatctgaaaaacatcttaagccatttttaaacacaaacaaaggccttatgattctaacatcagaaatctact

SEQ ID NO: 670960 - DNA, 969 bp, Homo sapiens
agcggctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgaccggcgtccacaacacgaggactgtcgcagagtgtcgctcttgtggaagacgccacagggacagctgtgcgacagggctatcacagtggcgccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccctatgtcttttgtatctacattcttgacggggcaaggaaattcctctgggaacctttgggctcattggccttttcaacttcagaacacaggttgacaaactcaggcctgcctccatgaaggcagaaaccctgcaaagggctggggactggtgggcttatgtcaggtggctactcctggaagcttgatttggactccca

SEQ ID NO: 670961 - DNA, 166 bp, Homo sapiens
tctgcacagagattcctgcttaaaaaccacaaaggatgactatggcttctaagcaagcaagcctgagaggctttacatgggctggctcctaatatcacaacaaaatatttctttgccacaaaggaactagactatgtagcaatcacatttacaaaactacatgcat

SEQ ID NO: 670962 - DNA, 269 bp, Homo sapiens
atccgcaaagtcctgtacgccaacacagtgctgggtggcggcaccaccatgtaccctggcattgctgacaggatgcaaaaggagatcactgccctggcacccagcacaatgaagatgaagatcattgatactactgagcacaagtactccgtgtggatcggcggctccatcctggcctcgctgtccaccttccagcaaatgtggatcagcaagcaggagtatgacgagtccggcccctccatcgtccaccgcacatgcttctaggcgga

SEQ ID NO: 670963 - DNA, 269 bp, Homo sapiens
acagaagcgtgtatggcaggatgtgatgagctggcaggcagtcagttctggcgcagagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtcc

SEQ ID NO: 670964 - DNA, 354 bp, Homo sapiens
  misc_feature (26)..(26): n is a, c, g, or t
  misc_feature (43)..(43): n is a, c, g, or t
  misc_feature (306)..(306): n is a, c, g, or t
  misc_feature (331)..(331): n is a, c, g, or t
  misc_feature (349)..(349): n is a, c, g, or t
ggcagcactgaattccaatgcaaagncccagaatcactgtgcnctgtctcctccaagcacacagatttttttctccatgccatgcaacctctgcctcaggggatgggggagaagtggcatcagcaattcaagactgtcttttgtaccctcttcagtgcctctttcagcgatatgaagttaaaaccaggtactttgatcactcacctgatttttgattcttatcaaggtgctttttgtgaggatagttgttcaatttggtggaacaaactaggaggagtcatgatcagtggaggtcttctatttggnccatcttgttctgtctccatcctgnccatttattattaaagtncagaa

SEQ ID NO: 670965 - DNA, 696 bp, Homo sapiens
gaccagctgtgccctgtgggacattgagacaggccagcagacagtgggttttgctggacacagtggtgatgtgatgtccctgtccctggcccccgatggccgtcacgtttgatgtcaggcgcctgtgatgcctctatcaagctagtgggacgtgcgggattccgatgtgccgacagagcattcatcggccatgaatccgacatcaatgcagtgggctttcttccccaacggctacgccttcaccaccggctctgacgacgccacgtgccgtctcttcgacctgcgggccgagtcaggagctcctcagtgtactcccgatgacaaggatcatcgagtggcgatcacctcatgttgccttctcgcgcagcggacggctgctgctcgctggctacgacgacttcagacgtgctaacatctgggatgccatgaagggcgaccgtgcagtgagtcctcgctggcctacgacaagcgcgtgagctgcctcggaggtcaccgacgagtggcatggctagtgagccacgggattcctgggaattcctttcctcaagatctggaactaactggccccagccctcatgggtcccaggccaggaggaggccctggcccaatgccgcacaagtacaaggccagggcacttgcggggcatgcgcgcaagtcccagcccccttccccggaccacgtaggcctatagggtc

SEQ ID NO: 670966 - DNA, 426 bp, Homo sapiens
gaggatccccgattagcgagagagggggactccatactgctggagattaagtttccaccactcagtagaatgggaacttgacatataatttatgttgagtcgcagagaaaataacttacatttcctgcataccggagtttgtcagataatacccatacctgcagaataatcattaacagaaagtgggtgataaacactgagtatctcaaacaaatttatctacctcaaaaccatggggtactgtggctcttatagtacgacaaaccacggtggtcttatctcaaggccagagtgagatgtgacgaaatgaccctctggcattttggtgggtaccaacataaagagaacagggaatctgaggagacgcaaggacaccttctctgcagaacgaaatcactgtcattggtgaggtgtgattctacttca

SEQ ID NO: 670967 - DNA, 380 bp, Homo sapiens
  misc_feature (132)..(132): n is a, c, g, or t
  misc_feature (140)..(140): n is a, c, g, or t
ggcccctgtagttaataagtatcttgtagagagatcatcccaactttcactcactagttttagcatcccattgaagatgttcacctgaatcaatcagtaccacaatgattgcccaaatacagattttctaantccatcantccttttacatttgttggttggcattaccctaaaaggtagagctttcccttctctccaatttattcattgatttatatcatgtggacttgtggcttattttatttgagaagttgtaatttgttcgtttggccagtggcgaccccttcaagctggcttctgtgtcctttggtatgtccccatcattcttggagcatgttcttactttctaatacaaaaagacattccatgctcaaaaaaaa

SEQ ID NO: 670968 - DNA, 132 bp, Homo sapiens
ctgtacaggacatcatttgcgtgtattacttggagcccgagctgcaggtgccgtcattggcgtcgcgagtggacacccataacccaggcgctgtgcgcgcactgcgcggagaagttcgcggtggtgcggccg

SEQ ID NO: 670969 - DNA, 118 bp, Homo sapiens
tctcaaatgacatcaaaggtctgcatattgtatgatgtattaatagttgatagttctaagtattgtgtcatagatactatgagcactataattcatatttgacacatgcatgtggact

SEQ ID NO: 670970 - DNA, 193 bp, Homo sapiens
  misc_feature (140)..(140): n is a, c, g, or t
atcttgtgtcatcccccttcgtgggggagggcacaaatgtggctgccaaacaacttctacctgggcagcgatgggcgcactgtgtgtcaactgcacggtagccagttgtatgcaagaacgacaagtgcatccccttctgntggaagtgtgacaccgacggacgacttgcggggaccaactcatgacgagcccc

SEQ ID NO: 670971 - DNA, 679 bp, Homo sapiens
  misc_feature (12)..(12): n is a, c, g, or t
gaaagatttctngtcagaactatctttgtgcaacagttctggatttattgccagctgcacatgtaagaatgacaatcacatgtgtaaacaattctcatgtagtataaatgtataattctcatgtagtataaatgtataaataattctcaagtagcttatttgaaaaatgtggcaatgaaaatgttattagaaacttactttgggctgagcactatggctcacgcctgtaatctcagcaatttgggaggccaaagcggacagatttcttgagcccaggagtttgagacctgtgtgagcgacatggtgaaaccgcctatatgaaaaataccaaaataattagctggacatggcgatatgtgtgtctgcagtcccagctacttgggatcctgaggagggaggattgcttaagcccaggaggtagaggttgcagtgagctgaattcgcactactacacttgaacctgggtgatagagtgagaccctggcttaaaccaaccaacttacctaaaaccaaccaaaattccctattatggatgacaacatgctatgatgggggcaccatgcaaattagaatctgtatggtaacccagcactgggaagaaagttgggccaccaaggatcaatccccggtacttaaaaccttttggtttaatcaacgttaaggatggcttggccttctt

SEQ ID NO: 670972 - DNA, 655 bp, Homo sapiens
tggagagggagaagcaagcggtcaacctggactatagtcaccctagcgtatgtcatgccgtaagctccgtcatccatggtcctgagccgagcatatctgatagaaactcaagtcatatagtgaagtcacgctagtaccagtgtaggcaggacagaggagccggtgacatgtaagactgtggatggcttctgccctcctggacatgatgccccaagcatgctctgactgtgcacgaaggtctgactcgggcctttcagcaaacctggccctcacaccacctccctcactcaagcgtccctagcatctcgtaccccaggactgagcaggcagcgtgtgacactgcccggtcccgtcaccccaggagcaccgcctggatgtagggggcctcccgcgtatcctccctgatctgaggcccgggtcctcaggatcccagagaacgtgacgtcaccaaagagaggctgacccccatcccagcaggtagatcaacacatgaggaaggcgtgagactgggacctcctagcagggggtgaggagctgtgtggcacagcaagactcccagggcaggtggacagccagtagccggggctccagcgtcacttcttcgtggcgcggtatgctgcgtccaggtcagccatgttgcgggcgtccgtgatca

SEQ ID NO: 670973 - DNA, 195 bp, Homo sapiens
cctcgtgtatattgaagtgaatggaacagaagccaagcaacggtggagtgtgggtcagacccagaggagaacagtgccaggtcaccagatggaaagcgaaaaagaaagaacgggcactgttccctgaaaaccagcatgtcaggtatatcctagttactggacaagacgagcacgttcgtggtgggccaggcactg

SEQ ID NO: 670974 - DNA, 1305 bp, Homo sapiens
  misc_feature (433)..(433): n is a, c, g, or t
  misc_feature (509)..(509): n is a, c, g, or t
  misc_feature (648)..(648): n is a, c, g, or t
gtcgaaaataccgattttagactctcgagaatgtggcccatatgctatgagtggtcacgggtgccctgtctgtgacctgactgaatcaacatgcgcagcaaaagtcatcggagtggtgcctgcagagtagacagcgacgagagaaggtgatctgtgagcaccaggtgacgtgtttacagcgctctgttcgtagtcacaccctttgactgaatctggatggcctgatggaacaggacatacttccaaaggtgcaactgaagagtatcccgaaacgcaatggaccggattcctacgtcgtgtatgagtctcatcagggtcggaaccattgttgtaggcagccgggtgcttggacacacgtatgagtaggaaggctcacgtccccaatacaagaaaagagctgggagtgagcaccaggcagcttgccaagcagagntctacctatcaaatgtcgtgtgtacactttgggaaggaccgggttttggcgtgagaaagcacagggaaggtcgccnttacatgtaacgtaaacggctattccagaattagtgaaccaagcgggtctccgtaggaatagacgcctgcactgagatgcgcgcgtattatgctacatgcagtgcaagtggaccacgctgtaggcagtgctctacccanacggcagaaggtttgcacgcctgcttgcgatccacagaacaaagcccgatcacgtgccagtgagaaaaccagtctgaccaatggtgggcataatacttcgggcctggcgtgaccacttttgtcatgggttaaatcattggcaggaggccccaggaactgtctgcccccaaatcagcgctttgttatgtaactgaaggggcctattttcggttaccctgtacggtgacaaagtgcgttatccgacgtaaaacttggaacaagccattcggggttggaacaaaaacgttgggcacgtgcccaggttgaaaacttatttttgcgccaactgttcccaattggaccccctgggaaattcgtacctggccatagttccagcaagaggcttataggagaaccaagctttgacgctgtgcttacccctggcccgttcgccaaggggagctaattggtgggtacatgggacctggcaaggacgccctgtgaaacttaagtcgaccaatgtgcctgggtagaactaagcatgggtgtcttgacctcggtttaactcaaagacaacgtaaaactttcgggcgttgcctataacgaaaagaagtacgtgttgactctttgtcctaccctaggaggaattctgcccctaatgattcccagaagggacac

SEQ ID NO: 670975 - DNA, 257 bp, Homo sapiens
  misc_feature (224)..(224): n is a, c, g, or t
acaaccaagacagggttctttaaacatggattccaagcagtgaatgaagacaaaggtttctaacccaacacaaaaggacagtggatttgactttctaaagactttttttgtggacaatttgacatttggagaagaaagacggcacactaacccagataatagttttaaagcctggaattttttgcagtttgatttggaaacggatgacctcttgaaatgttaanttttaataaaatttgtaacacttaaaaaaaaaa

SEQ ID NO: 670976 - DNA, 635 bp, Homo sapiens
gagccacaggtaaagccttccttttctctggtcttaccgcatcctttgtccaaacaaaggcagaagtcccctgtcccccatgcagttgtatgtacgcagagagcccagtcccagctcctaggcggtcagacaggcaccccgagtcaccactggcctgccagcaccagcagctccaggtccctgaaatccagcaggcataacctaagaggttacctagagttcagtcaagctcctcaaatagccactaagtgaaatgaggaaaagttatgtaaagtgaagtaaaatcctcaacaatgaaacacaaagctgttattctctttttatgaaactccagtaaattgtttcagaaaatgaaagtgccggaaaagaaatatttccattgggaactagagatgccctgtgttaaaatggtcacacagaaatctggacgaccaagctttaaagctttggctgtgttttaagctatagcctcggttcattagaatgggatttttttttttaaccaacaaacttctactttttctctctatgtgttgttctgcttaagcctctgaaaactaatttataaaattgaaaatgtgttcttgtagcaattccatactttctaataaacttgatatagacccttttgtaaa

SEQ ID NO: 670977 - DNA, 125 bp, Homo sapiens
caggatcctaagctccaacaagagtgaactctgaattaaaaatattattaattattaaaaatggcatttagataattcaaataaaaaaaaagaggaagcctcctttgttcttagtagggagctgc

SEQ ID NO: 670978 - DNA, 1005 bp, Homo sapiens
cgatgatgctgactgcctgtcatcaacatgatacgccgatcaccagcactttgaagttcacctctaagttccttgactacgagacagactgcgagacattaagggccacttaaccatagaggactgtgtgtataagacgacgtctacctaaccgcatagatcacgctggactgtcgagtctcacttctacccgcctcgccgtggaataacaagggcgtggagaaagcactcgcgcatacggtgtgagagactggcttctagcggcagttgtagcccaattgcgtagtaatggaaacaaatcgagcgtcggtggagcatgcgtgatagaaacgatgtggcttaaagcaccatggtacctctataggatggtgtacgggcccaatggttgcgacgtcacagtccattatatcacctcgaaccgccctactggattgttcccgcaccgaccgtcttgctcatgcatctcactacaaacgacatagagtagcttgaaagcgttattacactaataaattggcgctgcattgctctgaagatccgtacggtcaacacgacatctacatgccatcgcatatatgtccgaggcacgagcgtgtgggccaggacagcgcgactcgcttcatagggtaaacgaccacatgtacaaaggttagcgtcgatcgtccatgccttttgtccataaatcctatattcctcagtgaattaccctcaatgaatcccaatcagagaagaggggttcgagcaggattggagataatttcacgcgttaaatagagtcggtgcccccgggaggaatgaggggttgtacccgggataagacaaagtatgctatctgactcgtttcactttttgatcttatgctttatccgtgggcgagtcatggaataagtggacagccgggacacgccaacgaggatggacaagactaacgcgttccctagccgggggcctactcccaacactgggcgtagaacaacctaaaccccttgtccgttggccttattg

SEQ ID NO: 670979 - DNA, 126 bp, Homo sapiens
aacgtgaacttaagtattacttgtacctgcattttaagaagagtctgtatgagtgtgtagctatgatggccaaaagaaactttttctctctccctttgctaaattacaggactaaggagttctcct

SEQ ID NO: 670980 - DNA, 1070 bp, Homo sapiens
  misc_feature (292)..(292): n is a, c, g, or t
ggccgagcgcagatcgcttgcagcttgtctagactgtgtgggctgggaggtctggctagggctgtagctttgcgacatgaggatctaacatgccgtttggctcgcagatttactcacatctcgtcctttggaagcaggaaaaggaaacaacatataaaatgaaacgccctagtacaaagtcccaaattcttactttagtggatgtaaacatgtccagtgttgctacatagatcacacacgtgttttcacgccatgctcatgacagtggttcgtttgtgtaggttgtcaacangtgttgatgctcagcctacagcgaggaaaggccatgactcacagacagggtgtccagtttagacagaaagcacacactagatgattcaaacagcgttcgctgaattctctaattctcgtgttgtcatcacacgaaagccttatcatagaattccatacattctagattaagtttacccaagataactgtaactcacgagtttgggttctcgtcaaggtatacaggcagtaaatctccctatttcggtgtccagtttttcaattaacagtttcgactctatggggcgagaaacaaaccacgagagcaccacacaaacacaaaagacaactgttgtcgcggcgcacacagcgcacccctggaacacagccctcttcggaacacacccaaacggtgagaggagaccccgccgcagcgcccaacagcggcctacccagtgcaacacactgcggcacaaacgccgagcgatacgcacaacagaggagagacacacccacgatggaggcaaacacacaaacgaaaaaggcggggtcgggcgagaaaaaccacaaccgccagaggtaaagacaacgaaacaagccgcgccgcgctggagcggaacaaacggagcgcgcagggcgctccaggagaccagacgcaaccaaccaccagaagaagggcgagagtgcagtcgaaggggcgcccatcgatagcagcgacgatagtcatcaggcacgaccggggcgccagcccacgcaggcgggcaggcgcgcgcagaagttcagcagaggaattacacccg

SEQ ID NO: 670981 - DNA, 553 bp, Homo sapiens
  misc_feature (43)..(43): n is a, c, g, or t
  misc_feature (45)..(45): n is a, c, g, or t
  misc_feature (52)..(52): n is a, c, g, or t
tgagacggagtctcgctctgtcgcccatgctgaagtgcaaagncncgaactnagctcactgcaagctctcaatgcacggggaacgccaatatcctgctcaagcctggaaagaaattggaagtagcagtgtaagcctggagagcccaaaacatatagaggccaatgtgggaggatcaaacgaggaccatgggtgctaaaaccaaccagggcaacatgggcgcacctaatgcctaaaaaaaaagaaaaaagcacctgggcccccccccttctagttttttgagaggaaaaggaggaaaaaaccctggacccaaacacaagagaaaaggtgctgagcaaagccggcgttgtgcaacaaggccatttgttgggcctttgcatcctctaggtaaaaaaaaagacctctggaccagggtgagaaggtggaaaaaattaagatcgaggggggcccccacaaaggaattacaatattcaaggtacacggggtgaagcatataaaatacacaatcttaagtaacttctcctttaaagaaaggaatgaaaattccaaaaaaac

SEQ ID NO: 670982 - DNA, 410 bp, Homo sapiens
  misc_feature (335)..(336): n is a, c, g, or t
tattagggtatattgtaatatgcaaatatggtacagcactccaattaccctttaaagctgacatggttttctctttattttctatgagcatgcagagctctgagggtatttggaaaacttttggtatagtgggggttaactgttttttgactggaagctgagcaatcagtgataacagattttgctgtggttggttgatttggcagaaaagcatgaacagttttggtttaaatgattgaataacctgattagcattgttttggggtggttttttttggttgttgttaaagacacaacaaagcaattttaagggtaatcagatcactgcctttccnnatctgatgaatctttttttgagaaggcctcacctctctcaaaaccccttcattgaatactgagatgaacaagta

SEQ ID NO: 670983 - DNA, 1318 bp, Homo sapiens
  misc_feature (281)..(281): n is a, c, g, or t
  misc_feature (1116)..(1116): n is a, c, g, or t
  misc_feature (1123)..(1123): n is a, c, g, or t
tgcagtgagccatgatgtgacactgcattccagcctgggcaacagagtgagacaccatctcaaaaaaaaaaaaagaaagaaagaaaagaaacaccttagttcagaaacctgtggggttccaggacacttgtttgaggatttggtgattccagtgctctcagattattccaagggcattgttagatttgggattggctgacttcttgcttcagttccacacagcaagggttacccctgtggtttaggacagaccttagttgagtttacagcttggttcaganggccctttggttctgttgcacacacttgaaattacaccttagttcacattagaattaagtcacattacctttcaggtggtatctgctcagattttggtactgagacttaacttggtttagattacacttcagattagaattcaggactctttacattagccctgggcagattccacacagattgcattggcttagattagtccttaggcggttccctttcaggcaggtctccgtggttcacaggtattccttgccaactttcacccaggcacaccctttaggcagaccattgtcagaaggactctgggagatgctgcattgtcagacacccacagcttgggtgccctcaggcagagccataccctgagatacttgtggccccaaaccccaagtcactttcacacgctgaggtacccatagtcagttctagatcttgcttaccccgaatagatctaagtgatccatttcacccaaggtaaagcctgggctatacattagtgagacccaatttcttacagaaaactactaattaaattagccagatgtggtggctcaataacctgtagtccccagaaatctccggggaggctgaagcaggaataatcgcttgagcgcagggaggtgaagcttgcagaaagcgcgcatttttgaaactcagacctgggtgtacgatcttcagggtaggagcccgtgtcttccaacaaaattataaagactaagaacaaccaacaataaacaaacaacctgaggggggtcatcttctatcttgtggtgtggggaaaacaacgaggcataataaaagcgaccatggttaatctggtgttcctcgaccccnctttgtnagcacagggggaaacttcggggcccgcatatggaggcgattatacttacgggggactgtattgctgtacacctaacataaaaaaaagcgaagacaggatctgacgagacagagaatctatcatgacaagcagatagcgactaactaacaatgactctaccactactaactatgaacacgactgactgaagaacga

SEQ ID NO: 670984 - DNA, 177 bp, Homo sapiens
  misc_feature (134)..(135): n is a, c, g, or t
tgtcgtggctgacggtgcgcgagaacatcagctttggccttgagatgcagggccgcccggagaaagaacggcgcgcgctggtggatgaaaaactcgaactggtgggcctggcccagtggcgtaacaagaagccnnacgagctgtaaggcggcatgcagcagcgcgtcggggtaccga

SEQ ID NO: 670985 - DNA, 316 bp, Homo sapiens
aggctctctacaggcatttcatccagctcctcctctccaggacatttcatccagctcctcccctacagggacatttcatccagctcctcctcgacagacacatttcatccagctcctcctcgacagagacatttcatccagctcctcctctagggacacgtttcatccagctcctcctctacggacacatttcatccagctcctcctctagggacacattccatccagctcctcctcgacggggacatttcatccagctcctcctctacggggacattccacccagctcctcctctacggggagggtaccgagctc

SEQ ID NO: 670986 - DNA, 396 bp, Homo sapiens
atatacagcacgaggctgctagataaccctccctgcatcttgagacaggcagaactcttacccaaaagatgggactgagttcagatatcagatacattaatcactcatcattgcttacattgatgaaagtatcttttccctctgttaataattcaaaggaaaacaaattctatgttaatgctagtatatttctgtccaaacaggttgcctcagttcctcaggctacagtgaagactgcattactgaatgggtcggcggaccggggagtgcagggctctgtctcattcagtgaccgctccttctgcgtcgcgatcgatgtctctgtgtactgagattcctgtatcctttcctcccatacactccatacttgtagtctccatgctcatcatgccgtgg

SEQ ID NO: 670987 - DNA, 209 bp, Homo sapiens
  misc_feature (164)..(164): n is a, c, g, or t
aattggtatgactagtgaaatttggttatgtggatttgtgaatctgctgaagacctggagaaagcgtggaactcactggtttgaaagtctttggcaatgaaattaaactacgagaaaccaacaaggaaaagacagtaagaaagcagcgagatgcgatgaacacntttggtgctaaacaatctccggtgtaccgatgctcgaacttcgta

SEQ ID NO: 670988 - DNA, 149 bp, Homo sapiens
gactctagagtatcccccaattgataagcggatagggcggagacaaggcaaagatagtggaagaaaggaggcaggagatggagagggaagctctagtgctgcttttcttgctgttgaaaattgggggaagtccactccattttactaaa

SEQ ID NO: 670989 - DNA, 205 bp, Homo sapiens
  misc_feature (8)..(8): n is a, c, g, or t
  misc_feature (20)..(20): n is a, c, g, or t
  misc_feature (94)..(94): n is a, c, g, or t
  misc_feature (140)..(140): n is a, c, g, or t
acttctangaggatccccgntcacgactgctccaggcttcacccttggggcaacaattaaggcccccccttaaaccccaacctttggaaacaanttggaccaccaacaaacaaacttcccctggggcaacggcttctttnctccaacccccttcaaacttttcttggccaaccttcttccccttgcggcggcaaataactggcca

SEQ ID NO: 670990 - DNA, 221 bp, Homo sapiens
aacgacgatggcgcgtcccagcttgtcccttgagaggtgacacagaccccccactgatccacttggactccatccctatcactgacccagatcccagcagctgttccagccggcacaggcgtgccagcctgggtgagcaatggggatgcagcggacggagctttctccggggcccggcactccagctgaaagcggaagagttcccgtcgcattgaccggtc

SEQ ID NO: 670991 - DNA, 372 bp, Homo sapiens
ataccgtatccttagatcatatctttatatgtatagcagactctattcatgtgctcagagatggcggggatactgtatactgttaatctatctgtcagagacttactataacacgaagtcatctgatcggaatcctgctacctgctaaccatatgattgtatattgtataatgtcttacatcagataatgctaataatgtttgctgatttcatatgttaaagagctataaattccaacaaccaactggtgtgtaaaactaatttaaaatttcctttactgaaaggtatattcccattattgtggggaaaagaagccaaatatattactatgtgtaagagtaattaaaatattaagaaatgagatgtaggaag

SEQ ID NO: 670992 - DNA, 863 bp, Homo sapiens
gattttttacaaacaaaatggcgaaagcactgatgtcatttttagcagtcacttaaggcctatagaacttttttcaagtcggaaggtcctgttcttactatctccaaaaatgggcatcgaacaatcaatctaggagcgtggcagtgggtaaacctggtggacaggcaccaaagctattttctcatctgtcctgtggatgagtggaactgtggacacaacgtgatgtggcacattcatgggtgcacacagttgtacagacaaatcaataacaccacaccagttctggaaagacacacatcactgtgtgctttgtttgatgagctttgtcacattctaatccctctccccatcctgtttccactttgtggaaatgtgtatcctgtggtgtcagcaattctgattctgaaataggatcaggttttactaaacagcttctcttactattatggtgtcgactcgtgcttatgaataaagggcaggcacagtttgcagaactgtcttaaggacatttatttttttcccttttcacgtaatttacacttaatatctattcagagtcatatttaaaatattattagtgaatacagtaacttacgacaacacggtccttggacttacacttcttccacggtcaatgctcagtgtggtcatacgggcctaaatcgtacggctatcagatattactttacgttacatagctgctccacaacggccttagctggccgccacttgattccccggataatcttctagtgaatcggttacactccctcccaacggcgcggcttctactttgcgcacacccctacctagatggactcacgtcaggccccctgggatccagcacacagtagcatcacaac

SEQ ID NO: 670993 - DNA, 156 bp, Homo sapiens
  misc_feature (5)..(5): n is a, c, g, or t
  misc_feature (71)..(71): n is a, c, g, or t
taccngcataaacgcagctacgcaaaaggtggttagggcgatgagtgtggggaggaatggggtgggttttntacggtagaactgcggttactcatcctatgtgggtaattgaggagtatgctaaccaccattttgcgtgtgctgcgtttatgcggt

SEQ ID NO: 670994 - DNA, 1760 bp, Homo sapiens
  misc_feature (1537)..(1537): n is a, c, g, or t
atgtaatcctgtgcactctggtgagtgccgaggcagtgtgtgatcacaatgtgtcatgtgagttcaatgactagcctgaccaacgatgtgtgacaacccatgtcatcatactcaacacacatcacaacacacattcagtggcttgtgtgtgtgcgttggcatcaaatgccctgtcaatcccgagacacctctgtgggaaggtacaatggacatgtgcagtgcatccagccataggagagttatgcgagcaagattcggacagcagacaccgcatgcttttacatacactcaacacacatcaccgacacacatacagcacatgggctgttcgtgtttgggcttgacaaaccaccatggtcatgtgcccacagcgtaaactacagggagcaggtcgcatgaagatgccatgtgcagcgacactttccaccttcttggacgatcacaccttggagcatgtggccaaagcaatgtggttatagccacggagtcgcatcgatcccgacagccactccagacaaacaacacagtagacaacgactacacaacgcccatggggacaccgaaacaaccaatcggagaccaaaggtcaccaattccacaccgaaacaacacacagaaacacaagacaaacacaaaaaagggccagaaagtacgcgacaacaaacaacaagacaagcagcataggacaggagcagcggcagacagagcagcgtgggaacacaagcaccgaagaagaaacggcaatgagatcaggacgaaagagcacgcacacgacaacgaaggagcagcagcacggagccggaagagcgcagagcgagagcaccacaaaccgcaaagagcacagagaaggacagcacaacgagtcacagacacaaaagaagcggtacggacacaaagacagagagagcagaggcgagaacgcaacagcacacagccaagcagaacaaaagccgacggagagacagacacacaccagcacaccaccgaccagacagacgtagcagagaaagacccacacacacccacacacagaaaagacacacacaacagaacaaccgcaccgcaggaagtccgcacaacactacgcaaagcacgaagtacctcgcagaacacgagacacgtcacacgaccgaagcacgtaaggccacacaagcgaaggaggagcgcacaacaaaccaccagggcagaacacacgagcagacaaaaagacaaacaaacaaccagaacagaagacaaagcctaataaaaacaacaacagaagaacgaggaacggagaggcggagagtacgcacggagaagcgagagaggaagaagcaaagaagcaaaagaaggacgcgcggcaaagggacgaaaaagacacgcggaggacgcgacggagagaagcagcgcgggagagcggacaaacgagcgagacagaaagcgagggagtaaagatacggaacgagaaaggagcgcagagcggataacgcgaagagagacgaagcagcagacagaccacggccagaccgacaccgccagcaggcagaccgcgacgagnaatgaacgagagaagaagcaaccgcagcggcggcagcagcatgaagcaagagcaccgcagccacgcggaggcgcaaagcacgcgcggagacgggcgcgcacaggacggcgagagcggacgagacgcacacgaggcgcacaccgatggagacacgccacgaccgacacgcgcagcgacggcacgagcgaggcgagcagaagaaggcgaagaccgaagaacagaa

SEQ ID NO: 670995 - DNA, 922 bp, Homo sapiens
gcttttttttctttttttctgttgtgagcagcggggcgtcgcgagagcagggacgcaggatgggttcatcttccatttgtgctctgggcctcctttttccagacttgttctagccgctcttcttagtattttctcgcaaatctctgatgccagaggccgacaaacctcgaccagttccaaacgccgggttttctgttttgcgccacctggtcttctggggacgattccacagctttccagatacattcgatgtttccccttctgaccgatcccacgccatgtggacacctgccaatcttagttccagaagtggcttgtattgacctgtttccggggtcacctgaggtctcccccgtgttcctgggtcctcttcagaggccccgaacagttttaaccttctgagtcccccgcccgggtcccttacaccctcggcatacacgaggctgttggcacaagtgtagaggctgcctctgtgtgtggtcttaagtaaactggaaatgagacaacttgacgtggctgctcctccacagagggtctgcacacggccaccttcacaactgccgttgagctttcaccacgttctaagaactttacgggccgggaacctctgtgtccacgcactgcaccacgtatgagtgaggctcgccttctcccgccccaggcacttgggagtcccactgttatgagaacggcaccttcaccttcacgagaggtatactttttaaactgctcacgtttttgagctagttttaaatagtttgctgaaaaactcctgagtaacacctgctacatatcatgttttaattgcttgtcaccacattaaccctttaattttatttagtaaagggtatccacagtaggacttttttgaattgtaaataggtggttttattaaataaaagtccatgtaaaattggttaaa

SEQ ID NO: 670996 - DNA, 349 bp, Homo sapiens
ctccagcctaagcaacagatcaagactccatctcacaaaaaaaaaggaaaggaaggccttgccataaaaaaggtttaaatttttaaatttaccatttccggagatcaacccatttcacactggataatagctacatttcccacgccactgtatcctcaatattttatctttggccttcagaagatttttggttttttttggttttcccaaggggaacaatctttctgccaggcggcccacatggccctgaatttaatagcagggccacctttttatggcctttttatccagtttcaccgcaccagagtaatggaattggaaatttccaagcttatatgggttaccattt

SEQ ID NO: 670997 - DNA, 131 bp, Homo sapiens
tattaagatctgagcgcggtggcagtacatctcttgcaacacatgtatctgatgttccattggacagcttggacaaacagtggtgtgtgatgtctctgtggggctgatattcgaaaattgaagacaaaggc

SEQ ID NO: 670998 - DNA, 433 bp, Homo sapiens
  misc_feature (371)..(371): n is a, c, g, or t
  misc_feature (376)..(376): n is a, c, g, or t
ccaacaccacctatatctccttttttacacccacaaccacaaccccggggaaaattggtgaaattttaaaaaacccccccacccccaccccttaataacaactattataatttcatactacactcattcataaataaactcatccttcataaaaaatcttacaattttatcaactataccattaacctctttacatctaaaaatcccattctaatcctatcacattctccataccttaaacccttatcccattcaaacactattcattttttataataatcatccttaaataacttaaaataactatcaattccattcaatattcatcacacaatattacaaacaaatactatccccacaccaattagagnaatangttatttttatgattaaataacttactctccaccataaacactttcctctacctcct

SEQ ID NO: 670999 - DNA, 1020 bp, Homo sapiens
  misc_feature (1020)..(1020): n is a, c, g, or t
gagctgatacttaaagcagtgagctctgaagaaagcatcaataccatctaaaccaattatctttcaagatttttgggtgggtattagaaaacccagaaggaacattgtgatgctgatgtgcctaatagggtgcggacaggcgttggacaacgaaagtctctggctggccctaagtgtggcgaatgctgctcagtggaaacttgctgggctcccgagtcccaggtcaattgctctaggcctcagacttcccaatttatgcttgaggatataccaggctcccttgatgccgaccgatggccccaagctaagattgcaggaactttgagagagatagacgacagagacgtttcctcctactgtttggcgcacaggtgaggcctgggaagtttcgtgaacgctcgaacagtggattcatagccgcttcgggacctttccacaaaacgttgcttgggcaatttaaacaagggcgcagttaagaagccattgtgatggtccggggcccattggttcagctttttaaccccgtgatccctccgtaataaacagtttggcggttgaccctctcttaccaattttgttgttccccccttttccctttggaagctatccaagggtgtcattacccaatccttgtgtgcgacacactgtcgcgaggtggggagtccatcaaagaaatgggaaccttcatagaggggcgtccagagaatcccacatacacacaggggtcaaaaagcgctacaggcaggcagaaagggcaggagacacaaaattaccctgtttggctcccttatcacccgttaaaaaattattaataaatccccgacagatgtggtgggttaaaacaacgtctgggcacacagggtttcttccaccacttataaacaacgcttttcttataagaacccccgagggggaaattattctgatcgcgtcctaacggagcaacacaagctggggtgtggaaacaagccgcggccacaccaagaacggatgtggtgcgtatcattgattgcaaccacn

SEQ ID NO: 671000 - DNA, 1308 bp, Homo sapiens
  misc_feature (518)..(518): n is a, c, g, or t
ggaactagtctcgagttttttattttattttttaattttcctcattaaactttttataagggggtctcaaaattctggtgacaaatttggggtcaagtggttcccattaaaaagtacggatttaaaaaactaaataacttaaacactggcgccacacggcaaaaaaagaaacaccaagggggtccacaaaactattctcctatatcctatctggagggtactaacggagagctataggtgatcatttacccagtctttaactactaaacacttacagtgggccatatgtgagaaacaaacatgtctctgagaaaccggtttcttccacccactggtattaacaatgtggggtgtggcgcaggtaatacaggggatcacattatccattaaaccactatctgagaagctatacctggggccaaaactagaggtagactctatgccacgctctccaaggcaacgccatcacatatagggtgaccccacgcggtgtatagaggatgagaacacccacaacncgggaaaaacatgggagcctggtactcaaatatatcaccaaggaaaaccagcgcaaacagcgcagaaccacacacggggtggcgcataaagccagcgaagaacctctaccacaacaacaaccactaggggcgtctagcgcccgaggaaacacccctatatcataaccaacgctacagtggggtgcgacgaacatttaccgcgcgaggaaagcttatacacagaacatctactgacgggggcccaattatctaccacaggtttcttaattccaagcacgaagaaacaggggggacggaaatcacacaaatcctttctagacctctataacaagtgtaccgagagaacacatcttgtgcacctattgcacacagtgggcgaaaccccccggtgtgtgggcaaaacaacccacaaacacgaggggggacaaataacagcgcgggaccgacactaaattatgcggagccccgggagaaaagtggcaacaccgaggagcaatcacacttccccacgtagacacgcacagagttgaaaccgcgccaggccggagcgaatacaaccaaaaggggaggggaggacaaccaacacaatggcgaagatgacctaccccacgagaagaaacacggcagatggaccccacacgaacacagaaccacaaactccagtggcaacgcagagaacaaccaacatactcaagggacacaactacgcaaacgcccgcaaaaagagtgtagggtccccccaagaggaaaagacgcctccacactccaccaaaacgcgccacacacgacg

SEQ ID NO: 671001 - DNA, 373 bp, Homo sapiens
tgacctgaccttgcgcctatgggacctaatttatcttttatgtatctcggctctgcttatgtctaattcccacttgctctgaagcatatctctaggaatcgccccttctgcattcacctgacagttactgagcacgacatttttcacagatcagtggaatcaatcatcccaaatcttggtcttaagcagtgtcgtgggagtcttccttagaattgtcttgcgaatgtgcaaactgatactctgatcacacactgaattctgacactggctgtaaattatctgtgcagtaatacagagccttaagacattgccccaggcaatgcccataatatcctaaaggtcccttgacagttaagtttcaaggatcaaggtt

SEQ ID NO: 671002 - DNA, 261 bp, Homo sapiens
tctcagtcatcgtttctcatctgaggtgcataaaaaaaatcgctttcagatcaagttgacatgcaatacactgcagtattctccctgtcgcttttaaaatgataatctgtttcagccatgcaaagcagggtataaaataatatttcagtgtaaccactcagcggaagaaataaaccattccagttgcaatacctgatgtaccgttctctgatttcaaacccttcctttttctctgccccgactttgatgtttattcttgtg

SEQ ID NO: 671003 - DNA, 554 bp, Homo sapiens
gcacttcgtggttattcctttgctattgtgggacagctgtatgtattgtcttgctcgtccttctccagcattctatctagcaaacctctcagctgttggagcacctagtgctgtgctagctgcaacctcagtataggcctttgcaaggttcttctcctgggcttggatgctctcttgcaggggagccactcgggatctcttgggggctgacactgccagggtgggctccaaagagcagcggtaggtgtctgcctggagctcatagtcctggagcgcttgctgcagggcctgggagaggtgggatgctgtggccctgtcccgctctcggctctggatcttcctgcgtcagcctctgccagggaagaacccagagtcaggaggccaggaaatgccaatcaccctgactctcctctagccagtgcctccagggccacagtcaggcagagctgcctcccaggaaccagaaagggccgggagggagacctgggccaaactccctcctttccctgacatcattctctctgttttcctccttctctcctgattccaccttg

SEQ ID NO: 671004 - DNA, 881 bp, Homo sapiens
  misc_feature (611)..(611): n is a, c, g, or t
tagatttgcacctaatttaccagatgtataaagaagagctgatactaatcctatcgaaacttttcaaaaataattgaggatgagggactcctttctaactccttcaatgaagccagcatcattcctataccaaaatgtggcagagacacatgaaacagaaaacatcaggccaatatccttgaggaaaatagatgcaaaaatcttcaagaaaatattagccaaccaaatccagtagaatatcaagaagctaatccaccacaataaagtaggctttatccttggggtgcaaggttggttcaacatacgcaaatcaataaatgtgattcatcacataaacagaactaaaaacagaaaccatgtgatcatctcaattgatgcagaaagcaaaagctggcagctttccccttgagaatgagaacaagaaaaggatgtgcactctcactactcctagtcaacacggtacctcaagtcccagccagagcaattaggcaagagaaagaaataaaaagcatccaaataggaaaagacgggaagtcacactatccccgtttgcagacaaacatgattctttacataagaaaatccccatagtctgccccaaatctccttgnatctaataaaacaactttcaggcaagatttcagggtatacaatccatgtttaacttgagtagcctttctatatagagtgtccacatgggagccaattcagactgatgcttatatagccccacgaaagtaataccggatagctaaccgggggaaattcccccagggattcacacacgggacccatgcccagatgagagccctcttataggcagcgagtctacacagttcccaaagcgcgatctggcgaaatgcagactaaaaaccgcacaa

SEQ ID NO: 671005 - DNA, 824 bp, Homo sapiens
accccccggctacccaccttttttttagatggcgcccccccctagttttaacccccccacaattgtttctgtacaataattacgtttcccccccgcccgtcttctgtctttgtctaggaagacacattggtgtctatgaacaacaccacacaccgcccacacaactttctatttttccgagcaggtgaataaacaactctttcgtgtacacaacactaactcactttatcttccctcgagggaccacacactctctctctcccagcgcgagtctcttctttataaaaaaatgtgaatttcttggtgcaaaatatttacctcccaccccccccgcttcgcacctcttatctttggtacacatatcgtattccacaccaccacacctctattcaagaagaatgtaaagctctccatccgcctcttttcctaacaactcgtattcaaacacagccaaccctctctctctatgtagggtgcgtccctcttcaatagcacagggcactacaccgtttcttgatatatataccacctcccgtccccacacgcgcggcggtccctcccatataaacaagttattccccccctttatcaagaacaccccaacctgttgtacttgccaccacttacaaagaatattcttttaccacttcgcccctacagacacgaattttcttgttgcacccctgtgtatttatggacacatttcgcaatgtagattctttgcagatttcttttttttttatccccctcccccaattcttccaccaagaccctcttagaggacacccccaaaaacaaatttctcttcccccgaaaacataaca

SEQ ID NO: 671006 - DNA, 371 bp, Homo sapiens
catggttccggacatgatggacttgactgttgaagatagaacagatcattggtactggattggcactgtgtacgctgttgtaattctgtcaccatgtactacagaaatagaacattctcttgaaaagaatggaggaaagaacaagaacagctattgatatctcctcctctgcagagttagaatgaacgtaataacacacttttaactcatcatctttcttaacaaaaagtcacttcagatttagaagagaataccttttttttctttgtatttttcgagacagggtctcactctatggtccaggctggggtgtagcgatgtgagcttggttcactgctgcctttacctcccaggctcaaatgatcgttcca

SEQ ID NO: 671007 - DNA, 606 bp, Homo sapiens
  misc_feature (520)..(520): n is a, c, g, or t
cacacctttttttattcattcacatatattacaaatatacccaaataccaccacaacataaaccactaatccaaaacaaataaacccaaatacctctaaataccacaacaacatactcccaacaaaacactaccaccactaaaaaaaactatacattccaataaaataaaccaacacccacaacttaaacaaacctcacaaacttatcttaaaacaaaaacaccaaacatactaacccaccccacttaaccaccataaccaaacttcccaaacaaccacaaaaggccaccaaccaccaatccaccctttaatactcaaaaaccccaaccaaaaacgtcctataaacacaaccacacaactcgccaactcacctaaaacaaaacaccaaaaatcccaccccaaaaccctcccaacgctcaaacatacaacatctcccatcttacccaaaaacctgccaaaaccccacaacaaaccccatttttaacaaaaacccctaaatacactcatacacctccactcnaaaaaccacaaatacaaaaaaccccattccatctccacctaacaaaccaccataaccaactaacaataattcgcaacatacccccg

SEQ ID NO: 671008 - DNA, 562 bp, Homo sapiens
aggtactagggtgggaagaacaggctagtatgtcacagtgcttagttacaactgttaatgtgtgacctgctgttggtgtacatgtgggtacagggtgtataataaatccaacaagatagagtataatatcaatactgctaaatctgcatgtcctctgtgtgactgatagagcgttgctatttcatttttttaagacaaaatgaaagcaacatatagagttccaatgtattggtgtagataatctagttgggaatacttataagtctcaccttcccctttaaactaatattcataattggttcatatgtttaaaagactttaatttacaaattaaattgcaaatgggagcattagatttagttttagacttaggtgggtagcaatgccagtcaacttaaattacgtaacttcttgcaaccacgaaacctgtcatacgctgtacagtaacaagtgttggcattatcagttgaactgtaaataccaaatgcttcttccaattagtctctatcatgattaagtttctaaaatttatctgaacaccattcagaaacttgttttgggc

SEQ ID NO: 671009 - DNA, 225 bp, Homo sapiens
taagaagccattgatggacctcattcatggaaagttctgtaagtgttgccaaggaacatcagtatatttttcctgtagctggcacctttgagggagtctggtctcaaggccatctgttgcaagcaagggtgagacagccactatctctactcagacttagactctactaggcgagcgtgacaggaggctggacattggtacagaaagagtctgcatgatctattc

SEQ ID NO: 671010 - DNA, 826 bp, Homo sapiens
  misc_feature (157)..(157): n is a, c, g, or t
  misc_feature (168)..(168): n is a, c, g, or t
  misc_feature (422)..(422): n is a, c, g, or t
  misc_feature (453)..(453): n is a, c, g, or t
  misc_feature (474)..(474): n is a, c, g, or t
  misc_feature (479)..(480): n is a, c, g, or t
  misc_feature (490)..(491): n is a, c, g, or t
  misc_feature (509)..(510): n is a, c, g, or t
  misc_feature (544)..(545): n is a, c, g, or t
  misc_feature (566)..(567): n is a, c, g, or t
  misc_feature (674)..(674): n is a, c, g, or t
gagacgattctgctggtatggcgcgcccatttgtctcttggatagcctggtgcatacgtctgtatctcattgtgatacttggtcctagtgattcatcttgcttcgataatgagcgcaccagatatcatagaagggccctgtgtgaccatagcgggtnagttcgtggangcatccatccaaggcataggagctccatggacgcgctccattaacatagtcatcatgatcataggttattagtcctactccgaaggtcagaattagattaactgtctggcacgtgaagggaaaaaaaccttctgaccggtgacagagaccatgagatggattggccaaacccccaaagatggaatttcaaatttcacctggtctcgggccttttccaaaattggctggcgataacaggctatgagccaaccggnacccaaggcccaaagttatttcaacaagtgnctatgctcaagaaagtgtgtngtatnncatttctatnnatagctgtaaactttatnncaattatttatacttattggttttaatacttctnnaattccattttttggtcgtanngaaggtcacatctatgacacatttcgggttttagaaaaatggtgttacagtctttggttttgggggcctatcagcgtggtttatacaagaagaatggttgaatgagnctattgacgaaggctgtgtatcccgatgttgttgaggagtgtcctctataccttcattagaaattattgtttttgactgccttttagtcctctgttcccttactaatatcatctgggttattattattacaggaaagtggggtattgaaact

SEQ ID NO: 671011 - DNA, 532 bp, Homo sapiens
  misc_feature (7)..(7): n is a, c, g, or t
  misc_feature (29)..(29): n is a, c, g, or t
  misc_feature (94)..(94): n is a, c, g, or t
  misc_feature (116)..(116): n is a, c, g, or t
  misc_feature (126)..(126): n is a, c, g, or t
  misc_feature (150)..(150): n is a, c, g, or t
  misc_feature (160)..(160): n is a, c, g, or t
  misc_feature (175)..(175): n is a, c, g, or t
  misc_feature (185)..(186): n is a, c, g, or t
  misc_feature (192)..(192): n is a, c, g, or t
  misc_feature (239)..(239): n is a, c, g, or t
  misc_feature (283)..(283): n is a, c, g, or t
  misc_feature (296)..(296): n is a, c, g, or t
  misc_feature (298)..(298): n is a, c, g, or t
  misc_feature (315)..(315): n is a, c, g, or t
  misc_feature (331)..(331): n is a, c, g, or t
  misc_feature (400)..(400): n is a, c, g, or t
  misc_feature (405)..(406): n is a, c, g, or t
  misc_feature (413)..(413): n is a, c, g, or t
  misc_feature (415)..(415): n is a, c, g, or t
  misc_feature (434)..(434): n is a, c, g, or t
accgccngagaatcgccgacataaccctntcccgcggttggttatgtacagatgccgcattcggggctctcaactggttgatataaaaatgtgncctttgttaagcatttatttcnaacactaagnagcgactctgttaacgtcttttgnttttttggtnagtcttttacatttnaatagttttnnagacantctaggttaagcagagcaaagtgccttgtttgcctttaattgggggntgggaagggaaaagggtacttgccacatagtttcctttttaacngcactttctttananaacgtttgcattttgtnacttgctaccctgagnactttcaggaagactgacttaaatattcggggtgagtaagtagttgggtataagatctgaacttttcanctgcnnagcaagnanaatatttgacattgtgacntgactgtggaagatgatggttgcatgtttctagtttgtatatgtttccatctttgtgataagatgatttaataaatctctttaaatacttaaaaaaaa

SEQ ID NO: 671012 - DNA, 129 bp, Homo sapiens
  misc_feature (102)..(102): n is a, c, g, or t
actctagaggattcctccctctccgacatctttaggaggtgatagtcatcgctgtacgaggtgtcatacaccaggttgttggctgaaacatactcctgaganacgcacgggtccagccagattcgatga

SEQ ID NO: 671013 - DNA, 251 bp, Homo sapiens
  misc_feature (45)..(45): n is a, c, g, or t
  misc_feature (152)..(152): n is a, c, g, or t
aggcccgcctgttacgatggtgtccatgagtttcaagcggaaccnagtgaccggttctacagcacccggtctgcggctgttgccatgtccgcaccgggacgttcatcctggggacctggtacatggtagtaaacctattgatggcaattttnctgactgtggaagatgatggttgcatgtttctagtttgtatatgtttccatctttgtgataagatgatttaataaatctctttaaatacttaaaaaaaa

SEQ ID NO: 671014 - DNA, 134 bp, Homo sapiens
gcggccgcctactactactactactgctcgaattcaagcttctaacgatgtacggggacatgtttctagtttgtatatgtttccatctttgtgataagatgatttaataaatctctttaaatacttaaaaaaaa

SEQ ID NO: 671015 - DNA, 213 bp, Homo sapiens
gtatgtatacacatatgcacatgtgtgcgtatgtgtgtatacacatacatatgtgtgtacacatatacatatgtatgtgtacacatacatatatgtgtacacatatacatatgtatgtgtacacatggatgtatgtgtacgcataaacatgtgtatgcacataaacatatgtatgtatacacatgcatatatgtgtacacatatacttatgtg

SEQ ID NO: 671016 - DNA, 342 bp, Homo sapiens
tcttaagactgtgttctagatggacatggtggctcatacctgtaatcctagcactttgggaggccgaagtgggtggatcatttgaggtcgggagttcaagaccagcctgcccaactcagtgagacgccgcctctactaaaaatacaaaaattagccgggcatggtggtgggcacctgtggtcccagctgctcgggaggctgaggcagaagagtggcttgaacctgggaggcagaggttgcagtgagctgagatcataccactgcactccagcctgggtgaccgagcaagactctgtcacaaataataataataataataaaaagactgtgttctgcatcacc

SEQ ID NO: 671017 - DNA, 1276 bp, Homo sapiens
  misc_feature (707)..(707): n is a, c, g, or t
atcttattacctatccaacagtttgttacctgtctcagagacttttactcgagccttattaccactccattcactcatgctctccataactgctcaatcttaccgaagggtgacaacggctcactccaagaggtatcagccgccgttcataaataccgttaaagaatttcccagcgtgcgataagaacttacacccgctcagtaactacgctagtcgacgagacgatagtacatactactaggcgtgcaccatgcacctacaagggtcctcacataaggaacatacaagacgcgagacaccaggataactgtgaacgacacaatgccatggattacaaacttggtaccatgcgagtactcttcatttgaacgcgcttgcttaacaagggcactacaagtgagtgttacttcgacagtgtcctcaccgtgtctacaccatcttccctggatgggttcatgcttaagccttctatatactttgaaaaagcttatgccgagcaggagacctatgctgaaagccgtcacctatctccgctcacaattgaatcgagtcttgcaaaccctgattctctatccacatgaatctgtcctatgcaatcctgggcctaacacttggagatcatgtgtcaaccatttttaaccaatcccatataccaattctaacttgttgggccttatcgcaacgtcccgacacagtcccatagacntacgcctaggcctaatctgcgttcgcaaatggagttgttgagtataggggtacccactacctatctcttctgggtactggtgctttccccattgtctaatttggcatagtaagtggcattctcttatgagagagatacaattccaagattagacaaagaaggggaaatttacggcaccacgttgcaacaacgccgcacgggaagtggggttgtggccaggcggttaaccaattggataacccccccgcgtaaagcaaaagggggccataatcgataaagtggtagtcagacccgcactattggacaagattggggaaaatgacccagatgcccataccatgaaagggtattggaaacacacaacaaaagatccaatatttccgcattaggacatatacagttacattaaatatccacaagcgcccgttttggttatgttaggaataccctatacctgaacgacgttttggacaatacagcgccacttgaaacctttgggtaggtatacagccagattaagacgaaggaattagcatcacacaacattagaagcaggagtataggagcac

SEQ ID NO: 671018 - DNA, 151 bp, Homo sapiens
tgctggcagtgcggacgtgtctgccaggtcactgtggatgatgctccatgccatgtgagacacacaatggtcccagagatgacatccggaggccaagagctctcttcctcccgtgctaggaactgagagtgatgcgactgtgggtggcatt

SEQ ID NO: 671019 - DNA, 304 bp, Homo sapiens
  misc_feature (33)..(33): n is a, c, g, or t
gttttgtgcttgttgagtccttgaggatccccntgatggaacctcactacttaggattgctgaggcatcgagaatggcatgatacccgggaggtggtgcttgcagtgatgccgagatctgtgcctgcacactccactctgggtgacagagcaagactctttctcaaaaaaaaaaaagcgggccaggcttgctcactcatgccgtgttaatcccagcaacttggggaaggcgtgaggacagaattcaattaacttgtgagccccgtggagtttgtgagaccacgcctgtgggcaacatgtggcaa

SEQ ID NO: 671020 - DNA, 177 bp, Homo sapiens
ccttgtctcacgcagttcctcagcagtaagtacagatcatttctggcgtagcaagctgagacagatcttgacctatcgtgctcatttcatccctgcctataatatattaatcgtccagtgtttagagtgaaggggaggagaggagtgtgctcaggttagcccgcaagcttgctggtt

SEQ ID NO: 671021 - DNA, 164 bp, Homo sapiens
ctagaagaaattttatgaataagccatcagaaagccagtgctaacaggccagcggttcaaaaactcggaaaatgggatgtaaaaagagaaatttcggaccccacaagtctttcagggttacaacttgtcccaggggcttaattgagggctgggtgtatgacctt

SEQ ID NO: 671022 - DNA, 816 bp, Homo sapiens
gtcccagtgccgcggggcggcgcggggactgtgctgtggctgcctggcgccgatcagccagtagacatgatgagcatcaaagcctttactgcttgtctctgctgtgtgagcggtggagctgctgatgttgtgctgacaaggatgcgctgtcaacatagagtgctgtggagtgctgctggcagtggacctctacgtgggcaccaactgactgcttcgtctaccacttcctgttggatgtgagaggccatgtgcctgctgggccagaccacgttcactgccgaccaaagcagctgtcgtgagacacttgggcttcaagaagcccgtgaagcgagctgcgtgctgtcctcagcactcaacagtgctgcttggtgcttgtgtgacaactccatacagcctggtcaacatgctagaacctcgagccagtgccttcgggggcccgcatcaagggtggcatgccacgtttgcactgaactgagaaccctgtgagttggggaccccttctgtgtagaacgtttgcatcatcttctgtcaaacgcagaaccatccagatgtttctgtttgtacgaggaaccggttgcagatcgtcaaggaggtgtcgattgccgagcagtccctcgctgtggcttgttgacggccacttcctgtgtctgggtctgacacgtcagtccatcatccgcattacatgccatgtcgtctccatgactgttccctactgcagtgaggaaggcggcgatcgtcggaggtggggcggcgtctgtgcggccgggggttgctttttccgtcgggttccgggccgtgggtcggttgtgggggtgc

SEQ ID NO: 671023 - DNA, 182 bp, Homo sapiens
cagagatgatgccactgcactccagcctgggctgacagagcaagactccatctcaaaaaaaaaaaaaaaagggtggttagaaattcagggcaggcgctttaaaaattcccggggcccagggtagatttccgtgaaactctggtgggcccccggggaatatgtggccttctcagggggccttc

SEQ ID NO: 671024 - DNA, 988 bp, Homo sapiens
ggtcgacgatctgccggcgctggtgctaatactctttctagtgcaggcgggatgagagcgggacgtgtgcgccggcgagactgggagagcgaagggggcaggccacgtggtatgacggctgcaggatgcctttgcagccacgcgcgcgccttccctgtcttgtgtgcttcgcgaggtagagcgggcgcgcggacagttggcggggattacttttgctgctagtttcggttcgcggcagcggcgcgctgtagtctcggctgaagacagcggctcgaatcacacataagaactaatgttcggagaggaagcaagtctcggctggcggacagggcgcgcactggccatgctggccaaaacggacggagcagggacaaagagacgagactcaggacgcgcgcagaccaagagagcggaaccccagtgggatgagactgagcgcaccaccacggggagacaagcgccacagagacgtgccgagaacaaacgacgggagaagccactatgagaaaccaggaagaggcgggacaacccccgacggttatcatggggaaggggccacacccgtaaacagggaggagcaaaacacggacccatggcagagtcagggcacgtgtgacgacgcgcaaagagaaactatgacacacgcccaagggtaacatgacacccggacggagaagggaacttgaaacaggggacacaagttatccacaaacatgtacccattcccccccgaaggtgaaaccaacctcagcctaggcacacggccacagaggatagtcgaggacgaccacatgccgcgagccacaaccgcacaacaactggggcgcaacaaagttcgcatcacacacacgggaagaagcggacccctttaaagacatggggagacaacgtagcctacacccacacacgaacccccgtaactcgtgccgacatatgagccacttacaccatgtacacacccaaaacactatcaggcgcagaaaacagt

SEQ ID NO: 671025 - DNA, 351 bp, Homo sapiens
cgtcgggctgagcgcactctggactacctgggccttgaaggatttggaataggatcggcgttgtggcttgcatagaaagacccgcttaaaaggctagaaatggtgtccacccaaatttaagtgcacaccatgtcctggcctcgcggggctgggtagatgacttggccggacggatacggaagctcctcagaaagtgagttttttggtttttggccggaggggatatgcattcgtattcttgtcaagaaggcagcggcaacaaaaaactttatttgagccgctttctggagattaagataaatatcttcaaagggaaggtttgaaactaggactccatgagtactattttat

SEQ ID NO: 671026 - DNA, 940 bp, Homo sapiens
ctcgatgcttaaagaaatacaatgtggtgaagaactgggttgaggtggagatagccccagacatccgggggagaattcccttatgctcacttctctgagcttcaaggttctgaagcatccagataacaagttccgggtccggctcagagccctgtagggccaaccgtcgttggcccagtattcctctcaagaccctcattatgtcttgtccctcacgaggtccatcgagccaatgcttgcaggcgaacgagggaacgatgtgccatggcgccgtagatgggtgaaaggtgactctcacaacgtaggcgtgcctgaccgttctctccattgcacgcgctattggtgaatgaatcaggacatccacgttcatggtacttatttgtacacatcgagatgcatttcactacctctccgatgtagcgctcacccttgggacaagatctatccgctaccactccaagcacatgggttagtgcaagaatgtctaacatttctgggtcccaaactggcaacggagcaaagggttaatatgagcgtctgtgatcgtcttgccgactctatctcaggacacaaagagcccgtgaggatcgcatacaatgcacaaagtacgagagatcccgaaggattaaactcccagtcaccggacattaaaggcgaggggcagtcattctgtagtggtgctagtgtaagggatccattttccatccaccactggtgatgcttctttggccgtgcttgtgctacactcccggctttgcgtgcgtgtactggggctcgtgtaaacctcccccagtgttcttcaccagtaactgaggggcacgaatcctaatgatgaagaccccttttattaaagcaaataccatccctcgccttgaaaggggtaagcttggctctacagtcacagggaacctcctacgaccattaaaaccaccagcacgaa

SEQ ID NO: 671027 - DNA, 582 bp, Homo sapiens
tcacacctgagcctagttgttggtcacatgaggcctcgctgttcagcctatctctgcttttgagaatgcttgtcctcactagacttaatcagttgctagtgtttatttaaagtgagagaagtataactcttccttttacttgaacacttaaaagccattgtagggttaaccgacctaattccaatattgttgtctcagggaacagggagccccaaggagagggagaaacatggggaacagctggttagtgcaacagtcagaaaacacacatttaccaattaagttcattgtctcatatgggtgtggttcatggtgctccaaaacaattacaatactaacatcaaagatcactgatcacagaccaccataaaagatataataataatgaaaaagttggaagtaatgcaaaaactgccaaaacgtgagacacagagacagaaagtaagcacacactactagaaaaatggtgccaacagacttgctcgacataagattgtcacaaaccttccatttgtaccaaatgcagtatctgtgaagtgcaatacagccatgtgcattaaacaagatatgcctataatatgt

SEQ ID NO: 671028 - DNA, 252 bp, Homo sapiens
  misc_feature (25)..(25): n is a, c, g, or t
  misc_feature (106)..(106): n is a, c, g, or t
cgcgcgtcaggggaggcgagagaanacaaaaaaaaaaaaaacttaatctgtgacgactctcttaatttccaccgctacacttccacttacttacatgatcatttcnagagatgtattgttgaggggggcggtggtttatgtcaaataccgaactcttccaacaccacgaacacttgccaagtatttcaatccttgctatgccactgctagggtaaagccaacattcatcagcaaggtgaatacaggagtcca

SEQ ID NO: 671029 - DNA, 141 bp, Homo sapiens
gctggagatagctggcggcaggactcagcggcagcactcgtatctccgcaggcgtccgatgctggacagcacggagcagccaggagtatcaggtgtgtactgccctggacacctccgaacgctgttcctgggtacgagctc

SEQ ID NO: 671030 - DNA, 570 bp, Homo sapiens
tccacctcaagtctggaggacgcacctgcagctgcacagaggtgctgtgtgctgggagtggggaggctcgccgccaaatgctggctcagatccccaggccagagagatgggtctttatacgtgataagagcacggataagccaccgggtgggggggtcaaaatcaaaaagtcaatatccaagtctttagccgggtcactaataaagaatctctcaggccggctaaacgatagccggtgacttggtgcgggtaagccatgggcgggtaatctaactgggaatgacctttacattataaatctttaagacacataggggtagcttggtcaaagagtactatatttttatccttccaagtagaattttactttaatcataggatggaaagccaaattttaaaattccttccttggggaataggtgtgggaacctaggtgagaggaccaggggaggggtcagataccttaattttgtttttaaatcacatttgaatggcagatactcagaacatcaagtcattaagttaggtgacaatcagtatggggcgagaagggtccagtaccttttcatt

SEQ ID NO: 671031 - DNA, 912 bp, Homo sapiens
  misc_feature (3)..(3): n is a, c, g, or t
  misc_feature (5)..(5): n is a, c, g, or t
tantnccccgggcgaccgtaggaacgacccacggcgactgccaacacaatacctgcggcgcgcgtgggctatagaaaagtgcgccggaaacgattcctcggggccgagcatgctcccgccgaactggcccggggaaaaagatcgcccccggccccggggcttgggcccaccggtggaagtgaaggccaccaccgggttccgaaagacgcaggagcccggtcggaaaaaccactggtgcttggggtggcgaagaccccccgccccccaatcaggaaaccgcgcggtccctaaaaggccagagccagggggatggttcccaaacgataaaaaagaagaaggcgggccaccaccccggcaacacatagatgaggccgacaaaccccgcaggatgcttatagccgccaaagacacaccacttgggagacccaattggacccccccatcgcgtgtcaggaacacccacacccttccccccgcaagaaggaatcaaagatcacttaggggcgccccacgaggtggtgcgacagagtagaacaacaacgcgcacttaataagtgctacacaagagagcaaacacaaaagggtggcaaataataagaaagcagatattgcaagatataaaagggtggctacgcacacttcagcactctgtgggcatgagccagaccccgatataccatgctaccacaactggtccccgaagaattgggtcaacaaaacttatagtgacccctcgattggtcaagcttatcaataacttttttgagctacagatgtttcacggaaacaaaaaagtatgggggaagaacatacagaagttttctaacaggcccccggggtaataattcaacgggtttttttaaaggactcacaaacaatccaatttgatttttgggcccaacacacataaca

SEQ ID NO: 671032 - DNA, 1201 bp, Homo sapiens
  misc_feature (8)..(8): n is a, c, g, or t
  misc_feature (71)..(71): n is a, c, g, or t
  misc_feature (80)..(81): n is a, c, g, or t
  misc_feature (86)..(86): n is a, c, g, or t
  misc_feature (89)..(92): n is a, c, g, or t
  misc_feature (98)..(98): n is a, c, g, or t
  misc_feature (100)..(102): n is a, c, g, or t
  misc_feature (109)..(109): n is a, c, g, or t
  misc_feature (111)..(122): n is a, c, g, or t
  misc_feature (127)..(130): n is a, c, g, or t
  misc_feature (134)..(136): n is a, c, g, or t
  misc_feature (138)..(139): n is a, c, g, or t
  misc_feature (141)..(142): n is a, c, g, or t
  misc_feature (147)..(148): n is a, c, g, or t
  misc_feature (157)..(157): n is a, c, g, or t
  misc_feature (171)..(171): n is a, c, g, or t
  misc_feature (177)..(177): n is a, c, g, or t
  misc_feature (186)..(186): n is a, c, g, or t
  misc_feature (188)..(188): n is a, c, g, or t
  misc_feature (193)..(193): n is a, c, g, or t
  misc_feature (208)..(208): n is a, c, g, or t
  misc_feature (213)..(214): n is a, c, g, or t
  misc_feature (224)..(224): n is a, c, g, or t
  misc_feature (226)..(226): n is a, c, g, or t
  misc_feature (229)..(230): n is a, c, g, or t
  misc_feature (266)..(266): n is a, c, g, or t
  misc_feature (279)..(279): n is a, c, g, or t
  misc_feature (287)..(287): n is a, c, g, or t
  misc_feature (292)..(292): n is a, c, g, or t
  misc_feature (299)..(299): n is a, c, g, or t
  misc_feature (303)..(304): n is a, c, g, or t
  misc_feature (319)..(319): n is a, c, g, or t
  misc_feature (334)..(334): n is a, c, g, or t
  misc_feature (338)..(338): n is a, c, g, or t
  misc_feature (356)..(356): n is a, c, g, or t
  misc_feature (368)..(368): n is a, c, g, or t
  misc_feature (385)..(385): n is a, c, g, or t
  misc_feature (782)..(782): n is a, c, g, or t
  misc_feature (833)..(833): n is a, c, g, or t
  misc_feature (1149)..(1149): n is a, c, g, or t
  misc_feature (1175)..(1175): n is a, c, g, or t
  misc_feature (1177)..(1177): n is a, c, g, or t
  misc_feature (1190)..(1190): n is a, c, g, or t
tattaatnttaaaaaaaaaaaaaaaaaaaaaaaaaaaaaaaaaaaaaaaaaaaaaaaaaaaaaaaaaatanttttatttnnacggngannnnagaaanannnggagaanannnnnnnnnnnnacatnnnntagnnntnngnnatttnnaaagagtgnccgtcggatccggncgacanacttagatnanaatancaatatgaaacccangcacnntgagagagananatnngacgcagtcatatagctcacacagatcctgaaggcncagaatgacaagngagaatcnataanacagaangtgnngagatgtctgtgtanaaccgaagccccatncgtncaccgccacctgttttanatgcccggacancacatgacctactgagnctgagcctcaaaagaaccatgtgtaaagaaggtctgaatatagagcaaaatcactcaaatggacaggatatgtgtcagcctgaatacgtcagcacactacagactgggtgaaagtgataaagaaacaaaaaaaagcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtcccccctccctaaccacagntgggtcccttttcaacactgccacatttccttattgatgcatcttttcccnccctgtcactcaacgtggtccctagaacaagaggcttaaaaccgggctttcacccaacctgctccctttgatcctccatcagggccagattttccacgtttccatttcaggacacaatcatttaatatttccctgtcttacccctattcaagcaactagaggccagaaaatgggcaaattatccctaacaggtctttgactcaggttccagtagttcattttaaagcctaaattcttttgtggttgttgctggcccaatgagtccctagtcacatcccctgccaaagggagttttttttttgtgagagaccctgtnaacgacccaagagaacaagaataaancnataactgtgtgtnttttggctgga

SEQ ID NO: 671033 - DNA, 291 bp, Homo sapiens
  misc_feature (6)..(6): n is a, c, g, or t
catcgngggctgctatacagaatcttaaaaaaaaaaaaattttttatgaaatgaagtcagattgtctgatgagggactgcttttaccatccatccttctgcccgggctacataccctatcccttggttcctctggcagccgcgtttaccactgagatgcttagcaatatctcaatagcgaccccaaacaaaaatgaccaaaacagctttaatataaagatatattccataaaagagtttgccagtcaaagagaagcatcacacttccgaaaaacacaggctttcttctctg

SEQ ID NO: 671034 - DNA, 327 bp, Homo sapiens
tggcagagcttttagactgaagattttcccttcgtaatgccagaagcgttcctagaacttccccagctaaaacagggagacgctaacgtctctacctctaaggataggcccgccaaatagagttagcgtgaagaccccagcttgaccaaagatggtgacacctggggatttatggtcagcgacctgagtgaagcaacatcctccttgccactggctggtctgttcattttaacatgaacatgttttaatgcagactgttcaagctgtttcaaaacagtcattaaaaatacacatgcaggagcacctgtattaaagactttgtttgga

SEQ ID NO: 671035 - DNA, 152 bp, Homo sapiens
gtgtgtacgagtacggtgtacgctgggatgacatgctgagtcactcagtgctgagaaatctaagctgggatgaagttagggactgtggctatcaaaatagccaggagagatttatgttaacaagaatgcagatattagtttagtagttagag

SEQ ID NO: 671036 - DNA, 268 bp, Homo sapiens
atctagtaccctgtaccaagctcatattcatttctgtgatcacgcacatgagaatggatacttaattaaaatgaagtaacattctgcctaattaagtttggtgataaggttgtgaatttgtctgtgtacttgaataactgatttagtcaagaaatgatttgtcattatccgtaaagagaattcaccaaacaggacaaggcatattctattagaagaatgtagtcagccaggtgcatatcactgcatatgagaaactacatgcatcagt

SEQ ID NO: 671037 - DNA, 1178 bp, Homo sapiens
cggctggtggcctgccgcgcggcgcggcccgcccctcggcctcgggcgcgtggcttgcctcgcggtcgcgcgggccgccggtgccgcgctgtcgcgcgcggcgcggatcgccgctgtgcggtcctggcgccggcctcgtctctgcgggctcggccctgtgctccgccggctggctcccccggtgtgagcggcccgttgtgtccttctgcgccccgcggtggtccgcgggcgacggtggggtgcgtccctgctgtcgtcgcgcgccccgtctgcctccgtttcgttcgacgtggtctgttgagcgcgcgcggcgcgcgcttccgcggccgcgttggtcctcccgcgcctcggcgcgggcgggcgagcggtgtggtgctccgccctcgtcgcccgcgtccgtcgcgcccgcgcgggtccgctcgctggctgctgctgttgtcgtggtggcggcgcgtggcgtggacgctcttgtctagcgggggctggcgacggcgcggtgctcgctggcgtggcgcggcggctgtcggtctgccgtggtgatatgtcgcgcgggggggggggggggggggggtggcgggggtccggggtgggggggggggggggggggggcgtgggggggggcgggggggggggggggggggtggctgcccctataggtgctgagctgctgtatagcagcaaggttacgcgtgcctgaacgggaagcctttgcgccgtttgtgcgcaggagtcgtgatgcgtgtgcgcagtgtgacgcgtgcgctagagcagtggtaagcgtgtcagtgataacttctgctcttcatcgtgcggccgactgggctaaatctgtgttctcttcggcggcgctgggtgatcctcgccgtactgcccgcttggttaacgtcgccgcccaattggcaaaatattctggtaaatcaataaccatctcatcagagggtagtgaagccatgcaggaaggcgcttaccgatttatccgcaatcccaacgtttctgccgaggcgatcagaaaggctggcgccatgcaaacagtcaagttggctcaggagtttcccgaactgctggccattgaggacaccacctctttgagttatcgccaccaggtcgccgaagagcttggcaagctgggctctattcaggataaatcccgcggatggtgggttcactccgttctcttg

SEQ ID NO: 671038 - DNA, 231 bp, Homo sapiens
aattcaaaaccaaattgctaaccactgttctgtaaacagtgtaaactctacctctttagggcagagctcataactatttttttaaaaaaataacaaaatgttatttgaaattaatttacgcacatattatatatatataatgttaaaagtgagagtatttacactaccacattgtggtgttggggggaaaactccaggggttcccctcggggataagacaacttctctcta

SEQ ID NO: 671039 - DNA, 136 bp, Homo sapiens
tagaggatccccggtaagcgcggctgttttcattacaactgagccacaacaggaattccaagcatatcttttaaacctgagatagtcagagaatgtgtgccatcccagccaaatcgtgtcagagggtgaaaaatga

SEQ ID NO: 671040 - DNA, 1475 bp, Homo sapiens
ccgtagtgacttgtttgtccattattatgtggttggccgcacggtgctagttgtcggcgtgcccacccagtgttgctggttgtgtttctctgctgttctccactgttgtggaggggccctctgtggtggtattgtttaattcgtgtgccacactatttgtttgctgtcgtgacttgttctgcggtacttgtgtggtcgtccccacgagtttgtggtgcgtgttatttactgggagtgttctggcgttttgtccgttttgttgccgccactgtgttggtcttcttttggtcgccgtcctcgcgttagtgtaagggacccgttgtggtccgcgttcgccccccgcggcgttgtgtgttagtggccccttcccgtcccactcgccacattgcgtggggaacgctgtgttgaggggctcccccagtgttgaccgcctgtgtgtttgtggttttcccccggttcctcgccagggtgaggttgccgtttgtatcctgagccggcccaatgggggccccgggtccttgtgtcgccgcgtgccgctggaacggtttcgttgttcgaccccccagttcgttcggaagttgtttcaacgtgagttggggcacccgttgacgttttagccgtgggttgttccgagtccccgttatgttatggacgttgaacccgagacaagggtgaaacagtcccccgttatgagcacgggaagtttatttaaaatgtgaaacccactggctttaaacacttttgcgtgagagcccccctgtttgttgtaaaagaggaattggccgcttgttggagttctggggccatctatatcccttagccctaactcttcgtttgtcccctatatggggccccttctatgcttgaggacctcacttggagaggtataataccactgcttaaatatccactctcgtaagagccccgcggcacacgagcagaggcctcggatacgagaattcccctctcttataagacacctccccacgggccctcttcacctcgaagtattgaaggtagtctgtgttctccccaaggccacgaggggcccaaggcccagggcccgagagaagggattctccctcgggggcaccacgacccagctcgaccccataatgaataccaccttggaatttcttgtacataaagaggagtcgagcctcttgtaaataccaccgttatgctcggccctcgctcgtggaaccacgaaatcgcctattgaatgcaccacgctagctcacggtatagtggatgacaccacctgattctgagagccctaattaacagaaactctttggaatgataatgtcactctagacctttgatacgccacagtgtgattcctggacacgagtgtacttggctttaccctggcacgcttgcttggaaaatgtcaaacctcacggcctcacacccccgacctactgacattatttatattaatttaaattaatataatcttttatttccaccca

SEQ ID NO: 671041 - DNA, 1209 bp, Homo sapiens
attctctgcggtgggtttttgttgcgccctcccctcttctatttagttgtgttgtcgtcgcttcccctcccgtcccctaaaaagtggtttgttttttttttcgcctcgcgcgtgcttatttgagtgtctgtatgttattggtttgggtggctgctgggtgcaccaccaccacacgccgtgtttgtggtggtggctcgcagcagacacgtctgtcatatcattttgtggtcgcgccgcgggagttgttgcatctctcatcaatgatgagtgagtagtagtgtgtcgttgccgcgtcccgccgccttcttttgtgttgtgttgttgtcttgtctcttttttctgtgtgtttgtctgctgttgttttgtgtgttgtgctctttttgtgttttttttctttttgtgtgcggcgtcgtgtgacgacgtcatcacacgcgaggttgtgttgttataatatatccccttgtgcggtgccgccccgccgtggtgagaagaggagtgtgcccgccgccacgactcgtcgcgtgtgttgtgtgggcgcgagagacactactctcccctccacacggtgtgtcaccacacacacagtgtgtgtccgcagcagcagagactcttcttgttgtgttgtggcgtcaccacacactattgtgtgtggtgtgttgtggtgttttatagtagtataagtagtctactcttctctccgcacactatactgtagagagagcagagtcactactgtgtggtgtacacacacagagatattttctctctctctgcacactctctcttctcatataagacccacccccgcgctctgctctttctctctcatcagagagagagagatatgggcgccacactctcgcttctctctcccacaacagtgtccacacacacacagcagcgcgagagagtgtgagaaacacactctcgtgtgttgtctggtgtgagaaataatatgatataagacccacaatgtttttaaattttctgcccctctaaaactctttttatttttgtttttatttttgtaaaaaagaaccctctctctggccccccccctccccccctctgtttgttccccccccctgaaaaattatattaaagcctttgggttcccccgggagggggggggaggcgcccccccgggttatcccgtcacacccgaacatttgagacaccccctggagaaaaaaaggcgcccccccctta

SEQ ID NO: 671042 - DNA, 283 bp, Homo sapiens
tctttacgatatacgcagtatggggatacgggtgtacgtgtgcctgatggtaagaaccggtccagggcattattaatcttagagcgaaagcctatatcactgcgcccgctcataatgtgattgccattgctaggtttctagattgttcggtggttagtgtagatcagtgcggcaggagtccgaggaggttagttgtggcaataaaacttattcatgatactattatcagagatcaggttcgtccgttagtgttctgtataggactgatctataggactggtgg

SEQ ID NO: 671043 - DNA, 876 bp, Homo sapiens
cgtggtggctcacgactgtaatcccagaactttgggaggccaaggcaggtggatcacttgaggtcaggagttcgagactagcctggtcaacatggtgaaaccccatctctactaaaaatacaacagccaggtgtgatggtgcacgctcgtaatcccggctactcaggaggctgaggcaggagaatcgcttgaacccggaaggcagaggttgcagtgagctgagattgtgccactgcacgccagcctgggcaagagagtaagactctctctcaaaaaaaaaaaaaaggattttaaattcccaatttttttttctaactcttttttgcggtgtgtttttcgaccccggtatacctttagtatacctatgtgcttatcacctgtcgggtcacctgcgtaccctgacatttcatttttcagaagtaccttacccctggcttcctccatttttatccatggctccttgagaaacgccaagggcccccctcctagttactccgcagcggtccctgcacacgacgagacgggcggccaacacctgagccacgcagaattcgtattggacatttaccgttttaatttcctaaaaagccatttgagattggccggggagggggtttgcggttcgcgcccttgtggctccattgaagtggctgtcacaggaagtggcgcttcacaggggctttattaacctccctggtacaaatgcctattcccaaaattttgtgtccacttttcatttgtggtccccgggttaattctcaaaaaaacatttcccaaaccattctttcttacccccttatttttaaaaattcttttacctaaattggcacgttcacaacaataactcccggaaagggcccctatacctttataaaa

SEQ ID NO: 671044 - DNA, 142 bp, Homo sapiens
gacagaaatctcatcctctgctggtgattggaaccagaattatggccctcagcagggaccaccccaacaatggagtgccagcagcaacaaggtccaccacctcctcagtgaaagccacaaggaccagcccaacaaggaggtg

SEQ ID NO: 671045 - DNA, 397 bp, Homo sapiens
  misc_feature (381)..(381): n is a, c, g, or t
ttttatttttttgagacagagtctcgctgtgtcacccaggctggagtgcagtgccacaatcttggctcactgcaacctctgagtcccaggttcaggcgatactcgtgcctcagcctcctgagtagctgggactacaggcgtgcaccaccacacctggctaattttttgtattttagtagagacggggtttcgccatgttgcccaggctggtctctcctgagctcaggcaatcggccaccttggccttctgaaagtgctagaattacgggcatgagccaccgcatccagccagaaagatacatatctaattctagaaataggcatggcagttattcagttcattagttaacaggccatgtgctggacctaaattaaaatttnttggatattgtgttat

SEQ ID NO: 671046 - DNA, 163 bp, Homo sapiens
agtctctaaatcaatctgaatgataccattcagattgatttagagactggcaagattactgatttcatcaagttcgacactggtaacctgtgtatggtgactggaggtgctaacctatgatgaattggtgtgatcaccaacagaggagaggcaccctgcgaat

SEQ ID NO: 671047 - DNA, 113 bp, Homo sapiens
gggcttcgagcatctggggacagaccctcctggaaatggtctatgcacactgctgaggctcggttagcagttgagacagcacttgcaccatcagcctctacagaactggacat

SEQ ID NO: 671048 - DNA, 316 bp, Homo sapiens
caaatcattgaatctacacttaaggtgaatgtatcataatcagtatatcataataaagaagccatgcatacccttaattatgtggattcactctaattggtagttatattttcctgggtacatagtaaaggtcgtttaatctaacaaatataaagctcattattttacgaagaagaacctcaagtaatactctttctaggagccactattgtactaaatattatattcattaagtgtttccaggatagtttgacgggtactgttgatgaaccaacagcagataaaaaatatcctgcccttgtgtagaagctaaaat

SEQ ID NO: 671049 - DNA, 243 bp, Homo sapiens
gtgtgcatttgccagtggcaaatttctattctcaattaacccatgcagacaaatgctacgacatctgctgagtcacgttatagaagcatttgcgagtggacgcatggaggggcccgactcagtcgtactcctgatatgctaaatccacatactgctgagaaggtgggacatgtgatggccatggcatggacgccaccagagtccaacaccagagtacttagctgctctagggaggtgcgactg

SEQ ID NO: 671050 - DNA, 420 bp, Homo sapiens
gttatccgcgtcgctcttcatactgtggaaagtctccctgacagctccatcatggcgtggccagtttcttggctcgagcttgctctcgaatccacgggtgacagtcatctggtaggacaggtcatcattgatctccctgtagagccaggcgaagatgtgggggctcacgttgtgggtcggcggtgaagtaggagaatggggccacctggagggtatccatgtgcactgtggtctccccctttgtggtcgagatgatggagccaaaacttggaaagggcggattcccagggagggcattggcccggaaaagacatcctctcgggctagctgtgtgcttcttccaagagctcactgaactggctttcctgtgcagcctgacacaaactgcatgccaagtggtggagactttgcccaggtagg

SEQ ID NO: 671051 - DNA, 811 bp, Homo sapiens
  misc_feature (1)..(1): n is a, c, g, or t
  misc_feature (62)..(62): n is a, c, g, or t
  misc_feature (120)..(120): n is a, c, g, or t
  misc_feature (170)..(170): n is a, c, g, or t
  misc_feature (214)..(214): n is a, c, g, or t
  misc_feature (220)..(221): n is a, c, g, or t
  misc_feature (239)..(240): n is a, c, g, or t
  misc_feature (246)..(246): n is a, c, g, or t
  misc_feature (259)..(259): n is a, c, g, or t
  misc_feature (261)..(261): n is a, c, g, or t
  misc_feature (284)..(284): n is a, c, g, or t
  misc_feature (347)..(347): n is a, c, g, or t
  misc_feature (354)..(354): n is a, c, g, or t
  misc_feature (370)..(370): n is a, c, g, or t
  misc_feature (386)..(386): n is a, c, g, or t
  misc_feature (410)..(410): n is a, c, g, or t
  misc_feature (416)..(416): n is a, c, g, or t
  misc_feature (426)..(427): n is a, c, g, or t
  misc_feature (433)..(433): n is a, c, g, or t
  misc_feature (444)..(445): n is a, c, g, or t
  misc_feature (647)..(647): n is a, c, g, or t
  misc_feature (708)..(708): n is a, c, g, or t
  misc_feature (716)..(716): n is a, c, g, or t
  misc_feature (746)..(746): n is a, c, g, or t
  misc_feature (800)..(800): n is a, c, g, or t
nggtgacctccccacccgtcccaagcacacacacagacacacacacacacacacacgcacantggtcagggagctcgtggctgtgaggggccaatgggcggtatccaaacattttgaggngattttaactggtaggttcaaagcaagctgtgctcgacttcagtgagggntatgctgtgcctgagagggggttactgtggcatccgcacagttnagtggnntgtgggggccagcggggnngtcaantaggctgtctgtngnttgactcaaagtggagggaggtngtgtcccccggatggcggctgcataacgtgtagatatctgtggtctaatccacacggaggaantgtggangaggtggaaaactgcnaactgctgatggtgancgatccttgtttctggcatgacanagtccngcttacattnnaatgantcccaaggcanntgctgtttttgcttcatgatgtcctcagtgttgggaaggcaatttgtccatggcagaaacccgtagagccacttcagcatgcagtagcccaggctctggaggtctgctgcggcgggagggcccgcaatcccttgtgcagggtccatgcttatgaactcataggtccccctcgtgagggctcctgctgccttccacgtaggcnacgtgtttgccacttgggcaatagcggaaggcgaacaatacgcctgccaaagtcacctgantctggtcntctggatccacaaagatattttcagctgtnacatttccatgaacatactcattctcatggtggaactccagggcatcaagcagngggaggcaaca

SEQ ID NO: 671052 - DNA, 228 bp, Homo sapiens
  misc_feature (18)..(18): n is a, c, g, or t
  misc_feature (69)..(69): n is a, c, g, or t
  misc_feature (90)..(90): n is a, c, g, or t
ggggggggggggggggangggaggagagagggggagaggaggaggggggggggaagggggagggggggnggggggggaggggggaggggnggggggggggaagggggggggggagagagaagaagggagggggggggggggggggaagggggggggggggggagagacctaatcccccattttcctcctatccctcaaccccgacatcattaccggggtttcctttta

SEQ ID NO: 671053 - DNA, 196 bp, Homo sapiens
ggatctcgatatcaaatgccttccactgggaccgaaggctgctttccccctccctagaggtgcccattccataacctgggagactgaggagagcattggtctgaagcccagttcctgttcgccgatccatcccctactccaataatcccccactcctcgctaggtctcagtgtacatcgctgtcattggggcaggg

SEQ ID NO: 671054 - DNA, 732 bp, Homo sapiens
ctgtctagaggatcccagtaaaccggaaacatgcctttgaaaacggcacaagacaggtatgccctctctcaccactcctattcaacacagtgttggaaattctggccaggcaattaggcaggagaaggaaataaagggtattcaattgaggaaaataggaagtcaaattgtccctgtttgcagatgacatgattgtatatctagaaaaccccattgtctcagcacaaaatctccttaagctgataagcaacttcagcaaagtctcacgatacaaaatcaatgtacaaaaatcacaagcattcttatacaccaacaacagacaaacagagagccaaatcatgagtgaactcccattcacaattgcttcaaagagaataaaatacctaagaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaaggactttcttcacagaattggaaaaaactacttgaaagttcatatggaacccaaaaagagcctgcatcgccaagtcaatcctaagccaaaagaacaagctggaggctcacactatttgattcaactatatacaggttcagtaccaaacagctg

SEQ ID NO: 671055 - DNA, 639 bp, Homo sapiens
tggggggaggtaatatgggttaaatagtttttttaatttatttagggggaatgatggtggtggtaaactttaatagtgtaggaagctgaataatttatgaaggaaagggtgtcagggttgattcgggaggaccctatgggtgcgggggcttggtatgattatgggcgtatgataagtagtagtaactgggtagaacatggttggtgggtgtatatatggtaattgagatggctcgggggaataggtaatgtgattaggagtagggttaggatgagtgggaaaaaaaaagagaggaatgtaaagttaaattatcgccttttggggttgaggtgatgatggatggtggagattgggtgctgtgaaattggtttaaggtaatagctttctagtcaggttaggtctaggaggagtaggggcaggtttgggctcgtaagaaggcctacataggggatggtgcggtgtgtgatggaaatgtggcgggtaaaggggctccttgggtcgaaaagttacatgggcgtcagcgaagggttgtaatacccgtaggggcctacaagtgggggcttagcgaagttgctttagcctaaaattttcgtcggaaggcttaggaatgcattggataaattgtccatgaggataaga

SEQ ID NO: 671056 - DNA, 1017 bp, Homo sapiens
  misc_feature (334)..(334): n is a, c, g, or t
  misc_feature (344)..(344): n is a, c, g, or t
  misc_feature (358)..(358): n is a, c, g, or t
  misc_feature (374)..(374): n is a, c, g, or t
  misc_feature (390)..(390): n is a, c, g, or t
  misc_feature (467)..(467): n is a, c, g, or t
  misc_feature (502)..(502): n is a, c, g, or t
  misc_feature (527)..(527): n is a, c, g, or t
  misc_feature (569)..(569): n is a, c, g, or t
  misc_feature (612)..(612): n is a, c, g, or t
  misc_feature (616)..(616): n is a, c, g, or t
  misc_feature (630)..(630): n is a, c, g, or t
  misc_feature (633)..(633): n is a, c, g, or t
  misc_feature (636)..(637): n is a, c, g, or t
  misc_feature (643)..(643): n is a, c, g, or t
  misc_feature (651)..(651): n is a, c, g, or t
  misc_feature (659)..(659): n is a, c, g, or t
  misc_feature (664)..(664): n is a, c, g, or t
  misc_feature (676)..(676): n is a, c, g, or t
  misc_feature (693)..(693): n is a, c, g, or t
  misc_feature (707)..(707): n is a, c, g, or t
  misc_feature (763)..(763): n is a, c, g, or t
cgtaagagaggtgggcaagtacgtgttacagacggcacgccgcctttaggcggtcaaggtggggcgagcagacgttcgcccccctgcagtcggccgggtcactacccaagagcctttggaggcggaagcatggaacggtctgcaaacgttcccgagcgggcctctgcggctctggcgggcgtttcgaacttgggcgccgggcacacgcccagtcccgagagcgctgagggttcccttagcgttgccctcaccccggccaacccgcggggcgccagagtcctggccctttaaactgcctgcgctgttgcctcggcgtcttcgtttcgcgcgcccngcccgcggcngcctggctggagcngaacatggacccggcntgcgcgggtgtgtgcngggcgctgtggcctggtgggtgcgccttggcctggaggctgggagtgccgcccccagccgctgctacccacgcaaancctgggctggcttctgcgggggcggcgggcggccngagccccgtggctgcagctcgtacnggggagcccgccgcttgctgggagctgcggcgctggccctgngggggagccctggggctgtaccacacggctgcggtggcacctncgcncccaggacctccangcnganngctcanccgcgcantctccctntccanccgcctgcagtnaccctgtaccagtacantatgtgtccttctnagcagtccgagccttcctcgacttccatgccctgcctaccaggtggtggaggtganccctgtgcgcgggctgagatcaagttctcctcctacagaaaggtgccatcctggtggcccaggaaggagaaagctcgcaacaactaaatgactcctctgtcatcatcagcgccctcaagacctacctggtgtcggggcagcccctggaagagatttactataccagacatgatgtgtactagccgggagggggcggttgggaaagaggtctggccagagggggcccagttgtggcggcaggggcaatggccgtg

SEQ ID NO: 671057 - DNA, 311 bp, Homo sapiens
ggtgactctagggatccacagtacgcttctactatatgaagcggtactggtaacatatgatccaactttaacaatttttagctgagaatactttttaagtatcaatcaaatgtatcagcatccaccataagcgcataaaaattttcacatgccattaacacttgtgttaccatcataagcctacagacctacacactaattatctttaaaacccttattaggctgggcgtggcggctcacgcctgtaatcacagcactctggggggcccaggcgggcagatcacttgaggtcaggagtttgagcccagcct

SEQ ID NO: 671058 - DNA, 418 bp, Homo sapiens
taacccctctttagatttattgcgctcaaaacccaatttaaaccccccccccatgtaaacgggggggcagggcaaaaaagaaaaatgtcccgaaagccagtcttggaaaccaccagttctggcccccccgcaattaatcgcccgtgattgggttttggtgtttaccatctggtccctggtgggctggggggtcagagatgtcgagacgctgtgcagacgcctcctgggaggggcacggagccatctgacgccccttgggaaaatgtcacaaagagagagtggagaaaaacggccacttgtccggccatggagtcctggaggacagttggctggtacccaaagatactcatagaggccagcaagcgggggttacgacgagcatccctaaggtgaacacggctgtccaaagccaaggtcg

SEQ ID NO: 671059 - DNA, 1010 bp, Homo sapiens
ggagagagagaactagtctcgagttttttcttatatttttataagcttccacctcagggtttaactggaaaccagctttgggggcatatgaggcacaaggaatccagctctggttccctaagaagccatccacagggttttaccttgtagactgtcatcactggtcagacaatctggggtcctctggtcccggtggcaacccttagggctggttctgggacagcgacgggagccccaagacagacttgccagtagcgggcatccagcatggggctggtattccggggctattgttggactttgagagctgtgtacagaacttccacctggggtccctgttagaagctacagcaagggcctgatctggctagactccatactatttacatagtgtagaccagaaaggcacagtttactggggtgagggtccagtggaagagcgtacaagagattgttatccaaaaagggagaaagaagggccccagcggagaaacgggtagggtagcacatggtcattactaccataatacatacgagacgtaattccctattaccaagggggacacagcccgtcacagggggacatagaaatccgagaccttgcgggaaaggagccccatcatcgggagctacggggccatacagatacccggggtacccagatccctggtgcccgagtaccccggggactcagatctcagatcaccagatccccggataccctgggtccccaggggtcatacgaggcaacaaaaggatacagaaatcgcaccggggtactacagaagacccccaaggctcccacaggagacatacagggaacatactgcggtccccggagattcccctctaacaatgggagatcgtagaaccccggggttagtcgggggcatacacagaagagaagagcggcgaacagcgttaagagagcacgttgggaacaacccaaattgggggattacaatcagcactaagggccccagggtccaagaacgctcatcaagagggag

SEQ ID NO: 671060 - DNA, 1166 bp, Homo sapiens
  misc_feature (680)..(680): n is a, c, g, or t
acaaaggaacacccctccaacaagaaatcattgggagggcacacctcttggtgaggcccactccaaaaaacgcccacacaaacagcgattaccacagactttttatccaagagaagatccaaagttcccatttaaacccggggtcccaaaatttttcgaatcagtgggcaactgttccggaaaactttaatgcatccagttccggaaagggttcccccaagaaaacctgtcccagaaccaggtccaacacctaggactgaaaaattagttcgccgaaaggactaaacccatttcggaaatatgaaatccaaaactgcggaagtccaaacggaagaaattccatgcggatttaaatttaggagaatcccatggaagaaatccctgaaaccattacgaattctgggccttgttgaaaaagttctaccggagaaagatgcctttcagaggaagtactacaggacgggaaccttccaagaaacgccaatggtgccccccggccggccctgaaccctcgggaactggctgtttgggcctcctggtgctataccttttcttcaagttcctggtcagcatgatcaggacggggtcttccttgacgttggccagcttaatcctcgtcttcttgtggcccccgtgggagttcgatgaataattgtgttaccggaaattgacaaggggcntcttacgccaactctgacagcaagcagaaactgaatgactgactcagggaggtgtcaccatccgaagggaaccttgggaaactggtggcctctgcatatcctccttagtgggacacggtgacaaaggctgggtgagcccctgctgggcacggcggaagtcacgacctctccagccagggagtctggtctcaaggccgatgggaggaagatgtttggaatcttttttccccatgtgctttagtggcttggttttcttttggtgcgagttgtgtagaatgctgtgtgtgagtgtgaatttgtttgtgatcatagaaaggtattttggctgcagggagcgcagggctgggaccgaagggacaagtcccttttcatccttggtgctgagtttctgtacccttggttgccagagataaagtgaaaagtgctttaggtgagatgactaaattatgcctccaagaaaaaaaaattaaagtgcttttctgggtc

SEQ ID NO: 671061 - DNA, 284 bp, Homo sapiens
ggatctcttttccccacttctgttactgacctggcctaagttggactgtgtggtgaggaaactacaggtaatggaaaatatctttatggaaaagcagaaaatcctttgcccaaaagggaatacaagatgtcaggaataacagccccctcctactccttgctcaaaaagtcttcctccccatggaatgttgtcttatacaccacaattggtactccatagtttaggaccaaggcattgctttgtgcaagctgtcattttaaaaatgttggcatttcaaaaaaaaa

SEQ ID NO: 671062 - DNA, 908 bp, Homo sapiens
ttcggcacgaggtttctccatgttagtgaaaggagcaattggcttcgatagatatatacaattgatgaaaatatcagcttgtggaatttcgtcaaagggaccaccacgggaagtttctttgatatcccattttaatatgttagcatctggaataccaactttgtgcaacagatcgatggcaccggaaccacatcttcctagcgcaccaatgattaacacggttggctttctggcgccggtggctaaggcttctttataatctttggtaacatctttaaccaacgccttttcattggggtaaggcgacactgcaggcaagtcttcatcgtcagaatgcgtttgcttgaatgcccagtctcttacaccaagggctgcacctgcgaacccagcgtaaaatccaaaggcagcaactcttctaccttggtcattttccaaaaattccaaatcatatagagtaccgtgtcccttaataaatctcataaggacattttgccacccagcttggtctttgtagcagtgagcaaactggatgtgttcgtggactagagggaaagtatcggtttcaggcatttccttcaaacctataatgattctgtcgcgtggagcggttttccatgaacctgcaggcactataatggcacctgcttgacgatattcgttaatattgaaagtagattgtggactgtcctctacatatattttgaagcccttagctatcagttttttaaccgtggtaggtgttaaggcagcacgtgcctctaggggtttagtttcagctcttagatgtaatgtgacggcagccatttttgcggttgtgtgaaaaataaagcgttttcgttgttatcttatggtatggcttctaaaataccagtttccgtcaggaaagatgggctttttatattttcatc

SEQ ID NO: 671063 - DNA, 555 bp, Homo sapiens
cgccagctccactattgaatcggaaccccccaaacacgtagagggagtctggtggacctcgatggtagacacgctagagtgaccatacgagacctgtggtgtggtgtcccactctggagctcctgacaccacagagtgccggttgccagctggtactccagcagctgctggttgaagccattttccggggagtaaccgcccaccaggagcagagacaggcctcggcgggcagtaagggtgtgaccagcaacggatagcagctccacggtctggggggccttctcctgccgccattgcagggtggtgaggttgaggacccagaaatcacgggtgacgcctccagcggtaagtccccccagcagatacatggcaccacggacagcgggcacatatgcggctgcaatggaaggagcggggcgatgggcctgggcccccgtcctcggctcccgccagcatctgtgtccagcggcgctcactcactgagtacctgtacaggtttcccagcagcccctggggcaggccaggccccaaatatcacaaggtgcatcgggtcat

SEQ ID NO: 671064 - DNA, 522 bp, Homo sapiens
  misc_feature (23)..(23): n is a, c, g, or t
  misc_feature (171)..(171): n is a, c, g, or t
  misc_feature (246)..(246): n is a, c, g, or t
  misc_feature (281)..(281): n is a, c, g, or t
  misc_feature (415)..(415): n is a, c, g, or t
  misc_feature (423)..(426): n is a, c, g, or t
  misc_feature (428)..(428): n is a, c, g, or t
  misc_feature (430)..(431): n is a, c, g, or t
  misc_feature (434)..(434): n is a, c, g, or t
  misc_feature (437)..(437): n is a, c, g, or t
  misc_feature (439)..(439): n is a, c, g, or t
aactttagttcatcgcaccccgncttacaggcttaacatagaatgtggacctaaatacccagaagcaccctcctttgtgagatttagactaaaaattaatatgaatggagtaaatagttctaatggagtggtggacccaagagccatatcagtgctagcaaaatggcaganttcatatagcatcaaagttgtcctgcaagagcttcggcgcctaatgatgtctaaagaaaatatgaaactccctcngccgcccgaaggacagtgttacagcaaatatgaanactccctcagccgcccgaaggacagtgttacagcaattaatcaaaaagaaaaaccacaggcccttccccttccccccaattcgatttaatcagtcttcattttccacagtagtaaattttctagatacgtctgnagacctcnnnntncnnganagnangctcccattcaaaggaaatttatcttaagatactgtaaatgatactaattttttgtccatttgaaatatataagttgtgctat

SEQ ID NO: 671065 - DNA, 617 bp, Homo sapiens
  misc_feature (70)..(70): n is a, c, g, or t
ggcaggggaattgcttggacccgggaggcggagattgcacttgagctgaggtcatgccactgctactccnagccttggcaacctgggcgagactcctatctcaagaacaatagataaagcataataagaaagacaaactaccttgttgcgggcgctcgctgcctctcgagagaagtacttttgaacccacccactccggggattggttggcgcgcgcgcgtgtggcccacacaagattacgggataccaagacagacagtatcctgtgggccattagagaggaatagttccccacaaaagggcaagagctccgagggaaggaatcaatgatctcttatagggcgttcagcgcagtagttttctctctagatcagcctttataaataacagagcgcgccaggttggaggaccgaacagcgcgcgtcttcttcgttgagacagatacactctgcgtataccctggagaccttcccaggggaggcgctatctatccacgggggggccgccctttagctcagagaccgaggacgggagggtctcgacaaagcgcgatcacgccccggagttctccatagatatatttgtcacgcccaccgcggcgcctctggggtgggcga

SEQ ID NO: 671066 - DNA, 1442 bp, Homo sapiens
ggtgctgctgctcgtgtgccatgactcggagcagagcaaagccgcgatgtccagcgttcttccactgcagatgatggtggaggacagagctgtgtgcacgagtgacatcgagagtcgcgttggcacgagctgtcctggctgggacaagaaggattgcggcgcagaccctgaagggacaccaggagaagattcggcagcggaagtccatcgcgtgcctcctcacaccagtggcccagtgctgcccatctcccttccagacaaccgagagcgagtggattaccccgtgaggccaagaatcgcgtgggcaccgacagtgtgccacgtcagtgatgccagtgtttcctgccgatcgggacgtcgcaggagtgagccagcgggtccggtgctggcgtcagaaagatagacgaaggagacaggcaaatccgtcaaactgcggcacctgtgactgacatcagagtggttatgtgagaccgagcatgcatgacacggcagcctgacggtctttacaaagcacgctcgcacaccaaggcggacacaacacgtggcgcacgcaacgacaggggcaaagacagggcgccaagcaagcaggggcagtacctacacacctgcggtgggcaacggcaccccacctcctggagtggcaggagattcaattccgacgtgcaagtacccagaccaagatacagagcttgggcgattacaaacctctggcttgtgccaatggattggcagaaagcaaccatctcaaggaaagcccccagagagaccgcgagaggctcgtagcacacgtgtccttacttatccgaggggccctcctatgggaaccactgaatacaggaacaacagaacactttgagcagttggcagccccaggagcatatcggacaggcatccagggaaagtaagctgagaccacagtctgctacacccaccacgaaggaatgggccaggtgcgcacatctaccttgacagcatgtgacacacatgtgaggacactacagagggacaactgtcgtgatctattagagacagattacatatgcgacagaaacagagatggagatgagggaaccacacgatagcagaaagatggtagcccagagggtggacgacacacgggtaaggcccgaactacagtttgaaaccgagtaccaaaaagactacgggacgagtacaaccgacaagagagcacagggaatgacaagggaagaaccccgtagtagagggtctgaaccgacgtaaacagaatagcacaacaacaggagaggacgatacaagatagtagcggggagcgaaagcagaccaacgacgaaagacaagaagaagaagaagaaagagaggatgacatggaagaggcaacgagactaagaggcagaccaggagacagcgcgacgccagacagattagatcaacgcaaggcacaagcgtaacaggacgatcta

SEQ ID NO: 671067 - DNA, 479 bp, Homo sapiens
  misc_feature (23)..(23): n is a, c, g, or t
  misc_feature (171)..(171): n is a, c, g, or t
  misc_feature (238)..(238): n is a, c, g, or t
  misc_feature (372)..(372): n is a, c, g, or t
  misc_feature (380)..(383): n is a, c, g, or t
  misc_feature (385)..(385): n is a, c, g, or t
  misc_feature (387)..(388): n is a, c, g, or t
  misc_feature (391)..(391): n is a, c, g, or t
  misc_feature (394)..(394): n is a, c, g, or t
  misc_feature (396)..(396): n is a, c, g, or t
aactttagttcatcgcaccccgncttacaggcttaacatagaatgtggacctaaatacccagaagcaccctcctttgtgagatttagactaaaaattaatatgaatggagtaaatagttctaatggagtggtggacccaagagccatatcagtgctagcaaaatggcaganttcatatagcatcaaagttgtcctgcaagagcttcggcgcctaatgatgtctaaagaaaatatgaanactccctcagccgcccgaaggacagtgttacagcaattaatcaaaaagaaaaaccacaggcccttccccttccccccaattcgatttaatcagtcttcattttccacagtagtaaattttctagatacgtctgnagacctcnnnntncnnganagnangctcccattcaaaggaaatttatcttaagatactgtaaatgatactaattttttgtccatttgaaatatataagttgtgctat

SEQ ID NO: 671068 - DNA, 308 bp, Homo sapiens
gcagctgaggcgggaggatcacttgagaccacgagttggaaaccagcctcggcaacatagtgggaccctatctctctttaaaaaaaaaaaaaaaaaaattagttaaccaggcctgatggcacatgcctgtagtaccagctactggagaggccgggaggtggagggggctgaggtggaaggatggcttgagcctggaaggttgaggctacagtgagtcatgagtgcacaccactacactccagcctgggcaacagagtgagatactgtgtaaaaagaaaaaagaaaaggaggggaaaggaaagaaaatg

SEQ ID NO: 671069 - DNA, 926 bp, Homo sapiens
acacgtatcctgaaaactggagggccttcaaggctctcatcgctgctcagtacagcgggggtcaggtccgctgtgctctccgcagcacctccacttccatttggggcaatagcaaccgcacccctgaatttctccgcaaatttcctgccggcaaggtcccagttcattggagggtgatgatggattctgtgtgttcgagagcaactgctcattgccttacttatgtgagcaatgaggagctgcggggaagtactcgcagaggctaaggcagcccaggtggtgcatggctggtgtgatgcttcgctgattccgatatagtgcccccagccagtacctggtgtgttcccccaccttggggcatcatgcgaaccacaatgaaagcatggccactgagaatgctagatgcgaggacatgtgacgtgccgaattctgggcggctgctggatgcttacttgaacagactgagggacttttctggttgggcgaacgagtgaccaattggctgacatcacatgttgtctgcgccctgttgtggctctataagcaggtgctagagccttctttccgccaggctttcccaataccaaccgctggtttcctcacctgcatttaattcaggcccaggttcccgggctgtcttggggggacgctgcaactcgtgctgcgaagatgggggcaggttgatgctaaaagttgcgaagagcccaagcttaaaaggagccccacggaagagaaacggtcccggagagaacagaaaacccaggctgtgcggacggggtgacacacgggggtgcccccgccctaggagggaagggcttaatcttttcacgcggcgggtgctggccacgggcccggaccccctgtttactgcccaaaaccttttgggggatgaacgcggccccaggaaccagcggcggcatttcacg

SEQ ID NO: 671070 - DNA, 248 bp, Homo sapiens
aattaatcaacgtacctcgaatttataggtacaaaagtacccgagatttagttactataatatatacagactaatacagacattaataaaaagacaattctgtagacatttaaaaacagccagctagctaatataagcaaaaatactctataagcaatcaggtgacatatatcatctctattttccaggccgagggaccctgtcagatgagcatgctggagtgatatctgttctaagcccagcaagca

SEQ ID NO: 671071 - DNA, 138 bp, Homo sapiens
ggtcctcacctatcgttggatgggctacagcgcatctcaccctaacgttcatttcatcggggaacgatgaggagaaggtttcctatcggtgcatccgcaactggaagcctttgtagcgcatggagggttgaacctctg

SEQ ID NO: 671072 - DNA, 155 bp, Homo sapiens
gtgctgtggtgatgtctgctcccaggattaggaggcagaaggagatcccttccacggtgctagcgtgagatggatcctctcagggcccaacagctggctgcggagttggaggtggagatgatggccgttttttccaacagattgaccagtgcttg

SEQ ID NO: 671073 - DNA, 1329 bp, Homo sapiens
ggtgagaacaccacagatttgtgtatctggttctgtactaactatcaagattatctcgactccttactctactctacatgatccatatgctctgcctattgaaacctgctacattcaccctcagttgtctgtgtggcaccacattggcatccagtacgggctcatagtattcactcgtggctgcatgtagcatggcatcgtcaaaagattagtattgtctcaatcggtcatccagactgtaagctcgaggcactcagacgccactttgcgttggggtgaatttttacataccagtcagaggttcgttcatggtcaatctctctgatattgacttcgtactgggatctcaagcctactcggtgatcaggtagctcgactttgatcgacatacagtaggatgtttcaagagcacgatataactacgagcttgaactactctactagtgagactcatgtagaacaccgtatgtgttcccctgtatttagtggtataccgcgtctggaaaggggcatgcaacaaaacttcgtaatctccgagtctcattaactgtgtctacgtcccactacatgggccatgaccacacccttgctggttgcaatcatgcctgactataccctcgaggcttcgttcgccttctgggaatggacgccatttccacgactcagatcgaaggcccacagtatgttggaaaggttggtcctgtcgataacagttttgaagctatgcgtaccccaccgtgggaaatggcgccgatggcaacgcacgtgtggggtcgccaattggcggaaatgtgcccacgtatttgggcttaaaactcggccccggttatccataggggacctgtgagacaggtttgcgaatgtagcccctatctcgagcgaaacaccacgttgcccaaagaagcaaacagcaccaagcccaaagccataaggtatactggacagggcggcaatgcgagggcccataagtaccctttgaaaggcccctttgaaacccggctcaccttgcacacgcgaagtttgcgcacaaaagttttctccccaagcgaaggaataaggggccttcatctaagggttctcggacccaaagaggattccatcgcggctatttttgacacaggggggccggccatacccttgcgtgggtataggacacaagaacgcgaaggtaggggggacccgccatattcgaggtaaaaagtgggttcttccaacttaggaggctggtttttcccttatataaaccacgcttctctaaccccgccctccacgccttggctgtggggaaagaaacttacggaggacgcttggcaagggaaatccccccga

SEQ ID NO: 671074 - DNA, 703 bp, Homo sapiens
cgggacggagctgagcaggaagagccgtgcgccatggtggagaaggaggaggctgacggcggcattagcgaggaggaggcggcacagtatgatcggcagatccgcctgtggggactggaggccctagaaacggttgcgggcctctcgggatgcttcttgtcggcttgaaaggacttggtgctgaaattgccaagaactctcatcttggcagtgagtgaaatggactgatccatgctgtatcacgtaacaggtaactcctagaagatcccggagtctcagtttcttgattcgtactgggtcttgttggccgatatagggctgaagcctctttgtagcgagcgtcagaatctacaactcccattggtgtgagtgtgagaggtggacactgaggactatatgaccgaagcatgactcggagagatcaatgatatgtgcactactagaatttccgactgcgtcgttcgctgtcttgacgtatgctgctgccatggttagtgctcatagattaagaggtatgatcatgaatctgtgatcacaaaattagtatctatacgttacattatactagtgatgatgtattatggctaaccatgtgagatacacatttggcacaatctagagagagcatggagttgtgtaggaggaagaaaacgtagaaagtttgcccaaaggggttaaggggcaaggaggtaggaaagatggg

SEQ ID NO: 671075 - DNA, 463 bp, Homo sapiens
  misc_feature (376)..(376): n is a, c, g, or t
  misc_feature (400)..(400): n is a, c, g, or t
gacacagacccagaccatatcagagtctgcataggaggatctttcctgctcaggaagatggtcaaacctcatagaggtagtttcaaaccacaggacaatttctgtgtcttcacagagaagaaagcactgttaattcctgtttttacaccctgaagcagtgcaccatattaagatacagtgggacttgagctattcttctgtgaagaggaggagggcaactgtgaaagaaatggcttgactgtaagatgttctcagtctaaccaattttaggaaagaaaatatgtgaaggcagaggatccaaagcgattcccttcaaaccatcctaccccatgggacaccctttgtgaactccctaaggtaacagcagtccagaacncagatgacctacaggatttctgtncctttccagctttttattttaccattgatgcttcctttctcctataaaggaaacaacagcttc

SEQ ID NO: 671076 - DNA, 191 bp, Homo sapiens
gtagccagcggctgcatctgaggcggacgccgcagtgtagggcacaccctgagggtagccagaaacgttgaccaagacccgagcaacttaggggcttgcagctcctctgttcccaaccgatcccaagagagaggctgttagtcttggacttggcgttcgcacccctgagagaaggggtcaaagctcccctg

SEQ ID NO: 671077 - DNA, 976 bp, Homo sapiens
  misc_feature (976)..(976): n is a, c, g, or t
agggctcgccggaaccccgccgggcgcaccacagcgagcaggggggggtgctggctcgcgatccctgctttatttaaattattcggtaattttagcagtacaaaatctttgactatgaccatgggacacagacatgagtttatgttttggtttgttttggtctggggatcatgtacttttctaaatcctctgcacttcctttcattaacaaatggcagagtgcccgaagttcctctattattcatagaaaagaaatttgtaaggtaagactgaaaaaataaaatctacagattcacggaatgatcttccaatattaagaacatacaaagtatactaaagacgtctacatttagtgctccaggtaacaaatcaaacatttggacgttggacgtccctgtgcctatttcttggtaaggacagcacagataccaaggtgtgggcgaaagctaggaaaacgcgtcacgggcgctcctaggggtggtgtgagatgaatacacgggatggagttattgtgagcgccttaacaactttcgtttaagagtggcggggatggcattatcactaataggacaggggggatggggaagagggggaatgccactttgggcgtcgacggagtggtcttgtaggaggcagtggctcctccaggggattctatatctgggccggggcataagaaatatgagtgtgatggtagtgtcgcaactgagtcgaagaaggggagccgtaagtagggtgtggcgccgaaaacaataggggggacggcggtgacacaaaccaggtggggggggtaacaaaaaacaatataatacgtggaccggatgggatggggtagacacggggaggtcgagtggacataccggcaagacgggaatcgataatatgaaacataaaaaaacggggcggggacaacaaccagggggggcaatacaattgatcactggaataagggggtcatatctgcagtcaaaccggn

SEQ ID NO: 671078 - DNA, 515 bp, Homo sapiens
agaggacccgaggaagacatcgtggaacagtcgtgtatccgacttagagctggagctctgtttcaggatcgtgctgccagacttggaaagtcaattagtagactcatcgttgtggcctcgctcatcgacaaaccgacccaaatttaggagggacctgtgccaggacctgtgagggtatttgggggcttcagtagctcgtatgttggcagcctttcagtgtatcaggcgacaaaacagtttcagccacctcagtgttctctgcagaacagtgggcttccctctagttggaggtaaaaccacctcagctaattgattatctgccagcagaagaaaacagaaggttataccatccattgggagtggaacacaactgcccaaaagttaagaccttaaaccaattatttgctttcccttgagaaattctctgcctcttgttggggaaatgacacgttgaggggaattcccaggaaatcttgatccaacaggttggacgtatgtgtggaaattactcaaac

SEQ ID NO: 671079 - DNA, 105 bp, Homo sapiens
ggatttgctggtgcagtacaactaggcttaatagggacatgaaacaattctcagcaaattaaaaaaaataaataacaccaatcacccgctcagaccacagcaaaa

SEQ ID NO: 671080 - DNA, 105 bp, Homo sapiens
agacggccaagaactacttcaaaaaggcctgaaggatatgggctatgggactggattagcaaccccagggggaaagaccttttatcttcccattatagtatctcc

SEQ ID NO: 671081 - DNA, 313 bp, Homo sapiens
gccccacaggaccccctggaacagttcggcatatccgaggaggccaggttccagctgagatggcttgcaggcgtgagcagggcacggtggtcagcgtgcagcggacgggactggccctgccagccatgaatcgcttggccatgctcgatctgtttgtttggtttttggtttttgggtagggttcactgtgttgccaggctagagtgcagtggtgcacagctcactgtgaccttgacctctgactcagtgatctctgcctcagcttccagtagcgggatcacagcatgagcgcacaccgccatcacactgattt

SEQ ID NO: 671082 - DNA, 279 bp, Homo sapiens
ggatttgctggtgcagtacaactaggcttaatagggacatgaaacaaccagtttttaatgtaggtgaaaaacagccttctattggaagaagatatcatctagaattttcatttctggagagaagtgaattcttagcttcagttcttcaaaggaaaggctgactgttggggctaatgtgtctggtgactgagttgaagccagtgctcatttattattccagtaatcctagggccttaaaaattatgctagatctattctgcctatgctctgtaaacaaaa

SEQ ID NO: 671083 - DNA, 246 bp, Homo sapiens
  misc_feature (3)..(3): n is a, c, g, or t
  misc_feature (200)..(200): n is a, c, g, or t
tanctttctgtgtgcttaggtgcccgagctactgagggtctaagtccgggcagccgaagagtgtggtaggccctcgccgcggtgatggtggttagcaagatgaacaaagatgcgcagatgagagcagcgattaaccaaaagttgatagaaactggagaaagagaacgcctcaaagagttgctgagagctaaattaattgnatgtggctggaaggatcagttgaaggcacactgtaaagaggtaatt

SEQ ID NO: 671084 - DNA, 389 bp, Homo sapiens
tcataaccttataaatctacctggtgttctgtcctcctttggctgagctgaatctcgattcatgagacatagttactttccactcttccctcccctttctgcaggcagtggagcttcaccctatgaccactaccatcacaggcccacagggtcactgccagactaccactgatttttgtttaaggcacaggggctgtttggtcagcttgtcacgaatgctgccaggcctagaacctaccctttatgtctgtgggctcctatctggctcagggcaggtccagaaatgctatccaagagtcaaggcctggaatcttggacctcaagagctgacctttacttctctgtggccagtctgttacataaggtgcaagacaaagccccctttactt

SEQ ID NO: 671085 - DNA, 243 bp, Homo sapiens
cgaacctagcgtgagggctcctgcagcaccaggggcagcactgcacccgtgtgaaacttctggagagctgcagcctcaccacgcctcggggctcccttcgctgctttgtagccacccatagtttggagctaccgagatgagagcacagggggacattgaacagagcagattcttcatggatgcacagtcaggccccaccactctctgcagctgaacagtctcagccatgtacttgcgtcccag

SEQ ID NO: 671086 - DNA, 299 bp, Homo sapiens
gttccaagttgggggtttttttaaaaattaaaaaaaaggaaagcttttttgttttgccccctttccccatttaaaacctttttttcccttttcctgggatttttgaaaataaacccttgtgtgtcctgtagtgtcctggtttaacccccccccaccagcttccccgggggggtttggaacccctgggtttgtcccccccccccctttggggggggccccaagggcttttgggactggggtttgtacccccttgtttggccttttttgtggttgatgctgtaaactttttggctttttta

SEQ ID NO: 671087 - DNA, 342 bp, Homo sapiens
  misc_feature (307)..(307): n is a, c, g, or t
tgtattggtagggctcgctgcttctcctcggcggcctgatgtgctctcaccaggtggccggtctccacgtacagttccttcagcagaaggtcgaacttcgtgttctttccaaactgctccttcagcttatccactttctcttggaggagcatttccatattcttcagaatcatctccgcctcttccacccgctcttctgtggcttacagctgatcctcatgttcttcccgctgcgcatccaggcgcctcctggcctgctctccctgaaggctgagcaggcgatgcagctcggccacacggtcctggngcaccagccagacctcctgcaagtgctgggcctgg

SEQ ID NO: 671088 - DNA, 242 bp, Homo sapiens
agtgactagaggatcccacctcctaccacgaatagccagagactctctcaacagcacgggtgtatacctctgctctgacctggcactataatgaactgcttgaatcaagcttgtcctacccacgggccacatgcagaccaggatggctgtgaatgaggcccaacataaattcgtaatctttctcaaaacataatgagatcacgatggcaatctgttttgtctttttccgtggggtaggaggt

SEQ ID NO: 671089 - DNA, 119 bp, Homo sapiens
gagccagagcatatatcactatagagtagatagtaggagagtctgtctcctgtagtaagagttaggaggtcgtctgtccttgaaatagtagtgtgtaggtagatgctggtgtaggctcc

SEQ ID NO: 671090 - DNA, 854 bp, Homo sapiens
gttgtgaagtagaaactgatttctaattgacttcggctattactaaatatgtgacatgcatgcacttctttttaattgaacagtatgtttgctgctgttgtatctcagtttgaaagtagtaattgatgaataagaattcctagaaatattcttcttccataatgatatgtcacagatgttgtgagtgctacgacacacactccatctccattggttaagtcaagtttagtggacgataaacatgtagataatagctgtgtgtggtaatgactctggcccactcacccagaggctcgtgtatttccataagttatgggacccctctgatctgtctgaaatggccaccatcagatcattgagacttgacatgcagtctaaagatgtgtgtggtctgagatttctatatactgatttgtgaccagcagaataacttgtgctgtttccaaaaccagattctttgtgcctcttatagaagccagatgaacaggaggaagctgtgaccttaaatgtcatgtgctttaatgcttagttcctttaagaaatgtatacttttatcatggtgttatagtagaagatttggaaaattctgagaagtgtcagaagaagcagatagtcatcagtggcacacgaatgcgcccacgcaagccagccaaaaagttctagagaccggctttggcccagcccccagaggacagtgacccaggacaaaaagggccacggaaaaaaccggagcatcacaagagccgagtgctcaccacaaaagagacccggggaaacgaaagtgttgacaaatcccaagagaagtccggggccaacagggacatcacaaggctcaaacaagcgcaagaaaaacg

SEQ ID NO: 671091 - DNA, 830 bp, Homo sapiens
ggacttagcgttgctggtccatgtatagttccggcattctcagtatctctctctgacactagcctatggagtggttcccacagagagcgtactatgcgagctattatgtgcatgtgcgtcctatgtatgggtaataaatagtgaggtttatacaatggaaagcgatgatccatgagatggttggcctggagagaattcgggctgtagaatattgccacagaactcaggcgcacagcagaacaggtcatgatcagttccagaagtggtcctgggtgatgagccgggtctgggacaatggttatccttgggacatgctgctcgtcagtcgatttggaaccttcctcaagaacaagaataccgagcagccatctctgactggttgtacatgaagcagatgaatgcaaaggattcaagcatgagaactatggcttgatgcctttaaagtggagtcctgaggaaagagcctgtatttaacgatgagctcccagcaagcattctgtgtggcattgtgtccgtaaagcctaacgtgaaggaattcacaggagacctcggccatattgagaggaattggagaccatatttgagggcatagactgtgtaatctttgcaacagggtatagtattgcctaccccattacttgatgagtctatcatcaaaagcagaaacaatgagatcattttatataaaaggagtatagcctcctctacattgagaagtcaagcataggcagtgattggaatagtacagtccctaggggatgcattcccacagatgactccagtcctgtggggcagcacaaggtataaatggaactaaactaggcgtctag

SEQ ID NO: 671092 - DNA, 186 bp, Homo sapiens
  misc_feature (39)..(39): n is a, c, g, or t
  misc_feature (125)..(125): n is a, c, g, or t
  misc_feature (128)..(128): n is a, c, g, or t
  misc_feature (154)..(154): n is a, c, g, or t
  misc_feature (176)..(176): n is a, c, g, or t
ctcactatgttgccaggtgtcttgaactcctagcctcangcactcctcccaccttgggccacggaagtgctgggattataggtataagccaccacacccagcctctgttcaagacttcatatttnttnttaatcatccagtcttgttaggttgnatgtttcttagaatttatccgnttctcctaga

SEQ ID NO: 671093 - DNA, 109 bp, Homo sapiens
gtttctagtcaaacccaaagtctcactccttcatctatacattctcttcatctgtcccttgtccaggagtggggaccattgtagggttgctcagcattcctcgcaacag

SEQ ID NO: 671094 - DNA, 800 bp, Homo sapiens
gagtagagtggggcgtgctgaaaagatacccgaaaatatggaagggactttggaactgggtaactggcaaaggctggaacagttggagggttcagaagaagacaggaaaatgtgggaaagttggaatttcctagagacttgttgaatggcttgacaaaaatgctgctagtgatatgaacaataaggtccaggctgaggtggtctcagatggagatgaggaacttgttgggaactggggcaaaggtgactcttgttatgttttagcagagactggtggcattttgcccctgccctaaagaactgtggaactttgaacttaagagaggatttagggtatctggcggaagaaatttctaagcagcagagcattcaagaggtgacttgggtgctgttaaaggcattcagttttaaaaggaaaacagagcataaaagcttgggaagtttgcagcctgacaatgcaatagaaaagaaaatctcaggtgacattcaaggcagctgcagaagtttgcataagtaatgaggggccaaatgttaatccccaagaaaatggggaaaatgtctccagggcatgtcagagatcttcatggcagccctcccatcacaggctgcaggctaggaggaacacagggtttcatgggcgaggcccagggtccccatgctgtgtgaagcctagggacttggggcctgatctcagcgctctagccatggagaagggggcaacgtaaaggtcagcatgtggtccgaaggggaagcccagctggcagttccatgggtgaccgcaggccttccacacacgggcg

SEQ ID NO: 671095 - DNA, 842 bp, Homo sapiens
  misc_feature (35)..(35): n is a, c, g, or t
  misc_feature (71)..(71): n is a, c, g, or t
  misc_feature (124)..(124): n is a, c, g, or t
  misc_feature (140)..(140): n is a, c, g, or t
  misc_feature (152)..(152): n is a, c, g, or t
  misc_feature (159)..(159): n is a, c, g, or t
  misc_feature (220)..(220): n is a, c, g, or t
  misc_feature (225)..(225): n is a, c, g, or t
  misc_feature (246)..(246): n is a, c, g, or t
  misc_feature (254)..(254): n is a, c, g, or t
  misc_feature (260)..(260): n is a, c, g, or t
  misc_feature (289)..(289): n is a, c, g, or t
  misc_feature (291)..(291): n is a, c, g, or t
  misc_feature (295)..(295): n is a, c, g, or t
  misc_feature (297)..(297): n is a, c, g, or t
  misc_feature (299)..(301): n is a, c, g, or t
  misc_feature (326)..(326): n is a, c, g, or t
  misc_feature (355)..(355): n is a, c, g, or t
  misc_feature (376)..(376): n is a, c, g, or t
  misc_feature (395)..(395): n is a, c, g, or t
  misc_feature (438)..(438): n is a, c, g, or t
  misc_feature (500)..(500): n is a, c, g, or t
  misc_feature (767)..(767): n is a, c, g, or t
  misc_feature (808)..(808): n is a, c, g, or t
ggccagggcaaagggaggcaacagcaggagggacngaaggcattcatcatggatttgaaaggtcaggcttngagaaaattaagccctaacattagcccagggcaaccctcatatgtattgaggnggcttcttccctgganatcaagaatggngcaagtngtgtaccctccttgggagaggtaaggaattagtcacaccactcatttcggtgcttggaatncagangagggggcgggaggagaaaanaaagaaanaaagantaaggggggcaagggaggggggaaaggananggangngnnnaggaggggctgctcaggtttgctgngaagagtggggaggggagaccctctaggnaacagcagacacactacagtnacagtgacttctatgagcntacagcatgggctattgtgcagaattgattccaacaagcctcncttcttggtcgtttctaagctcctctcatatgggcctcgaattcagattggtagcgtaaacnacgtaaatgatgccagaacaactctgttctcgttgttggaatggaaacaaaatgagggtgcccccaaggcacttcagacacctagacctccacctctaggacctgctggggttggccactcttcccatgaagagcaggcagcaggtgcgatgctcgtagatgaggaaaagaaaggggcggtcgacagtgaagcggacttgggtggacagcggcatgaaccccaccgtggtcacagtggtggcttgggtgccttcctcgttcactgtnatcgtgccttggtgcttgaacaggtcgatggcgatcctttngtcttagatgcctgccatgttgtcatttttgtta

SEQ ID NO: 671096 - DNA, 729 bp, Homo sapiens
tggaaacggatctcgctctgtgcccaggctggagtgcagggctcaatctgtggctcactgaactctgcctcccgggttcagccattctcctgcctaagcccccgtggggtactggaattgcaggcgccttgccaccatgcccggcataattttcaaaaacttttgaggataagaagacgggggtttcaaccgtgtgttgggccaggatgtggccctcagaacctcctgaggacctcggtgattactacacccgcgcttgttggctcctccccaagaagtgccgcgagtaaacagcagggcgaaagacctaacccagccccgggcgcggtaccatccatttattgtatttaaagacccgattgaaccactataaacaatcagtatgcgccgcagtggataaggcgcctcttatgcgctaggtcccccaacaccttaggacaaggcccacaagctgggagggcaatggccgcaacacggaaggacttttcagaggacccccccgtggggcaaacaatggccaaaccctcattctccgaatgaaaaaggttatctccccacgctggacaactcccctggaagaacggtacacctggacataaagcacactcttcaattcaaggcgagtagatagatacttcacgccctaaacgtcgacagaggcacaacagaacattctatacagttccgacgccaaacaaagaaaaacacacgctccgccggggcgacacc

SEQ ID NO: 671097 - DNA, 160 bp, Homo sapiens
gtaaggaggagggaagtagtgacttcaacatgtgctggctgcggcactggccggtggctactgtgtgacgtgtctggcccggagcgggcagagttggaggtggtggcgtcgctctccctaggggctgtcgggacgctcctctgtgggaccgagcctggga

SEQ ID NO: 671098 - DNA, 644 bp, Homo sapiens
  misc_feature (482)..(483): n is a, c, g, or t
  misc_feature (495)..(495): n is a, c, g, or t
  misc_feature (517)..(517): n is a, c, g, or t
  misc_feature (521)..(521): n is a, c, g, or t
  misc_feature (525)..(525): n is a, c, g, or t
  misc_feature (527)..(527): n is a, c, g, or t
  misc_feature (539)..(540): n is a, c, g, or t
  misc_feature (545)..(545): n is a, c, g, or t
  misc_feature (550)..(550): n is a, c, g, or t
  misc_feature (563)..(563): n is a, c, g, or t
  misc_feature (584)..(585): n is a, c, g, or t
  misc_feature (596)..(596): n is a, c, g, or t
ctgatttcccccccctggaaaaaatagtatggcctcccggtggaccaggtgttttgtcccagccaaagatagtaaagtgggtcagccattgtaaccacgattaggaggtttaaagatccgcctttggatgggaggaattcaaattctggctgcgtgctttttaatattgatatgcttaaacactcccccttatgccccaaatgtaggggtataataatgttaacaagggcatgatcctctttataattctaccttgagggccgtctccaagtttgatggattttaacagggtgctccccaggtagctttaggagggctggccacttaaaggtggggagcaaagaatttttttatcccacatcaaccttttgggcagatttggacttttccattttttgccctcaaagcctgttaaaatagtttagcgggcataaggtaacttcccatttacaaactctgcttaaaatttggggggaaatttnnaaaaataattgnccgggtttttgggaatttgttntaangaangnaaccttttgtcnnataanattcntattttctttttntaccttttataaagtaagggnngggtgggggtnatttgggttttttttgttcccccagtttaattaatccttaaaccttga

SEQ ID NO: 671099 - DNA, 254 bp, Homo sapiens
  misc_feature (56)..(56): n is a, c, g, or t
  misc_feature (119)..(119): n is a, c, g, or t
  misc_feature (135)..(137): n is a, c, g, or t
  misc_feature (149)..(151): n is a, c, g, or t
  misc_feature (154)..(154): n is a, c, g, or t
  misc_feature (186)..(186): n is a, c, g, or t
  misc_feature (194)..(194): n is a, c, g, or t
  misc_feature (203)..(203): n is a, c, g, or t
  misc_feature (211)..(211): n is a, c, g, or t
  misc_feature (218)..(218): n is a, c, g, or t
  misc_feature (231)..(231): n is a, c, g, or t
  misc_feature (246)..(246): n is a, c, g, or t
cagcatgcaagagtttttcctttaaaaaaaaaaaaaaaaaaaaaaaaaagcaatgntttctctaaaatcaaagagggagtcattttattccaagatgttttatcttttatgttaagggntcaaagcttataattnnnttttttaatttnnnaangagggatcaactccagtttccaatgtctatgngtctatgngtgtatgtnccatacanatgattnacatgaggccggnatggccaagttcttntggggggg

SEQ ID NO: 671100 - DNA, 904 bp, Homo sapiens
taaaaagggggttttttttttttgttttcccttcccccccccccccgggttttccttttttttgtgaaaaaatttttttttgggcctgctgttccccctctttcttcttctattctcttattcttccccctccacgccgggggggggcagggggagtgatgagaagaaccaccagcagcccaagaaatattaaatatcgtgcttcactcttctcgtgggaccaccaagagagaggagcacaaacaagaaggtggggtgtggtgtctcacacccccaccaaacacagtgaagagaagaagacaggggggcgctcttcttctataatatatactcccccctccacttattcactccacactagtccacccaagagagagagtgtggcgccacacctgtgttgtgtggatgggagcgcaagtgaggcgcccacagagattgtgcgctcatcacacaggcagagagagagagtggtatagacaaatctaatataaaaaaaaaaatatactttctcacttatatcatatataagattgttgtggtgtgctcaaaacaaaaaaaatataaataaaataataaaaaaaaataaaataaataaaaaagaaaaagaaaaaaaaaaaaaattgacacctgcgcgggcgacatcactataatgagcggagcgaagacgagagaaaacaaagaagagaataaagactgacgcaaacggtaagagagtgaacaaaaaaagagacaaccaacgacaaccagccctagtatgttgtatgacaaaaagaaggagaggaaataaaaacacggcggaggacccccccaacgaagggggggggaacgaaaataaattaagaaagacagcggacggctccaccaaataaatacacgagcacccagccaaaaaaagagaagggag

SEQ ID NO: 671101 - DNA, 892 bp, Homo sapiens
aaggctgggtgtgcggctcgcggcgcgtggaggctgctccctaccgcgcgcgagtcagactcgggtgggggtcctgccgcctttgcctgcccgcgcagccctggtggcctgaggtgctgtgcgtgtggacctgcggtgttggtgagacctgtgcctggcgcccaatggacaaatggagcaacttcgaccccaccggcctggagctgctgccgccaaggctggctgctgctgagctggatgcactctgctgttatgccaatggactgccctgaatcttggcacatgattgcatgtgatgcatgactgctgcagtttgtgatgcaacatgtccaatgctcaaatgatgtatagatgtgcctgcctgtggatgcagctcaatgatgctgagcatgatcctggggctgcatgtgcttgatgtgatgatgtgaggtgaatgacccttgagctgatggatgaccctgggcatgcaccatgtgccagtggcccagtatcaagacaagctggccctgggcatgctgctaccgatggaccaactgaatgcagcagcaacttctcaatgagtgagaatttacgtgaagcagtgaggagtcctgtgcaggaagcaggaagccatgcggcgagccaccgtggagctgggagatggatgctgctggcacaatgaatgagatgctgcgagtggaggccgaggccctggtgctgctgcgccaaggcctgagcgggagaatgcagacatcatcctgcgagcagatcccgcctgaaggcggctgagcacctgtcagacctgtcttggagtccatcatgacggctggcacttgtttggggaaggatccgtgctttgtgacagactgggacaatgtgacagcactgtgttggctgaccagtggctgtgggc

SEQ ID NO: 671102 - DNA, 136 bp, Homo sapiens
cgacacatcacacagtagtactaccaaccaccaccatcacaccagcagtaatactaccaaccaccacatcacaccaacagtaatactaccaaccaccagcatcacacaccaacatgtaatactaccacaccaccag

SEQ ID NO: 671103 - DNA, 263 bp, Homo sapiens
ccacaagaggacttacttaagctcaccttcacggtgtacaactaataaaacaacatggaagttgcaattccttgcctccactgtgagacaaaccccagccacatctccagcacacaacaacttccaaatgcctgaaccgcagtggccattcaacgcctccggccattcaacgcctccgggccattcaacgcctccgggccattcaacgcctccgggccattcaacgcctccgggccattcaacgcctccgggccaattcaacg

SEQ ID NO: 671104 - DNA, 361 bp, Homo sapiens
gtattttttttttttctagtacaccttgtaattttttattgaaagctgggcatgggccgggcatggtggctcatccgtagtcctagcccttgggggaggctagccaaggtggattgcctgagttcaggagttcaaaatcagcctgggcaacatggtaaaaccccgtctctgcaaaaaaaaaaaaaaaaaaaaaaaaaatacaaaaattagctaggcatggtaagtgcgtgcctgtaggcccagctacttgggggggctgaggcaggaggatcactttagccccggaggcaaaagttgcaatgagctgagatggcgccactgcccttcagcctgggggacagagtgagaccctgtttcaaaa

SEQ ID NO: 671105 - DNA, 152 bp, Homo sapiens
tacttttgcacagggaacaaaaggcatcctcaagcttttacgtaatgctggtgtgcttagcgacgtgctgaaagttgactgtgcttgtgtcgtgaatgccaacatgaagagacgttattatggttgtgtgttgctttcagctagatactcct

SEQ ID NO: 671106 - DNA, 478 bp, Homo sapiens
agaccctgtgactgtgaccttatttgagaagagttttggcagatggagttaagtaaggaagttgccttagatcaccacaaggcatgggttcagatcctcgtatctggagtgctccaaggagaacttggaagggcagagtgcagcaggactttctgcgggcaggagttgaacatggtccagctggtccagaggcgggcagacctcacgtggaagggatggtgatggcttctgctaccgtcagtgagctgaaggagagatctgagacacagacatggggggaaggtcccgtgcagatggaggcagagatgggggtgatgcagccacagccaaggaacatgcagaaccaccaggagctaaagagcctagaaagtcctcctcgtgacctttctgaagggccagggctttgctagtgccttaacttccgattctggccttcagaactgggagagaataaattttgttgttttaagccaaaaaa

SEQ ID NO: 671107 - DNA, 123 bp, Homo sapiens
gctgactccatcttgcttctaaactcacaaactcttggttcatccctgggcataggccaagatagctattggaagaaattagtttatagtttaacccttaaagcaggatgataatagcctctt

SEQ ID NO: 671108 - DNA, 194 bp, Homo sapiens
ccatcgggccgtcacggccagccgcgagtcacactcaaacgggttcccactcaggttgatttcacttaaattaaataaataagcaaatataccttcttctaacgtagacatcttgttgtggcatatatccagctctgccagcgctgagagtttggccaggagcccaaggtccagcgccgggagcagtcccactt

SEQ ID NO: 671109 - DNA, 244 bp, Homo sapiens
agcctggtgtggtcatcgacggcggcgtggacgtagtcgaacccgatcgggtacgcgtcgtggcgtgagcgatggttcgcgttcgtccctccttgaatccgccgatcctctgccgtccgggatgcggccgagtttcttcacatcaatgtggacgagatcgccggggtggtcatgctcgtaacggttcgtggcgcgggtcgcgcggatcaccgtgccggtgatcgggtcctgccatgccaatggc

SEQ ID NO: 671110 - DNA, 180 bp, Homo sapiens
aagcagaggctggaaagccacttcttatgaataccataggaaagaataaagtattgctcgcgcctgtgatcccagcactttgggaggccgaggagggcagatcacgaggtcgggagttcgagaccagcctggccaagatggtgaaaccccatctctacttaaaaaaaagcattgcggccg

SEQ ID NO: 671111 - DNA, 166 bp, Homo sapiens
gagagaagctctcactctgtcacggctcactacagccttaacctctagggctcaggcaattttcccacctgagcccccgcaagtatgtgggaccgcggatggtgcaaccacacccagctaattctttaatttgtctatagaaatggggtctcgctttgttgcctag

SEQ ID NO: 671112 - DNA, 486 bp, Homo sapiens
cagtctgtaacgtgagtcctgccagagcagcttgtcctccaagaaggcgacggtgggcagcgtcaggaccagcgtctggtgcttgagcatgctgtgcacatttaagccaacagccgggatcaagttgaaggtcttaagcctagaggtggcctccacgatgctctgtggcatctcctcgtgtgttaagtccacgaggagtacggagtccccccaacggcggtagtgccccagctctgtcaaggacttgggggcttcgggggggcagctctaaggaagccatgaattgccaggtcgttccgggccccccttgaccgtcaatggccccttttgagcccccgtcccgaaaatcttggccctcgagggccccaaaatcccctttaaggggggccgaattaaaaatcctaaaatcaatgtaataaacgtgtttcccgggttgaaaaaatggttttcccctttccccaatttcccacccaaaataaccaaacc

SEQ ID NO: 671113 - DNA, 139 bp, Homo sapiens
  misc_feature (9)..(9): n is a, c, g, or t
  misc_feature (33)..(33): n is a, c, g, or t
  misc_feature (45)..(45): n is a, c, g, or t
  misc_feature (77)..(77): n is a, c, g, or t
gagggggcncgggagtggggagaacggaaaagngaagggacggtntggagggacaaaaagcggcggccaatcctcgncacactgatggcccttagcagggtactcctacctatctccccttttatagtaataatggtat

SEQ ID NO: 671114 - DNA, 166 bp, Homo sapiens
gtcttaagcactggggcctctgtggaccttggcctcctcgtggacctgggcttcgtaggtgagcactgcagcctcccatgggcattcccatccagcgccagcaccactgcaacatatatgacctgagtgctattgtatttcaggcttgtgtgtgtatgctacttca

SEQ ID NO: 671115 - DNA, 273 bp, Homo sapiens
gggaggggtgatagaggatcccaccaccggaactctcacggctgacagagtcacgagatcccactttgggccacttcttcatctcacaccactttctccttccctcacgcagcttgcagccatgttcactttttgattctttgcactatgcgacaagcactcaggggctctcggcacatgcgtgtttcttcatacttgacttacgctttcccaccagattctgggtatggactgaacagctggctgagagctcgcggctggtggcggtaccga

SEQ ID NO: 671116 - DNA, 165 bp, Homo sapiens
aaaaaattttttaaaaaccctttttttttttaaaaccgggccccctttttttgttttttttgggggaaaggtttaaaaagggccccctttaagggggccctttttgggtttccccccccaacccaaaatttttcccccccccccctttttggggggcccggggga

SEQ ID NO: 671117 - DNA, 106 bp, Homo sapiens
tgcaggctggtactgtctggagttatgggatgggaatagccgctcatgtcgagctaacggtaacggtgtggggccgcgtgcgatgccgccgtggcgccttccccgg

SEQ ID NO: 671118 - DNA, 255 bp, Homo sapiens
  misc_feature (1)..(1): n is a, c, g, or t
  misc_feature (79)..(79): n is a, c, g, or t
  misc_feature (88)..(88): n is a, c, g, or t
  misc_feature (188)..(188): n is a, c, g, or t
nagtgcatggctgcgatgtggtgttagtgattgggtttcggtcgctctcccgtgtatcccgggctggtattttgctcgnaccagtggntgcccaagggcaaagtgggcacgagagggaagaagcagatattttgaagagaacagagagactctgaagttctaactgcggatcatacttggggggcaantggcactttaacttggcttgttgacgtttggtccttctttttaactcaatcttgcctcagtttttgg

SEQ ID NO: 671119 - DNA, 796 bp, Homo sapiens
tgctgctcgcatctgctatagtggaggccggagcaagaacaggttgaacagtctaccctcccttatcagggaactactcccgaacctcgtggtagcctccggtaaacctaaccagtcttctccgttacatcctgagcatgtgtctcctctatctctagggggccatcaattgtacatcactataacaattactcaataataatacaccctcccttgccctataaccctataataccatagaatcgcctccatctctacgttctgatgccgttcctaaatcgatcagacatggtcctcacttcttccattatctcgtcccaggtcctcagactgtctgggcattcagctatatcataccataacctatgaacgctgccaaaccatcacactaccaacctctcttccgacacccaggccggcagtggagcgaggatgctcgcgatgtactaataactcagacaacactaagtatgctcgatatttcttcggtgttcaaccctgaaatgtttgatcattcagtatccataccacgggcttctggaataagtctcctcatattgtagacttactacatccggtatagacaatagaggagaccactttggggatacagttaaggtattggctctgaagtctatggagtattcaatttggacttacctagaggtttttaatcgtcgtgtagtccatcagccagtgatcatttactagttacgcgagtaagtactgttaaagactagctgctgaatggcaatattttcagcctcccggttaaccataaatccatgcgttatcc

SEQ ID NO: 671120 - DNA, 209 bp, Homo sapiens
tgtctggtgcaatttgtattctccgtctcaagacacgggaagaacaggatcataacggaagtggtcccaatccacaaggctgcctggaaacctgtacatattctgagccacaacagaggaacagatcaaaagtggctccggccgcggaccggaccctctccggaaacatctccgtcaggcccaatagtctctccgacagggtctcatct

SEQ ID NO: 671121 - DNA, 170 bp, Homo sapiens
caccacagggaaactgccctatggctatgggcccggaagagtggccctggtgccagcgggtcaaggctgagcttacccaacaggaacaggggttttgcccccaggcagcagcagcagcgcagctaaagccagccagccatatagtttttcgtgttgtcttggagccagcc

SEQ ID NO: 671122 - DNA, 196 bp, Homo sapiens
aacgtgggattcactggattcaaagtagaacagctgaaccctcgtggagccattcatacgggtccctactaagagacaagtgattatgctacctttgcacggttaaggtacccgcggcgttaaacatgtgtcactgggcaagcggtgcctctaatactggtgatgctagaagtgatgtttttggtaaacaggcggg

SEQ ID NO: 671123 - DNA, 262 bp, Homo sapiens
tcgtcactccggatcgcccgattccggccatgctgctctttctcgttatgtgtctctccttctgtcgtccacctgggggtcttctttgtcggctcccactgtgtgcagacacccgtcgtgactggtacctcccgtgcgccaaatgtaatgcacactccattgcatacagaccgctctcacagtcatcacagtctggtttcttgatatcctgaaggaagattcggccacctcgttggttctagcagcttcatcagttcctcat

SEQ ID NO: 671124 - DNA, 155 bp, Homo sapiens
aagtccttaaataatggtgacaaaaatgaatttatactcacctatataagaagatagaacaagtgtaactacccacctcttccttcaagatcactattcagaagagcctccgacagttagttaatatgtgcatcaccccagatccaggagaggcg

SEQ ID NO: 671125 - DNA, 750 bp, Homo sapiens
gtgacaggactgctagttcagaattcaagaatgctttcctagtgtgtgagatgatgggcgtggattccttctgcctgtcactgggcgcaaagcaaattgctttagttattggatcgagcagttcttagaagcttggttggtattccttcatccactagcatccattgtgtgaaatagaccagttttcagcttggtgatgcctgtaagctaagaagccaatggttagccgtgaaatgcaagtcttgggtaggccagtgttcaatgaacgctagagattagtcagaaaagagttaggctgtggggctttagaaagggattttgagtcctgtcatttctacttgggagcatttcggagcagattacgtctttcagtactaaaaacaagtggctacctgatggaacacttttcttacccttatagggaaactgagcacaagctgaatgatattgtctgctgccaggaagagacatcgaagcaaaagagtcaaacaaaactagaaacctagaagaaatgggaaaacaatagagggtgcctctagaatcgaaagcaaatctgagagacgagacaccatagaccgaatatttatcgttgaaatccatcttatccatcatctcatggggtgcaacaggactcctcgatcctgggtgagcattatgggtacgacagttttattacgcaaagatttattacgtaccatagatgtgctgagtgtaccattgtaccttgagcacatacatacgataccttat

SEQ ID NO: 671126 - DNA, 176 bp, Homo sapiens
ggtaactgctccccttgtgatctgtttaataccctgtacatatctttgagttcaacctttagtacgtggggcttgttcacttcgcggctaaggaaagaacgagcttgtggaagacaagtctgcggcttggtgaggctgcacatccagcagccactgatctgagcagagtattaacg

SEQ ID NO: 671127 - DNA, 408 bp, Homo sapiens
  misc_feature (32)..(32): n is a, c, g, or t
  misc_feature (110)..(111): n is a, c, g, or t
  misc_feature (113)..(113): n is a, c, g, or t
  misc_feature (135)..(135): n is a, c, g, or t
  misc_feature (390)..(390): n is a, c, g, or t
  misc_feature (406)..(406): n is a, c, g, or t
cttgtgtccaggagttcgagaccaccctgggnacgtggtgaaacccttctttattttaaaaaaaaattttgaagaagcaaactcctgtctctactaaaaatacaaaaaanntncgctgggcatggtggcatgtgnctgtaatcccagctacttgggaggctgaggcatgagaattgcttgaacctgggagtggaggttgctgtgagccaagatcgtgccactgtactccatcctgggcaacagagtgtgactcagtctcaaaagataataaagataatatttttttaaaagtttgaaaaaaaaaggtgatagctatcaacaggtattattttgggggggctcctgctgtttgcttaagtactgtgttcaagggctttacttgcataaccntcattaattattgccnaa

SEQ ID NO: 671128 - DNA, 787 bp, Homo sapiens
tatccattctgatgtatttgctggatttggacgcatcccttttccttatgtcgctcacatctagttaatggggacttaacctccattccatggtttgagctcatctctctggaatgccgcgtatataagacgctggcatgtaaggctccatgagagacagcaaacctactaggacgttaatttgcccattctgggctcttgttgtataacttactggcataagtagactacttttagtgttctaagtttaatatgattaacagagaacggcttttttctcaggttcaggcttttcatgaaagtagtttggagaatcaatgaattgcaataaccagcttcacacaagcataactgataaacgcgagtgctacttgtagtcttggcaacgtgagccaacgaacctaggacgcacgggccacttcctacctgtataggacgggcccccatacggagatgaaatcttgtttcctggtgatgcacagaatcagaactacagtacagagtatcccaaatgaggccctgtgtctagacaggacgcgttcgtttttcccaaatcgtaacgtcggatttactgtagtgaaattgtagctgccatactggtagtctacattagagcccttgacgtgctcggaccatatattctccttccttcttatgaaccaggttgtttccttcgtagattttcccatatgtcaacatatcgcttaccagtcacacaaagtttcctgttataatttcttttagcagacaagttataagtcagatgtaattagcatcagagggataa

SEQ ID NO: 671129 - DNA, 986 bp, Homo sapiens
ggtgactgcgagccacgtgggtcctcgggcgcgtttaggttgctgttgtgcaggagctctgaagtgcaccaatgcttcatgcggccatgagacgagaagccactgagtgctaggagcgtgatggacgcgttctctttcagtatgcgaactcagaaggcgacaactgagggatccgacacgttgtatctatgttgtccgaggaagcattatacttcatggacggttgtggcagtcacgacagggcattcgcggcatatgttcagggctgcagttgcacaagtggcgattggcctgggtctttcactgaaagtattatacctacaaacggacgaacgacattagggtttgaaccttggcaccgtggaccgcaggtccccagtgacgtactgtgaacccagggtccattcgtgtggcaatagcgtacggatgacgaacttaccagtggtcgcggagattcaggttgcggccccgactaggagggttcctttgggcgaacggaggcggcacatagcaccattgatcgcgggattggattggggaacttgtgttgcgcaggatcttccactttgcgcgtacaggtcgggggacagacacgaagatcaccctatcgtcacgaaagaggttcgccgaacgggcgcgtagcgcagaagtgccgacgtcacctggttggcgacagcgacggtcaccgtgggaccaattaacgtagaaggctattgagttagagaagcgcataagccaaatatgtgaggttaaacgttgtcggggatcacgtgtggtgaaaataaatcgatgcaatgaggtagggaagtgttgtcgatggcatgtaaatacggttgtggcaaatccggaggaagaatatgcactggaggagatattggacgagcacgtgtagaaacgtgtgcaaaaacgatggcgatatcaggaaagtatacaacaaaattgaacatcggtgagatgtactatacatttgaaaatagagtgtggaa

SEQ ID NO: 671130 - DNA, 141 bp, Homo sapiens
aaggggcgtttgtttgggcgagaatccatgcttctgacccagagcactgggtgtgggcacgagatcgcgcgcacctttcctagagctccaggcaccgtggaggcctgaggtcatcggcctgagagaaggtacatctgcact

SEQ ID NO: 671131 - DNA, 180 bp, Homo sapiens
tgatccaaggattccatgagtattgatcagaacaggacttttgcgatggacttgcactacagtgaggagacaggccatgccttacaagtgcatgcagcatcactgattcacatcctcaagttaccgcacagtgcccacccaaaagtatagtccgataagcctggcagtaaggcagaacat

SEQ ID NO: 671132 - DNA, 292 bp, Homo sapiens
acattagatcgagctcctacccttaaggctgcagtgcagagaccagtgggagcatctgtagtgaagcacagcaaggtatgtccatccccctaggtctccacttgctcccatagaagactttagcccaagaagaactgtctgacctgtaattctgcagcacagtcttggccatcggatgggggtgatctgacctgaacactccttggtttactggcctctccagtatcccaactgagccacgcctgcttgcaggtgcagccttgggtgccctggtggcccacatcacagctcc

SEQ ID NO: 671133 - DNA, 263 bp, Homo sapiens
gggcatgccagactggagccccgaggaggcggtctcctcttcaagtagtgggagggggcatggcctggagtgttgggggcagcctgggaacacctccggttaatagtgtgtggttacagacgaaggatgtgactcgtcttgcagcagtcaccatgcctgaccgctctgtgagtgtactttccttggacaggcaaggcttgttggcctagggctgcgcttgacatactccgtcctgctcgagccattctaggttctcctttctt

SEQ ID NO: 671134 - DNA, 161 bp, Homo sapiens
ggtaactcctcccgagagtacttccaactctgctggccccgaatccactatgcaccaccaaggcggctggtggtgcctgcagtacacagccagtctcttcgtggtctcactctctcttctgcatctctactcttaagagactccggcattcaaagcctccg

SEQ ID NO: 671135 - DNA, 253 bp, Homo sapiens
cggccgatgaacgctttcatggtgtgggctaaggacgagcgcaagcgctggcgcagcagaatccagacctgcacaacgccgagttgagcaagatgctgggcaagtcgtggaatgcgcctgacgctggcggagaagcggcccttcgtggaggaggcagagcgcgcggtgcagcacatgcaggaccaccccaactacaagtaccggccgcggcggcgcaagcaggtgaagcggctgaagcgggtggagggcggct

SEQ ID NO: 671136 - DNA, 268 bp, Homo sapiens
  misc_feature (2)..(2): n is a, c, g, or t
  misc_feature (148)..(148): n is a, c, g, or t
  misc_feature (154)..(154): n is a, c, g, or t
  misc_feature (171)..(171): n is a, c, g, or t
  misc_feature (202)..(202): n is a, c, g, or t
  misc_feature (247)..(247): n is a, c, g, or t
gngtaacaacaatcaggagcctgtgtctggcggtggatctattatccatgacgggctaacccagatgaccatctggccatggggggcactgtgccacttgaaggagttctagtactacccgcccctgcgcatgcccatcatccccttnctgctntgagcgctcacccctgntgaggctcagcccctcaacccggtggcattntgggggaggagtggggcccacagctctccagcacccggaataaancccgcctgccccagtcgaaaa

SEQ ID NO: 671137 - DNA, 190 bp, Homo sapiens
cagatggagtctcactctgtcacccaggctggaccttgtctcaacaaaaaggaaaaaggaggtacagggaggatgatggaggactgaggtttggtacacaaacccatgcttttttttttctttttgaggcggagtctcgctttgttgcccagcctggagtgcagtggcgcaatagagcgagactctgtct

SEQ ID NO: 671138 - DNA, 138 bp, Homo sapiens
gcggcgctctagaggaccccttaattactggcagaaaaaaaacgtgcacgacatactacaaagagattttttaagtttaaaaaaagttggatctttggatttcctttttttttttggggttacttggacgcggggtac

SEQ ID NO: 671139 - DNA, 1298 bp, Homo sapiens
  misc_feature (114)..(114): n is a, c, g, or t
  misc_feature (332)..(332): n is a, c, g, or t
  misc_feature (374)..(374): n is a, c, g, or t
  misc_feature (391)..(391): n is a, c, g, or t
  misc_feature (393)..(393): n is a, c, g, or t
  misc_feature (405)..(405): n is a, c, g, or t
gcggatggggaaaaaaaaagatgtgagacatcgctccggctggtagtattggctacctctaaaaaacgccgtgctgctctcgtaataattgagcgagtgcccttcgcgaactgntaacgtcgcgagaacgtcgctagcgctgggagtcgcgcgttcgggcgtagcgtcccggacggcaaggagcagcgcgtactagtcacgcgagacgcgaggcaatagtagtatgcgaagtcctggagaggtgactgtgtcaattgctggaggatagaatgaacgagaggctcttgcggcgagcctcagctagccctgttcgtgtcctcacatagagaggnggagaccgatcgaggctaggctagggttccgcaggcgcttcngtcggcctcgaaacaanancgtagtcgcggntcactaccgcgtcgtcggacacgtcggtgggacgtcacgtaggaggtccgacctctcaaaaggccacgactgtatcgcctttgtggaatcgaagccatggggtttgtgcgagggccacgcgtgtgtccctcgcgtgcaatccatgaccgcaacgcttacgttgtcaagagggcagggagaaattgtcctggcgtgcaattgtaacagcggctagagaaagcggggcggaaagagtgtggaccccaggaggccagcgtctcatacatcgcccagacccgtttgtccgggagtccttggccttggggggagacacgaaggtaacccagtgcgccagctaagtaccggagccagccgcgagctactccgcgctggacaagacgccccactgttctgggggccaacgagcttcgaagcccctttcgagcagcggggcagtctcaagcccgcgcgccgaacatctggaatcgcgtcagctggggggcaaagtgaagtttccctgagaccccaagtccgacagcagaacccagcccaatgaaatcaagacggagcagagctgggggcctaagggagccctcggagagggacagggagggcaaagtggcgaatccggccagaaactcgggatacgaagcggaagagggataaggggaaaaccccggcaaattgggtggaccagcaaagcggagggggacacaagggggcccattgtaaaacccagacgcggacttgggaacaatctgcgcacagtgacttcgcgcagacgcgcgggagacccagacccgttgtaggagcactggcgcacgggaagctcacatacgagaaaccgcgaaccaactacaagaagggcgtcagcatcacaccagaggaatatctaagtaaacaccgtgtaactg

SEQ ID NO: 671140 - DNA, 938 bp, Homo sapiens
  misc_feature (31)..(31): n is a, c, g, or t
  misc_feature (96)..(96): n is a, c, g, or t
  misc_feature (100)..(100): n is a, c, g, or t
  misc_feature (114)..(114): n is a, c, g, or t
  misc_feature (308)..(308): n is a, c, g, or t
  misc_feature (464)..(464): n is a, c, g, or t
  misc_feature (514)..(514): n is a, c, g, or t
  misc_feature (537)..(537): n is a, c, g, or t
  misc_feature (735)..(735): n is a, c, g, or t
  misc_feature (792)..(792): n is a, c, g, or t
  misc_feature (809)..(809): n is a, c, g, or t
gttgggttcatttcctgcccaagaagctggntgaggcagtggctgaagcccacctgggcaagctgaatgtgaagttgaccaagctaactgagaagncaanccagtacctgggcntgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgcngcagccgtcatactgttccaaatgtggcagcgggcacagagtaccctcttcaagccccggtcatgatggaggtcccagccacagggaaccatgagctcagtggtcttggaaccgctcactaagtcagtccttccttagcctggaagtcagtagtgnagtcacaaagcccatgtgttttgccatctaggccttcccctggtctgtgnacttatacctgtgtgcttggttnacaggtccagtggttcttcagcccatcacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggccactgagaaagnacagagaagtgacagctaggggttgagaggggccagaaaaacatgaatgcaggcagntttcgtgaaatctgccnccactttataaccagatggttcctttcacaaccctgggtcaaaaagagaataatttggcctataatgttaaaagaaagcaggaaggtgggtaaataaaaattttggtgcctggaaaaaaaaacaaaaag

SEQ ID NO: 671141 - DNA, 182 bp, Homo sapiens
tgattagcggatgctttactgttcccaaacacacacacacacacataaacacagtgggcgcaatctcggctcacggagactccgctcctgggttcaagccactctcctaccttagcctccagagtagctgggaccacaggtgccgctgccaccaccctctggctaactttttttttttcttt

SEQ ID NO: 671142 - DNA, 705 bp, Homo sapiens
  misc_feature (17)..(17): n is a, c, g, or t
  misc_feature (29)..(30): n is a, c, g, or t
  misc_feature (63)..(64): n is a, c, g, or t
  misc_feature (68)..(68): n is a, c, g, or t
  misc_feature (118)..(118): n is a, c, g, or t
  misc_feature (341)..(341): n is a, c, g, or t
  misc_feature (399)..(399): n is a, c, g, or t
  misc_feature (416)..(416): n is a, c, g, or t
  misc_feature (423)..(423): n is a, c, g, or t
  misc_feature (535)..(535): n is a, c, g, or t
  misc_feature (550)..(550): n is a, c, g, or t
  misc_feature (564)..(564): n is a, c, g, or t
  misc_feature (570)..(570): n is a, c, g, or t
  misc_feature (611)..(611): n is a, c, g, or t
  misc_feature (617)..(617): n is a, c, g, or t
  misc_feature (626)..(626): n is a, c, g, or t
  misc_feature (629)..(629): n is a, c, g, or t
  misc_feature (643)..(643): n is a, c, g, or t
  misc_feature (648)..(648): n is a, c, g, or t
  misc_feature (658)..(658): n is a, c, g, or t
  misc_feature (661)..(661): n is a, c, g, or t
  misc_feature (663)..(664): n is a, c, g, or t
  misc_feature (666)..(667): n is a, c, g, or t
  misc_feature (670)..(670): n is a, c, g, or t
  misc_feature (672)..(672): n is a, c, g, or t
cgcgaccgagagaggcngcgagcgtcccnncctcagagagcagctcccgagacagagcctcannctgnctggaagatgccgagatcgtgctgcagcgctcgggggccctgttgctggncttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgncgcaacagcagcagcagcggcagcagcggcgcagggcagaagcgcgaggacgtctcancgggcgaagactgcggnccgctgnctgagggcgggcccgagccccgcagcgatggtgccaagccggcccgcgcgagggcaagcgctctacttcatggagcacttccgctggggcaagccggtgggcaagaagcggncccagtgaaggtgtnccctaacggcgccnaggacnagtcggccaaggcttcccctggagttaagggagctgattgncacgantccggaggngantgccccacgggctnccgancggcagggcncangnncnntgnanctgctgtggtgggccacggagggccctaggatg

SEQ ID NO: 671143 - DNA, 965 bp, Homo sapiens
  misc_feature (31)..(31): n is a, c, g, or t
  misc_feature (96)..(96): n is a, c, g, or t
  misc_feature (100)..(100): n is a, c, g, or t
  misc_feature (114)..(114): n is a, c, g, or t
  misc_feature (307)..(308): n is a, c, g, or t
  misc_feature (314)..(314): n is a, c, g, or t
  misc_feature (317)..(317): n is a, c, g, or t
  misc_feature (337)..(337): n is a, c, g, or t
  misc_feature (354)..(355): n is a, c, g, or t
  misc_feature (374)..(374): n is a, c, g, or t
  misc_feature (377)..(377): n is a, c, g, or t
  misc_feature (383)..(384): n is a, c, g, or t
  misc_feature (403)..(403): n is a, c, g, or t
  misc_feature (412)..(412): n is a, c, g, or t
  misc_feature (427)..(427): n is a, c, g, or t
  misc_feature (436)..(436): n is a, c, g, or t
  misc_feature (442)..(442): n is a, c, g, or t
  misc_feature (451)..(452): n is a, c, g, or t
  misc_feature (465)..(465): n is a, c, g, or t
  misc_feature (471)..(471): n is a, c, g, or t
  misc_feature (476)..(476): n is a, c, g, or t
  misc_feature (479)..(479): n is a, c, g, or t
  misc_feature (482)..(482): n is a, c, g, or t
  misc_feature (490)..(490): n is a, c, g, or t
  misc_feature (492)..(492): n is a, c, g, or t
  misc_feature (500)..(500): n is a, c, g, or t
  misc_feature (517)..(517): n is a, c, g, or t
  misc_feature (521)..(521): n is a, c, g, or t
  misc_feature (526)..(526): n is a, c, g, or t
  misc_feature (530)..(530): n is a, c, g, or t
  misc_feature (533)..(533): n is a, c, g, or t
  misc_feature (545)..(545): n is a, c, g, or t
  misc_feature (548)..(548): n is a, c, g, or t
  misc_feature (551)..(551): n is a, c, g, or t
  misc_feature (553)..(553): n is a, c, g, or t
  misc_feature (567)..(567): n is a, c, g, or t
  misc_feature (576)..(576): n is a, c, g, or t
  misc_feature (587)..(587): n is a, c, g, or t
  misc_feature (605)..(605): n is a, c, g, or t
  misc_feature (619)..(619): n is a, c, g, or t
  misc_feature (630)..(631): n is a, c, g, or t
  misc_feature (762)..(762): n is a, c, g, or t
  misc_feature (819)..(819): n is a, c, g, or t
  misc_feature (836)..(836): n is a, c, g, or t
gttgggttcatttcctgcccaagaagctggntgaggcagtggctgaagcccacctgggcaagctgaatgtgaagttgaccaagctaactgagaagncaanccagtacctgggcntgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctgggnngcggcngtngtagtgtgtccgggtgtggngggggggggagggtgcnntcttggggcccggggtcgnggngggggnnccggccggcgggggaccgngggggcggnggtctgggggcgggncggctgagngcgggngcctggccnnggcctgggagtgnggtggnggggncgnggngcccgtgngntttgccgncgtgggccttcgggcgntggnggtgngggngtngtgcctgtgggntgnggntngcgggggcgcgggngggtgcggncggccgcgggngacgggtggggggggggngtagttgggggggnggggggggggnngttgtttgaattttcctgagagcctggcttagtgctgggccttctcttaaacctcattacaatgaggttagtacttttagtccctgttttacaggggttagaatagactgttaaggggccactgagaaagnacagagaagtgacagctaggggttgagaggggccagaaaaacatgaatgcaggcagntttcgtgaaatctgccnccactttataaccagatggttcctttcacaaccctgggtcaaaaagagaataatttggcctataatgttaaaagaaagcaggaaggtgggtaaataaaaattttggtgcctggaaaaaaaaacaaaaag

SEQ ID NO: 671144 - DNA, 126 bp, Homo sapiens
gatgatactatgaaataaacggctgtgtaaacttcattcttccttgtaccagttgccatcttttagcgccaaaggaattgctgtctcccacttggattgaatgcagagcctgcagtcgcggccgct

SEQ ID NO: 671145 - DNA, 100 bp, Homo sapiens
  misc_feature (87)..(87): n is a, c, g, or t
ccgcgcccgccgccgccatgccggacatgctgggacataggatgtgtacccgtgagcccccgcggccgcacgcctggtgcagcccanatcccaatctgtg

SEQ ID NO: 671146 - DNA, 1881 bp, Homo sapiens
  misc_feature (200)..(200): n is a, c, g, or t
  misc_feature (391)..(391): n is a, c, g, or t
  misc_feature (819)..(819): n is a, c, g, or t
  misc_feature (1855)..(1855): n is a, c, g, or t
tgggaaaaagctagcctgaggtttaatttgggcccaaaaaaaaaaccaatggattggtttggtaccttgggggctgtggccaaggggggtctccccaggttagttaaacttccccaggtgtgggcgtgagggcatagggttgaccctcagggtgggctcctcctgtgttccccagtgtgctcacccgtgcattaggggcnctcttctcccaggtcctctggaggcgcaagcggcaagagagagggtgtaagcgtctgggagaagggggtttgcgccggcaagttgtgtcccaatttgtggcgcgaggcactgtccaggaggaactccagaaacacaccagagtctctccccatatcaaggtgtgtctccgaaattttcttctcaaacaaancccaggggcggcccttggagagagagaacgtgtgtgggggcgcggcgtctaagacagagagagcctttggagaccccccgggcgcgccatgtagaggcacataaaggtgtttgggagaccggcccatagggggtgtgtgtaatcgctttaagaaggcgcgcgggggcgcttgtttgtgaggagagggggccccccccactataaaagaggcgcgcgaaagttctccacgagaaaaccacatctgctgcgttgcttaataaaagcgcgcgtgtggtgggtggggtgtctcctcccgcggataatatgagagatataccactcactgagtggtgccccggagatatacccccgaaaagaaaatatccccgaagcgccgccgaggatcatctcgctctgtggcgcgcctctcacaaaaggacaaacgtttncccccatgagagaagagggagcgcgacaagaatcccccgagatgttgccccacgaggggggccccaacagtctataggagaaaggtgtacacacaataccaaagagtccccccgtggggatacaactcaaccaacgagcgcaagagttttgtgcgccccaggcggcgcccacaaattgtggtcccctgtgggtttatgtgaggccccccctcgatgttctaagcaagaagggggggcgggcggcgcctctcccacaaagaggtgcgctcgggagaccacaaatactggtcggggcggcggagagtgggcggactactcaccacatataaagaggggggccgcaagcgggcttccttcccaaacaagacgtgtgactctcggggggcagtcttcgtcgcacaagtgggggcggggcgcccccccaagcaggggacgagaaagagaggggcccccccatctacgcacaaaggggagggggggatcaagagagaggcccgcgagtggcgctggaggtgtgtgccccgccagagaaggaatatggggccctcccacagaaagaaaaaagaagaggtggccccccgaggagggagaggacgaccaccctccgcgtgagtagtcgctcgtgagaaaacgaaacacaccaagacaagcgacccaggaggggagaacgcccctcgctcgcgtgggagacgagaaaaagtgtgtcgctcccagaaacaaggaagagaccgcggttgctaacgaacaaggagaactatggtcccacgtgcgggcgaccccaccacggcagtgggtgcggcgcggccgacaccaccgaaagaacgatgagatgttggttgccacgccacgacaacgcaagtgagacgaatcgaacacgcaggtgcatcacacctcaagatagagagcaacgcacagaagcgagggacgcgcaatcactactatgatgacaacgatcgcgagcacgaaggcagcagctgcgcgagtccaaacaaaccgcagagtgaggacggcagcaaccaaagctccaccgcatcangacgacgacatagctacaagacgatt

SEQ ID NO: 671147 - DNA, 1343 bp, Homo sapiens
  misc_feature (354)..(354): n is a, c, g, or t
agccggctcaagatccatagctgcacagaccggggcccgcgctctcactcctctcgccgatccgagagctggctcggacagcatcgctgaagtacatttaggagctaggcgggttcattggcctctaatgactgccctgtatccatgggctgagggaactaggctggtaatgacctatgctggctagaccgcatgttacgcataaatccctgaactattgacttaggttgcacgaccgacaccgcgtacggatcggcgcaatgtggcaatgaggcaaactgagcctgagagcttgcagagctgctgcgcacagtaccgatggtggtccagaattgagatgcgtgaaccagttcnttatgggtaagatggcgttctcgccgtagccggaactgctgggtggaattcgactcggctctcggtccatcccctggggggtcctatcacgatgtaccgcgtgtctgcttcttcgccgccccagcttggccctcatacttgcctgcgtggtgtattttgctcccgttgcttaggctcctacaacgagaggaccccaggtggtctcaatttgcgagcgaccttagaacgagatagagaatacccctagatggcgtacaggacgagagttacaacgccatagtaatgaaaccattccccctattcatgttcaccgtgcgccttgccagggggactgtgacccacccccaaaagtgtattggcaccctgagtggcggtgcatcccgactccataggcattggccaacattacgccgttggagtggcggtgttccccccaaagggaaacctcaattgaacccctgggaggagcttggctctttcgatgtgagccccaacagtaaagtggcaaaccccaaaatggctcaggtacgagtcccccttaacttaagcgtagaaagactttcggcatttgtagcttggaccgcttcacttacccggtggagttgaaagcgtgggaaggccccttaccctatttctttaaccgagtggttggcacacgcttaggtagccgcctccgaggcgaattcacccctgcacaaaccggatagtacaaacagttggattcagacgcttaaacaaatattgccaccgcgcacgtttgagtcctaaacggatggtcttaccacaaccattcactacaagtttgtggtggaaccttttggaccccctttgaggcgcgggtcccaggaaacggcgacctttgtggaaaccaatttcacccagtacttggcgttgagacccagacttggttccagtccgataccttacccatgagattgcgcgcccgcacccaaatggggcgcaaagaagtcactatccaccgtgggaag

SEQ ID NO: 671148 - DNA, 346 bp, Homo sapiens
attttacctcagggtgaagagtcatggctaccttggggtaacaactgttcgtctgggtcttgaccatgcatgtactatagcggctgtgatcatgtgtgtctaccccatcgttctggagtcctgatctcccctcctctgtgaatgctaccagctaccctgatgtatctgatctgaaaaagttccgctagactctgcattacttcagatgcttgtggcaccaatatgacaggtgtgatgtttgcctggggatgccgaactgagaaaagtaccatctcctgttgtaatggagttaatggcgttccgctcaggacagctgcacttacatctggtgttaaaccaccgttat

SEQ ID NO: 671149 - DNA, 252 bp, Homo sapiens
  misc_feature (23)..(23): n is a, c, g, or t
tccgggtatcccaccagccactncttcctcctgggacctcggcaaactacccctcgtcttccctccctcggtaggccctgatgcgtggaggaccccgcccgggctcggctctttactccattcacagccgtgcacgcgcttcaagccaccagggttgagacatgtcagctctggagttctcggttgttgtaggaggttggctgttttcaaatcgtaatgatgtttcgagcaaataaatttgattgatacaga

SEQ ID NO: 671150 - DNA, 444 bp, Homo sapiens
  misc_feature (21)..(21): n is a, c, g, or t
  misc_feature (41)..(41): n is a, c, g, or t
  misc_feature (95)..(95): n is a, c, g, or t
  misc_feature (173)..(173): n is a, c, g, or t
  misc_feature (207)..(207): n is a, c, g, or t
  misc_feature (225)..(225): n is a, c, g, or t
  misc_feature (385)..(385): n is a, c, g, or t
  misc_feature (387)..(387): n is a, c, g, or t
  misc_feature (435)..(435): n is a, c, g, or t
taaaagtgaccctcgtgcctnaagccctccccgaagtgccngggaattaacaagttgtgtgcaaaccaacaccccagctaaattttggtaatttnccgtagagatggggttcacccatgttggcccaggctagtctcgaactcctgacctcaagtgatccgagtgctgggtanaggtgtgagccactgcacccagccttctcttcanttttgaatgtgtttttantttcatgctcacttactcaactctctctaaacatgcagatatttaagtgtgctttgacagctgggtgtggtggctcactcctttcatcccagcactttgggaggcctatgtgggaggatcccttgagcccaggagtttgagactgttgtgagctgtggtntnctgctgcactccagcctgggcatcagagatcctgtctctaaacacaanttggattat

SEQ ID NO: 671151 - DNA, 236 bp, Homo sapiens
atagtgaatgagtctcaatggttcatttaaaaaactgtacagatctacagagaggacaaataggacaaaatgtgaacaattggtgaatctaagtagaaggatatctagaacatttcattggttaccttctattctcccaaatttttctgtaaagattgaaaatatttttaatattaaagcaaggttgtcctaagaaacaggtggttaaaccaaggggtcaattaacatttttggta

SEQ ID NO: 671152 - DNA, 311 bp, Homo sapiens
gcacgagtctctctctctctctctctctctctctctctctctctctctctctccgagaaacagaaggagaagaagctgactcccatcacctatccgcaggggcgagccagggataaggagagaggggcagaaaaagagcgggagagcgcggcgctcacacagagaggccgcaagacagggagagacgaagcgacccgagcagccctctgcccgcctcccgagaaaaagaggaagagaaaatgcgtgcggctgtaaatgtctcagcccctcgtgcgtggccctgtcccttggaacctttggacgctctgctc

SEQ ID NO: 671153 - DNA, 983 bp, Homo sapiens
ggctcttgtcatttagccatcctttaccagctccatgaatggttctgcaggtttctgcggccccccggacagtggctctgacggcgtgactgatggtgctgctcacatctgtggtccaggcaaggtgccactccatgatgaattatcgtgcaaccgagattactggcatggaattgctacgcgtagtagatgggacacagtcgcttcctgtgagaagatacgatctacaaccagggaggagttcggtgcgcttcgacagcgacgtgggggagtaccgggcggagactggagctggggcggccctgatgaggacgactggaacagccagaaggacatccgtggaggaggagcgggcagatgccggacaggatgtgcagacacaactacaagctggactgaggccgatgacccgtgcagctgccgagtccagcctagggtgaatgtttccccgatccaagaaggggcccattggagctactcacagaactgcttcgtctggtcacgtcgacggatttactagccatggcatgcattcaaagtcctgattggtgcctgatatggaccaggagcgaaaccagactgggagtcgtgtccaacatcctgaatccgtaattggagactgtacgcttccagatcctggtgatgctggcaattgaccccccagcagggagatgtctacacctggcaagtggaggcatcaccatggctgtgactagtcctgttccccgtggagtggaaggcacagtctgatgctgcccggagtaaggcattgaccgggagctggaggcttcgtgctggggcctcatcactctgtccgaatgggcctcttcatgcacaggaggcatgcagaaagtccacgaggatctgggtaacagggttcctgagctcctgaaacgacatgggctaagaacaagccttgcgggtacgtgacaactggcccaggcagaccttagttccggtggtacgctgccgaattgccgatc

SEQ ID NO: 671154 - DNA, 159 bp, Homo sapiens
ttcttcaagaaactccccggtacgaggccagatagagagttgtgggtcaatctagtaacatggactgaggacattttctggcgatctgccactaagtgagtaatactcaaacaatgataaaataaagcttaaagaagaaacacaaacagaaaagcccag

SEQ ID NO: 671155 - DNA, 1008 bp, Homo sapiens
gtgagtgaaagtagtgggttggtgtgggccggaggaaagcgttggaagactcatcgtagcgtgtggatttgagccgccgcatattcttggagccctaaagtcttgataagtgctatcgttgattcctggtccaatctgggacctgataagggttttatgtattgacaaactctatgggaatacaagtgcgcaatcttcagaatcggagatttagtgaaagctggtgaactatatggcgacgtagcttattgtgcatcccaacctcacggaaaggttgtgttgggctttgcttacgtaaatcactaaataccggtctattggctctaccgttttgaagtaacgaagggaatccccggaggtattgcaagactgattgcaaatccgaagtagcatcataagttgagcacagaacaacgtaatagtgcgctgccgttggttcagagtggaaattcagttctgaacatgtgtgaaactcagagatgtttagaatttctgtggtccaaacacctccccttcatgagtgggggtccggtcagccgggttcgaaggaagtgattcactccgtgaggagtagggatctccttccaactttttgtctcacggagtcttcccaattgcaacgggggcatttgcctttccttctctgtcaagcatcgaagagctctagggtccccttgtgctaaaaggagcgactggggggcagtcagatgacgaactgaaggactcccggtcggtccgttccgaggggatgaaagaaaaacttttgctacgccaatggccggttcccggcatcctctacctttatgaaaagagggtccactccgggtagcagcgctcagggatgccataagtgttccaacatctggggtcggggaacactttcgcgagaagagaacccgcacgcttttttgtgccacaggtaaaacacaagctcgcggtcggctccccagagggagagaatttccacctctccatgtttgcgccacgggcgggtgtttcttgctcacg

SEQ ID NO: 671156 - DNA, 334 bp, Homo sapiens
gtcgacgtcatcaggaaggtgcaaatcgaaattactttgagatgccacctcatacatgttaggatagctattatcaaaaagacaagagctaacaagtgttggtgagggtgtggagaagagggagcacttgtacactgttagtgggaatgtattatatattggtgcagccattatggaagacagtatggaggttcctaagtaaattaaaaatagaactaccatatgacccagcaatccctcttctgggtatatccccaaaggggaatgagattatctctatatcacagtttctttatccatttgcccattgatgaacacctaggttgtgtctgta

SEQ ID NO: 671157 - DNA, 154 bp, Homo sapiens
caccagctcactgctctagtaaccacagctgaatctcccgtcgtgggccccctccacggagtcagctggtgtagaataacattcctgctgatgtggacgctgaagtcaccgcgttactggttcctggggcagcctcagccgcagttcggtgtgt

SEQ ID NO: 671158 - DNA, 515 bp, Homo sapiens
  misc_feature (7)..(7): n is a, c, g, or t
  misc_feature (95)..(95): n is a, c, g, or t
  misc_feature (97)..(97): n is a, c, g, or t
  misc_feature (100)..(100): n is a, c, g, or t
  misc_feature (102)..(102): n is a, c, g, or t
  misc_feature (111)..(111): n is a, c, g, or t
  misc_feature (120)..(120): n is a, c, g, or t
  misc_feature (189)..(189): n is a, c, g, or t
  misc_feature (196)..(196): n is a, c, g, or t
  misc_feature (209)..(209): n is a, c, g, or t
  misc_feature (213)..(213): n is a, c, g, or t
  misc_feature (216)..(216): n is a, c, g, or t
  misc_feature (220)..(220): n is a, c, g, or t
  misc_feature (225)..(226): n is a, c, g, or t
  misc_feature (230)..(230): n is a, c, g, or t
  misc_feature (234)..(234): n is a, c, g, or t
  misc_feature (242)..(242): n is a, c, g, or t
  misc_feature (250)..(250): n is a, c, g, or t
  misc_feature (252)..(253): n is a, c, g, or t
  misc_feature (282)..(282): n is a, c, g, or t
  misc_feature (324)..(324): n is a, c, g, or t
  misc_feature (345)..(345): n is a, c, g, or t
  misc_feature (368)..(368): n is a, c, g, or t
  misc_feature (375)..(375): n is a, c, g, or t
  misc_feature (377)..(377): n is a, c, g, or t
  misc_feature (382)..(382): n is a, c, g, or t
  misc_feature (395)..(396): n is a, c, g, or t
  misc_feature (399)..(400): n is a, c, g, or t
  misc_feature (409)..(409): n is a, c, g, or t
  misc_feature (412)..(412): n is a, c, g, or t
  misc_feature (452)..(452): n is a, c, g, or t
  misc_feature (503)..(503): n is a, c, g, or t
gcctgangtactttcactcacatatgcggggcttagtcactagcaaacttgtttttcttttttacagattttccagcaaagttattaaatgtcantntcnantaatggacnccgcatggntgtactctgaagccatggaacaccacttcttagttaccttcacacaataagccataacatatagctttnggctgtncacaattaagcancagngangggnaaagnnagcnagancaccagantattttcngnngcacagcttcattaactattattatttanctgcctcattttatgttttttctagcccccacaaaaatgaantttccctgtctcatccccagnttaggctttttctccatctcccnacacatncnttgtntcctttcatcggnnaanntctgggggngantttcccaacttcagtagaaatgataaaaaaggcaaccgcnggtgtgtaccataaggagacacaagaagaaaggtgacactaaggctacagngcacagaaaaca

SEQ ID NO: 671159 - DNA, 113 bp, Homo sapiens
ccgggtgggtctccccctcatcagcgtccggctcggccgtgttgaccacgctgtagagcaggctcccgtccccgttcctcttcagatagcccatcttgccgcctgggaggaac

SEQ ID NO: 671160 - DNA, 260 bp, Homo sapiens
ctcagcctcccgggttcttgcgattctcctgcctcagcctcccgagtagctgggattacaggcgcctgccaccaggcccagctagtttttttgtatttttagtggagatggggttttgtcatgttggccaggctggtctcgatctcctggcctcaggtgatcccgtgcctcggcctcccggagtgctaggattacagctatgagccgccacacccagcctcttgtttgttgacttcttaatagcagccattgcactccgg

SEQ ID NO: 671161 - DNA, 261 bp, Homo sapiens
gatcccccctacatttgcaggagcatagattctatcaggttgttttgtcaaagcaggttattcagtgattcctccctatcattcttaagaacgttaaactaatgtctgttgtgtgtttagctctgagatagaaatggaaaatatgtaaaatcctctgtataggtaggttatattgcggttgaacttctgtactagccccttttctcagactggtaccttttaacaatatcaccgctaatctttttatagtgttatctctaa

SEQ ID NO: 671162 - DNA, 114 bp, Homo sapiens
atgtagcttttctattcctcgatactgtaagaggcggggtatccggagagcgaatgttacgaatgtgggactgggatggcctcgtgatgaacgtcaaagctcgacggactcctg

SEQ ID NO: 671163 - DNA, 159 bp, Homo sapiens
atgtacaaacgtcatggagggagatcgaggtgtttggtgcacatgacggtgagtgtgtgggcccggctgggccatcacagtgaaaccagtgtgtttgctaaaaatagtaaaaagaaaagaacccaaaattgaatcaaataaaaaaaacgtatgcggccg

SEQ ID NO: 671164 - DNA, 229 bp, Homo sapiens
aggtttttttttgggccgtttccaggccccttccccggccactttccttggaaaggggaggaagcctttttttgttttggaaaccccggggaggttgaacagggaaaaagggaagggactaacgggctccggaagggggggggttttttttttaaggcccggggttaaagggggggggcccttttttttttcccccttttttttttttaaaaaaaatttgcccacttga

SEQ ID NO: 671165 - DNA, 402 bp, Homo sapiens
gcttatagctctgccaggagacaggttagctgttgcccacgtcagctgacacactccgacttttgttgaccagagaatacgggagggttagagggctgcctttggactagtctacgtgtacacctactgtcctgtgtcgtgaggcaggtgctgatgcaggctcaggaggatattcgttgacatagttctttactattagtggaatctggcacaatctgtctgagtgctagcctgaggcgtgtgcatcatgctccatattacttactgtggcttgtcgggccagaggttgtattgcttgaagttatcgctacttggtcagtttgagccttccttagtatactgagttcctcctctgctcggcctaggactcggatgtctactgcctatgagccccttgtgcgt

SEQ ID NO: 671166 - DNA, 141 bp, Homo sapiens
tcgtctatggcgacacgcggtcgatccatgcccaggcgatccggctcgcccgtgaccggggcatcaccgtccaggtcggtgatgcggtgctgatccagcagcgcggcgcagcgttcgggccagcggtcgtggccgtccttg

SEQ ID NO: 671167 - DNA, 466 bp, Homo sapiens
  misc_feature (450)..(450): n is a, c, g, or t
agtaatttttataagtataaaagtgcatttcattctcaaaaagttataaaggaaaaagtacaagttctcccatcttctacccatgaatttcttctcttttctccagaggtgcccattgttaacgatttggtgtgtatctttctttcttttttgagacagagaatcgcttgaacccgggaagcagaggttgcagtgagccaagatcactggctttgtgccaggagaacatgggatgtgtggcctcctcagctgttttcaggcaggtgcgatgcctcaggggagggagcacaggtacctgcaaggtaattctgtcaccccaccccatgaccagatggcaaagtacttccaccctacacatggatgtgagaaaacaaccaaagacaagcagcaatacaaattccaaaagtgtaaaaagaaaaccataccagggagcaacaagaatgaacgcangacattttaaattttg

SEQ ID NO: 671168 - DNA, 419 bp, Homo sapiens
tggagtgcagtggtgtgatcatggctcactgcaacctctacctcccgagttcaagcaactctcctgcctcagcctccaggtagctaggaccacgggcatgtgccagcatacctggctagtttttgtatttttagtagagatgaggttttaccatgttgcccaggctggtctcgaactcccaagctcaagaaatccacctgccttgcctcccaaagtgctaggattacaggcgtgagccactgcatccagcccaaaaacattaaaaaaaattatccagctgtggtagtgtgcacctatagttctagctactcagaggctgagatgggtagatcccttgagcccaggagttcaaagttgcaatcagatatgatcttactactgcattccagcctggccaacagagcaagaccctgtctcaa

SEQ ID NO: 671169 - DNA, 746 bp, Homo sapiens
gccttttgtgcgcaggtgttcctggggaggccacagccgctgtggtgccacttataagcgcgggggtgatcaactacaccgcgggttttttatatacccgcgggcggggtataactttttctctcgggagaagctgttgtccgactgctggccgctttttggggccgcgccagctagatgcaggcgttgtcttccacgcaagagcgaccgactggtgttggtgcgtccgctcgtcgtagttttcccgcgaggatttttgtgccaccaacggtcgctcccgccctcttcttggggcggaggagtttttttctactcccgcgatgtgattgttccccccctctctctttctttttgacaccccgcgcgcggcgtctcgctggtggctcctcttgtgtcggccccccgatggggttgtttgcctccgtctgttgacccgccccccctcttgttgtgttgtgtgcctcaccaccagacggctcttctccctcatggtgggggttccccaccccccgatggtgggtttatgcaagacgatgactactttctccggcggtttttatgccaccaccacctttcctcgtcgcacaacggcgcgcggggcggcttcttccctggcctgctctcttttttctatttttgttgggggccgcccccccttttttcccccccccttttttttccccccttttttttaagggggcccttttttttttttttccccccccctcccccctctttttccccca

SEQ ID NO: 671170 - DNA, 399 bp, Homo sapiens
ggtgcgtggatcactctgaggtcaggagttcgagagcagcctgaccaagagtggtgggaccccttctctactaaaaatacaaaaattagctgggcgtggtggcgagcgtctgtcatcccagctactcgggagactgaggcaggagaatctcctgaacccagaaggcggaggttgccgtgagccgggatcgcgtcggctcactgacaacccaggcctgggactacacagcaataaatctgtcttaaaaaaaaagaagacttatacactctagttactgtacccctttctagtgctatgactaacgttgggactgcacaaatacttacgtatggtgttaggatggctgtagtattgggcgtacgtaaccacgctgggcctgtccatatgcaaggggtaccg

SEQ ID NO: 671171 - DNA, 133 bp, Homo sapiens
cgatgcagcatatacattagtgtactgttataccttgcctatcagtgtctccgcagatacatagtctcctcatctactgtgttacaaaacttatgagcatgtttgcgcagcatcaatcacacgggaccggtcc

SEQ ID NO: 671172 - DNA, 275 bp, Homo sapiens
aaacagtcagtataatattctactatttgtgttgataaagataactggcagaatggaactctcacatgggatgtacctctgctggcttctttgggagttgctaccatgctgtttgggtagggcctggtgacagcagttgcagggactacagccgtgatactctatactccattctacgtgacgtgatctggcttcccacgttcatctatttatctactcttaacagtctcgttctccattttccgaatggggaaaccgaagtatggggctggaac

SEQ ID NO: 671173 - DNA, 951 bp, Homo sapiens
tcttcactcggtgtattcgtggacgatggactctccatacctacacccatgtcgcactcctgttcagttaagcttgttggataaggaggcagtggcggtccgaacgctgatgtggctttactcgaagcgtcgaattggcgcttttaggtattactgcactaggtatgtagactcgtaggtcctgctcactgtcccctgactgatattccctaaagctgttcagagctctgaatatggtatgcttagaatagtcgtcttcaagacttggataaacttctaatagttccacagtcttacgtagttggtgtctggatatggtcgtggttggccacatgaggagttgacgttggtattatgtctatgagatcttacgccaagtggggccatctttggtctatgatgatttgagatgcaaactccaacatgctgattgtactccgattaatgcaattgggacgttggggatgctagcatgagtgatcagaagttattctagagtcatgatcactgaacttgtattcaatcttcacgtgtgcttccatccagtatacgccagtgacctaggtaccgggcccgcttgagattcaaagctggtctgtctatcagaaggcatatattgaacgttgattgtccccacagtatgcgggtaggctatatggggtattcctagcctgaggcgtgcgacctatgaggactagagaaatgcggaaggaggaccttcactaccagggaagccagcaaactcgcggtacgactgtgctgtacctgcaagcaggcactatcagtccaaagcccgggatatcgacccgacggggggctccaattacggtcaggaatgcagaaaccaagggcttcgcggaacgtcgaagtctcggaggcacaagggaatcggaacataggagcagaaaaaggaggacaaaaagcacaaccaggaaaaaagtacaccgccga

SEQ ID NO: 671174 - DNA, 593 bp, Homo sapiens
ggacacagagatttcctagccccgttaccaaacgaaaaagcaacgcaagggcttctaagaagccatcccagatgaccttattgtgcgtttgagaagagcagtcctcataccagagtgtttggggtttgggcctctttcagtgtgtattcattcttacgtgggaaagttgtatccgaggtttctgtggtgcatgaagcttttgccttcaccatctgttcccgttgtcttcctcgtggtgacatcagagtacagcagtattttcccttgccatctaagtggggttagggcatgttttgactcaaccgtgtgtgtcccctcaatgccaggggaataatcctaccctaagtcagctgaactgaagccaggatctaagctgtcaaacgaatgagacccaggttgctttaaacagcattggtagagatgaccagttttccgttgcagcgtacctgggaagaccggtatgctaattagtcttgcaacaaaagatgttccgttggcttcatctaaacaagaggcaatctaccgttcagtgtcataacgacgttcattccaggaggcaatctctgccctgtgctccgggacagaatggaatg

SEQ ID NO: 671175 - DNA, 670 bp, Homo sapiens
gaggagcaagcgtctgccgcggtggccgggtgccggattagacaagatcaaagctgcaggacataatggacagatgatgcgttcacagagatggaaggcatcttggatctgattgatgatgcttggcgataatatacaagctgccttcatgcagggatgcttcgcattttccactgcaagtgagcttcctgatccctgagatcaggatatgggtgggcaccacagagtctgtcaaagaaccaagaaatggaagtggacagactttaggctcgttttaccagtacctcgcatgaagaatgtaccccccatcgacaaagctgactgcgtaaggatcctttcttgtgggatggattttcctccaaaacgtcacacgaagatacaatgcgatgggttgtgtgaagatgcgtcctaaatttcaagacctttgaggaatagattagtgatcaaaagtgtatagccatttagtttgtggtagcgaagtgggatgcgaaattgagtgagaaactgagattacctcgagtgaagtggtgaatatttacgtctttaaacctaaagactgcgtcattgagtagctgtatgatttgaacgtgattgattgagtcgtgatgctctacctgctgatttggtttgctgaaaagttttaagcttccaatagttatgtgtgtcctga

SEQ ID NO: 671176 - DNA, 285 bp, Homo sapiens
agaaagggtttcaccatattggccaggttggtctcaaactcttgacctcaaatgatcggcctgccttggcctcccaaagtgctgggattacaggaatgagccaccacgtgctgtcctgaatgggtctatttctgagggtactgtgcttagaccctggagtgaagtggggagatcacagctcactgaaaacttgacctcccaggctcatgtcctcctcccggttcagcctcctgagtaggtgggactataggggtgtaccattacacccgggtatattttcctttt

SEQ ID NO: 671177 - DNA, 486 bp, Homo sapiens
ggcggtacctcaggatgcaagtgtcgtgattgatttgagcaagcaaggggtacgtgacaggcgctgtatgcaccggtggtcagagtgaaacagaacagagcagggagtttcacaatgttcttccatacaatgcctgaaatctatgggtaacatcgggttctaagtcatgagttgatttttaactactaggtttaagccaggcaggcccaggcctggctttgggcctggcgctgggctgcctgtctttgatttcacttccttgtttttttcttaaaacaggtactgagtataaaacaatatgagagagcctctctcttccctcaccagctactcaggaggctgaggtgggaagattgcatgaacccaggaggtcagggctgcagtgagctatgattgtgccaccacattccagcctgggcaacagagcaagaccctgtctctaaaacaagaaacaaagtgcaccagtgtgtggattccagcttctcc

SEQ ID NO: 671178 - DNA, 367 bp, Homo sapiens
cagatgaacatgacccagtccgttattaattcaatgggtctgttcaccagaatgtggtaatttcgttcttgtaatttgccagaattgtattgagtaaaggaaatagttacagtctgcacacccgagaccaggacaattcctccgatgaaattggctgcatcaaaggtagactttcgcacaggttgtgaggttggagtcacagtggttgtttgttgtacctgatgtagtaactgtcttggaagttgtagaaggggagggctgaactgtgggtttagctgtagaattggctgttggcactggagtggccgtggaaacggaacagaagtctgtcgtgttccccacttgacaatcactaactgttgagtta

SEQ ID NO: 671179 - DNA, 366 bp, Homo sapiens
actagtaacggcgcatgtgtgaattggttagactgtcgacaggtgtcgagggtcagtggcatgggtggacggcacactattgacaaagtctactgagacttcatgggatagtaggggagcgcaacaacatagctaccctggaggacagtgccaccatgagagactctatcaaacccaaggcataataggaatagatgtaacctgtatcctcaattattttcggatttgtgaaatggtcggaatacatcctttgaacaaaggaaaatctctttaagaacagaagggcacaaatcaaatgtgtatccgaaggaagagcaagaacatggccacacccaccgtcccacacgagacatttgtgcgctgaac

SEQ ID NO: 671180 - DNA, 127 bp, Homo sapiens
gtactctaccgctctttaggctgagaaggccagagcacagtgtatgtgtgttgtgtgggtgcaggccaggacgtgccctccatggggcatgcaggctctgcagtaccctcagcgctgggtctccact

SEQ ID NO: 671181 - DNA, 84 bp, Homo sapiens
ctctgttttcttctgtgtggatttaatgagagaaatttaaatatggccgttaaattccaaaagtttcaagcctttgactgggga

SEQ ID NO: 671182 - DNA, 387 bp, Homo sapiens
cagcggatacctatcgggcgagggtacactgttcccaagggcaacagatgcaccaggcagcacagttcaaaggacagctagacacacttatgatctggaaacacgtaatgatgtaacccaatgtcatgtaccacacaccttttctccaaggaggtctcataattctagaggggaaggtccagcgtgattacaaaatgaagacagacaacacaacatatactctgtggagatatcctactcatactatgcacgtgctgtgatcttgaacataactcgtcccaaataacttgtcacgatcatcctagactttaaaggttggctgatccatcaatctatgcactcaactgtaacttctttcccagtgtagttagcgcgtgctgtccgaga

SEQ ID NO: 671183 - DNA, 534 bp, Homo sapiens
  misc_feature (527)..(527): n is a, c, g, or t
tctcttggcagggtggttttgccttagacttttatagagaggagtatacaagttacaggtggaggacttacatgtgggattgttttgcaatcagaagtctcagtcagttgccaaacaggaaatatttatctctgtgtcatgctggttttaggtggacaaagagttctaatagagagacaaagaatgaggaattgggctgagcatggtgatgcacatctgtaatcccaccactttgagaggcccacacaggaggattacttgagcccaggtgttcaagaccagcctaggcaacatagcaagaccccgtctctacggaaaaaaaaaaaaaaattgtaaaaaagaatgaggaattgaagggtctgtgtctggtcttgtcccactgggatgggataatctcatgggataccatatactatggtgtatgcagttcatgggtgaccaaatcattgttatgtgatgcatgcctgtaatttgtaaaattccttgcaggtatacaatttattgattaaacaattggaagtttgganaaataaa

SEQ ID NO: 671184 - DNA, 455 bp, Homo sapiens
tcgggcgaggcagtctcgtggggccacagaaggcctgggttttctgtcagaggacaggatgcacattccttcaagatacattcccagattgttgggcatctcgttcttgggttttctgttgttgctgttccgttttgtctgtcttccctcctttgtttactagcagcctggaatttgccactttttctaaacgaagatttatggaacacttaccacacggctgacgctgtgcgaggctaaggttctaatacaccgcagctcacttaactctcgcaataccataaacgcacactgtttcatcttgaccctttcttgggaaggtgacagagaggtaggagggcaaacatcttgtgtgccccgtcccaagggtattactggtggaataatatccgcccaccaccccagtttctaatttgctgtaggctgtgacgctgtgtggcaaagactaggagtcc

SEQ ID NO: 671185 - DNA, 465 bp, Homo sapiens
cggtccctgtacgagaaccgtagaatgcttcacgtcttccatccagcttgagggctcctgtgcagtccttcactgcttctgtgtactgctgtcaggacctactaggcagagtgctctgtagctgtacgtggcagattccaggttactacacaagaggctttcactgtacttctcaatagctttcttatggtttcccttctttacaagctcattgccttcttccttcagaactctggctttctccacatccccagcagaaggcactctgttctttgtagctgtggtttctttggatttgcttttagccatctctttgtggttctccgaaaggcaggaattccacctcttctgagctgaaacaggcaccaaggggattgagggcagctttcaggcgccactcaggcccaagcgagtccatgagagctctggtcattctgttgatgccttctacggcttcgtcggtca

SEQ ID NO: 671186 - DNA, 825 bp, Homo sapiens
  misc_feature (825)..(825): n is a, c, g, or t
accacgcgtcgacggcaggcagagttaaaacggaaatttagaacagttgaaacaggagagaattagtcgatatcagggggtgaatctctacattaagaacttggactgacactacttgatgatgagaaacttacggaaagacacttttctccttttggatcaacttaccagtgctaaggtaactgctggaggactggaatgacagcacaggcgtatggctatcgacatgcatatcatcaatcatccatgaagaagcaaaccaaagacagaacacatgagaatagaactggacagcatagagggcatcacaaagccacaatatatagttgcccatggacccagaggacaggaagagagaaaggcatcacactagacacaaaccagaaatatgcaacacgagatggcatggaacagagagacacaaacacatgacacaaatgcacaaacattacacaatacaaaaacacagacacatggacagacgacggtagcgaccacatacgaaagacaagaacaaaacacaccaaagagcatcagagaaaaagagacacgtacaataataaataacacacataaacccagacaaaagcaacaggaaatcgaaagaaccaacaaaaacacaacgacacagcaaccagcacaggatagccgaagcaaaacactccaaggaacaaaccaacaagaacaaagagaaaaagaagaccaaaacaacacaaaaccatgaaagccaaaaaaccaaacaacataaagaaaaaacatagcgcaacccacaaagagaaaacagaaacaacaagaataaaacaagagcaaaaagcaaaacaaaan

SEQ ID NO: 671187 - DNA, 352 bp, Homo sapiens
  misc_feature (42)..(42): n is a, c, g, or t
  misc_feature (112)..(112): n is a, c, g, or t
aaaacccgttttccagagtccttcaaacaagcttgggaggantggagttcaacattgaccttgcccaaaaagaaggtctgcatcgactttgggcacagctcagacaccctgntggcaaccctcaacaaaacaggaaaggctgtttcctaccttggccccaagtagccaggacctgggcgagtcttccggatataaactgaagaggcaggctgttgatctggtctccccggcagatctggaacaccaactgctcagtccagtccagcccagccatggagttcctgcccagacaggccttccccgctggctccctgcaagcttccatgtaataaagtcaagctgagtttgttga

SEQ ID NO: 671188 - DNA, 318 bp, Homo sapiens
ttttggggggtttggggggggaggaaaaccaaatgggagttgggggagggggggaaccagttcgggaaccccccgcctggagtcagggccaggggggcagggccccccttgtatccaaaagttcccaggggggattgtaatgggggttgggactggaggttgaaaaaggggtttttaaaaggaagggggcaggagttggaattagtgggccccccctgccccccaagggggggggacccccccccccccacttttaatgttttttaaaggcatttgggttttttaaaatttggccaccaagagcacctttttttgtca

SEQ ID NO: 671189 - DNA, 366 bp, Homo sapiens
  misc_feature (37)..(37): n is a, c, g, or t
  misc_feature (48)..(48): n is a, c, g, or t
  misc_feature (59)..(59): n is a, c, g, or t
  misc_feature (67)..(67): n is a, c, g, or t
  misc_feature (218)..(218): n is a, c, g, or t
  misc_feature (231)..(231): n is a, c, g, or t
  misc_feature (283)..(283): n is a, c, g, or t
  misc_feature (320)..(320): n is a, c, g, or t
  misc_feature (322)..(322): n is a, c, g, or t
  misc_feature (333)..(333): n is a, c, g, or t
taatgttggtttccccttggaagttcctttttaactnccccaaacccntgtccttaagntgtggtcngaatgtgtcccttcaaaattcatatattgaaatcctaacccctgaggtgatggttttaggaggtggggcctttggaaggtgattaggtcatgagggaggagccctcatcaatgggattagtcccttataaaagagatcccaaagagttgcnttgtccctttcantatgtgaggaagcagtaagaaggtgtcattttatgaaccaggaagtggcccntcaccagagaccaaatgtaccagcactttagttttgnanttcccagcttntagaattgtgagaaataaatttttgttgttaat

SEQ ID NO: 671190 - DNA, 582 bp, Homo sapiens
agcgggccgggggcggggggcggcgggcgacggggcgggcgcaggatgagggcggccattgctggggctccgcttcggggaggaggacgctgaggaggcgccgagccgcgcagcgctgcgggggaggcgcccgcgcctgacgcgtgggccctatggccatggaccaccagccagctgtatgactgccgtgccccatttccagttccaagcagttgagtgttaattgttccctttgccgcatttcacacattcaatttggtgaaggacaccaagacgtggagtcctagcgactgccgcccgtgggcagtttcctgggtgggcagcatggcatgtggccccagcacatggagcggacactgcatgccgaggccttcggccctggctgccgtgctccactgcaggcatgcccatgcctccggccgcagcctcaggaagaagcggcctgaggacttcaagtttgggaaatccttggggaaggctctttttccacggttgtcctggctcgagaactggcaacctccagagaatatgcgattaaaattctggagaagcgacatatcataacaagagaacaaggtcccc

SEQ ID NO: 671191 - DNA, 199 bp, Homo sapiens
atctcctgagctcaagcaatcatcctgcctcagcctccccagtcaactgggactacaggcatgcagccacacacccagctaatttaggtgtttttcgggtagagctggggtttcacccatgttggctaggctggtctcaaactcctgccttcaaatgatctgcccgccttggcctcccaaaagtgctggagatatacaa

SEQ ID NO: 671192 - DNA, 838 bp, Homo sapiens
gcctgcctgtgctcccagcatggctgtctctgcagtctgatgggcaaggactctgctgtgcattctccactgccgtctactcgtgccactcctggtcccgacacctagcctgcctgtgaaagaacacccggaaatgaaaggccaccaagaagaaatggcactaccgtcctaggaccagacgacaacatggcgctggatgcacccaggacccgggccctaagtggatcacacaccacacccgcacgacacccactctaacaacccaccgtgccagcaccctctcacccctgtcccgcacctgcggcccaatcacacgctaacaccacacacggccgtcgcccccatgcgcgcccagcgacgcgccacacctcccagaaaactcaacaccaagcattcgcaccacaacaccccctgcccccacggaccacccacgttaccccaccccacccacacgccacctgctgccacgccccctctaccgacgccacaccacagccacaccgcaccccgcgccccaccacacgcacacccgcgaccaccccgcacccagcacaccccgacacacgaacaagccataaatccacacacccggccaaactccgaaccaccaccaccgcccccaagcaccccaacccacccacacacaagccctgacaccgcgcaacaccccccacagcgaccacgaacatagccaggccccaacaccacaccaaaacccaccagcaccacctaacggaacaacccacacataaacacaccgtccacccaacgaacaacccacccaccaccagccacgaacacaccgacaccgggcacccaccccccacacaccctcaca

SEQ ID NO: 671193 - DNA, 752 bp, Homo sapiens
attttttattattttctgtctttatatttttattgcactgaaaatgcagcttcttcattgggtcaatatcacctcttcatcgaccccagaaagggagtggggaccctgcatgctgccccctccccgaccccggggtctatctggcaggactggggaagggagcctctcagggggtggcggtccacgcccagtaagcacctgggcagctgtgcggcggccgaggcagtccgaaggtgtggggtcagctctgagctctatgtgcaggtccggtaccccgagcgccttgccagtcgggacgccagggcccatcgagtatatagtcgctatgcgcgcccagggtgcccgtgcgccgtggggctgggccccagtcgtgcctgtgcccagcaggtccggttgcccggtgcgccagatctcccgcaggatccgttcggctcctccagccgtgtcgcccgtctccagtctcctccgccgacgtgaacacgttgaccgtcgaggggcccgtccggctctgcggacagctcggggcccgggaagcagtgtcatcgagggcccagccggaatcaccggtgtcctcctacgatcctgcgtacgcaagtccctcggagctccagggtgactgctgacgggggtcccggaaggctaagccgggccccgggacccgagagcagagggcccacgaaatgcgtctacacaccacgcgagggtcgacccacgggccccaaccaacgccccacaagttaaagcaaaactca

SEQ ID NO: 671194 - DNA, 286 bp, Homo sapiens
acatctatgcctcaggcatgtacatgcagatgtacttgcaagttcttacattctttacgtcacaggtctaactcagttgatggcccatctagggagcttttaaacatatcctcatgccaagctccgaaacagatccattcactccaaatctctggcagtgaggcgcaagcatcattattattacaagttaccttagccaactctaatatatagttgtctggatgagaatcatctgttgcccaggctgcagctcagcggagcgacctcggctcagtgcaagctccgc

SEQ ID NO: 671195 - DNA, 161 bp, Homo sapiens
tgcctacaggatcctaagaggaggaagggaacccgtaacacgaagcttaagaagaaggataaaggtgaagctggtcagagaagaaacctcctgagtgctgacatgaatatttttgaacgaccttggggattactgtaccctcctctgtgccctcctctgtt

SEQ ID NO: 671196 - DNA, 286 bp, Homo sapiens
  misc_feature (188)..(188): n is a, c, g, or t
ttgttcctcgaggacgcccaccccctctttcacaaagaattgtccagccccatatgctaaaagtaccagggttgagaaaccctgaactacactgagggattgagattacgttcaaaataatattgaacactggtagtgaagtctgaatttaaagcactggcatatttattcattcaacaaacacatancaagcacttaacatgtggcgctggtgtctaggggccaagatgctgtggggacccaatagacgtcatcgaagaaccaattaggagtaccgagctggaat

SEQ ID NO: 671197 - DNA, 208 bp, Homo sapiens
  misc_feature (53)..(53): n is a, c, g, or t
  misc_feature (61)..(61): n is a, c, g, or t
  misc_feature (66)..(66): n is a, c, g, or t
  misc_feature (89)..(89): n is a, c, g, or t
  misc_feature (175)..(175): n is a, c, g, or t
ttaattgaaataaggaacagtccagtgatggtggcagatggaaacaccagtgnggaaattnggatnccaaaaatgtccaagtttgagtnccaggggaattcaattcttagaacctagacacccattttctttaccattgtcattgtgatttttgcactgttttgctattcagccncttatctgcatggaataaaaccataaattcttt

SEQ ID NO: 671198 - DNA, 155 bp, Homo sapiens
atcatctattgacgtacataaacacggcaacaagcaagccatcatttagtaaatctcgtacaaagaaactctccagaatctaatggcatcacagatcctcgcatcaggcacatataaccccgattgtcttgttttctatcgcagcaatcagcttt

SEQ ID NO: 671199 - DNA, 195 bp, Homo sapiens
cctataaaggtttttaaaattcccggggaagctttaatgacgtttgcccggagtttttctttatataatcaaaattgaaattggtggtggactatggaactttattatgcctttttccgtcccctttcaaagcaaaagctttttccatgggaggaatgtttagttttaattggcttaataaattttttccttaga

SEQ ID NO: 671200 - DNA, 350 bp, Homo sapiens
ggctatgtggacatcgtgatcagcagagagagatctctgtacacagacacgagaacccatgaagagagatgaaatcatacacaaaaggtgtgtggacaggcagcagagatagagatgcacgaaagtgtccgagacatcacgtgtggctccagcccatgtaactgacagtgatagacacctctatctgccccactgtcctggggtcgctcttgggaggcacgggcatgggcgtgtctggactcattctgtatcaatccagtgtgttcctgtcatagttagtgtctcccaagcaggccatggtaagggcctcgcaggggccattggggagcacagggtcaggcttctcggga

SEQ ID NO: 671201 - DNA, 294 bp, Homo sapiens
tacgagtgactatgagtagcaggactaccgtgacaatcctaacatagtccattcttaatttaactatatatattgatcctaaatactaccggataccggcggagtgcgaacttaaagctccaggaccacgagcctactagctatctcgcacctgaaacacgctatgatgactaacacccttaattccatccaccctcctctccctaggaggcctgcccccgctaaccggctttttgcccaaatgggccattatcggagaattcacaaaaaacaatagcctcatcatccccacca

SEQ ID NO: 671202 - DNA, 300 bp, Homo sapiens
  misc_feature (17)..(17): n is a, c, g, or t
  misc_feature (61)..(61): n is a, c, g, or t
  misc_feature (142)..(142): n is a, c, g, or t
  misc_feature (172)..(172): n is a, c, g, or t
  misc_feature (183)..(183): n is a, c, g, or t
tggcctcctcaccaganccatctttttactgtagtttccccacgcggatgtctggagacangcggcccccccagatcaccggtctctgtcccttcggtccccgggagatcctggtgggggatgaggagaagcggacactganacgcttctctcacagcggagaatacaaggncaccgcgccgntccctgagggctgctccccgtggagcgtcgccgccctagagagcggggtggtcttctctatagcgcacggtctttctcacaccccaggagatgtgagtggggagggcctgatctctc

SEQ ID NO: 671203 - DNA, 199 bp, Homo sapiens
ttttttctgttcaagttctaaacgctgcttgctgcctgctgcaggatctgctctctctcttttcggagttcattttttaaaatggctattcatgctccttgtactcttcatccagtttcctaggttgtactcattccggcgctctatggccgcatggtgatcatccacctccaagggccattaaagacttgaggcttct

SEQ ID NO: 671204 - DNA, 218 bp, Homo sapiens
  misc_feature (114)..(115): n is a, c, g, or t
gatcgactggtaccaatgaggtctcgctctgtagcccagactgttctcaaactcctgtcctcaagcgatcctcctgccacagacttctgggaccacaggtgtgcgccagcatcnnagcttatttaaaaaaaaatttttttttttttggtagtctccctatgttgctcaagctggtcttgagctcctgggctcaagcgatccgccccccttggtcgacg

SEQ ID NO: 671205 - DNA, 491 bp, Homo sapiens
tccactagtgtaggcctgtgtttccctcctgcaagcgattgacccttgagaggatgaaaatgatgttagacaaaaagcaaattcgagcaattttcttattcgagttcaaaatgggtcgtaaagcagcagaaacaactcgcaacatcaacaatgcatttggcccaggaactgctaacgaacgtacagtgcagtggtggttcaagaagttttgcaaaggagatgagagccttgaagatgaggagcgtagtggccggccatcagaagttgacaacgaccagttgagagcaatcatcgaagctgatccccttacaactacacgagaagttgctgaagaactcaatgtcaaccattctacggtcgttcgacatttgaagcaaattggaaaggtgaaaaagctcgataagtgggtgcctcatgagctgactgaaaatcaaaaaaatcgtcgttttgaagtgtcatcttctcttattctacgcaaccacaacgaacca

SEQ ID NO: 671206 - DNA, 722 bp, Homo sapiens
  misc_feature (50)..(50): n is a, c, g, or t
  misc_feature (103)..(103): n is a, c, g, or t
  misc_feature (133)..(133): n is a, c, g, or t
  misc_feature (142)..(142): n is a, c, g, or t
  misc_feature (212)..(212): n is a, c, g, or t
  misc_feature (282)..(282): n is a, c, g, or t
  misc_feature (285)..(285): n is a, c, g, or t
  misc_feature (322)..(322): n is a, c, g, or t
  misc_feature (332)..(332): n is a, c, g, or t
  misc_feature (335)..(335): n is a, c, g, or t
  misc_feature (358)..(358): n is a, c, g, or t
  misc_feature (361)..(361): n is a, c, g, or t
agcggagagcacatccggtgttagaagcgctggtaggccttggagaggcngggttaaggaagagtggagactgctgcacggactctggaaccatgaacatatntgatcgaaagatcaactttgatgcgctttntaaacatgnttctcatataaccccgtcaacgcagcagcacctgaagaaggtctatgcaagttttggcctttggtatgtntgtgggcgggctgcaggggcctatgtccatatgggtcactcatttcattcagggctggcctgctgtctgnctngggctccctggatattgatgatttggctgatggcaanacctcatagnccntgaaactgaacagaaaagactgnganttcttgctggatttgcattccttacaggagttggcctgggtcctgccctggagttttgtattgctgtcaagcccaggatccttcccacatgctttgcatgggcacggcacatgaatctttaacctggcttcagcactcagatggcactctatgccaagggagccggtagactaccttctttctgcggaggtatcttggatgtcaggcctgagcttgttgcttgtgtcttccctggggaatgtggactttggatccatttggcttttccaggcaaagctgtatgtgggactggtggtcatgtgtgggcttcggcctttttgatactcaattcattattgcaaagggcgaacatggagatcag

SEQ ID NO: 671207 - DNA, 454 bp, Homo sapiens
cagaagtaataagcatggagcttaatttgtgaactgacaggttcacgtggctactttgtcaggccacttctggcaggggaccagagagccacgtggtcaggacacagaaggccacttactcctcttggctctgcatgaggttactcatgcggttatgtacaagcagtactcactgaggaggaatagttaagaggagtctgttttatgacagttaaagaagttgccctgtaagctggggcctttctgccaactctgattagcgtctgggtttgtaacaagaaaacaacaaaagattgtgcaggggcagacgaaagttctgatcaagaccgagattgttcacgttggcttgtgaatcaagtcagctgtggtgctgaggactgttgagtccatactctgaacagtccttgactgatcttgtccccgggttctctgaggtgcagcagcatatagcatt

SEQ ID NO: 671208 - DNA, 524 bp, Homo sapiens
  misc_feature (1)..(1): n is a, c, g, or t
naaagatcctgtttcagtggttttttccagttactcatgccccaaccttgggatcatccttcattcacctctcttattctggtctcttataatccacatggtctttctttttttttttttggaaagggagtctcattcggtcgccaggttggagtgcaggggcatgatttcggttcatggtaacctctgcctccggggttcaggtgattctctgtgagtagcggggactaggggttgtgcaccaccagtcggggctattttaaatctttggtagagaggggagtctcataatgtggccaaagcgggtctcgagctctgggcctcggggctttaacacgtatgggcggttatgactagaacattggtcccagtatcggcgtgtctcattgggttcaactcggctcaaacatcatttccccaaggagggcctttcgtgtttacttaaaatgggcacccccaaagagtcttaatttcctttttccggtgaacgttgtaccacctcgaggggaggaccgtctccagat

SEQ ID NO: 671209 - DNA, 110 bp, Homo sapiens
ctagaggatctcgccaggtaggactaagctgatagaaaagcgattacctaaaagaatttcacagcgggaagcctattcgcaggatttctcattactatcaacatttcccc

SEQ ID NO: 671210 - DNA, 340 bp, Homo sapiens
aagctgctcctggccatcgttggccagtgagaagggtccttttcccctttaaggaatgaagctcttcaggacctatccttccatgcaatgagacctgcatgcagccatgtcagataccacctgaccagagtagttttctactgaagactgtcagggggtgtgctgggtttgcacatgttgttactgccttaattctaatgttaggtttttttttttcctgtatccaatcagtgtaaaagccatatcaatgacgtagtaatgtaatatttgtaaagctttgctctcactgcttttattttaatccggatttcaaattgaataaaagtcacaacaatctcta

SEQ ID NO: 671211 - DNA, 256 bp, Homo sapiens
ggccggaacttttgggccgggcccctcccagggcccccgctccgtgggaaaaaacagttcctccatttccttgaaaattgaacgatttttaaaaatagattaaatttcgctggaaataagtacccagaaatttcaggggagggtgccgggtccttcccgggcctggggttttgaaaccacccaggtcccccacctcccctttaaaaaatgcaaattttttttttgacaaaaatcacatacttttttttttaattta

SEQ ID NO: 671212 - DNA, 381 bp, Homo sapiens
gatctcgcgacccgtcagacgctgaactatgtgtttttaaggctggttccctttgtaaatggtctcaccagatgttgttagctggactttctgagatgtggattaagcttttcttttcttttcttttcaagaaagagttttgctcttgttgcccaggctggagtgcaatggtgccatctcgactcactgcaacctccacctcccaggttcaggcgattctcctgcctcacgctcctgagtagctaggaatacaagcacccgctaccacacctggcaatttttttttttttttggaattttaagtagagacaggatttcaccatgttggccaggctggtctcgaactcctgatttcaggtgatccgcccacctcagcctccc

SEQ ID NO: 671213 - DNA, 685 bp, Homo sapiens
  misc_feature (74)..(74): n is a, c, g, or t
  misc_feature (142)..(142): n is a, c, g, or t
  misc_feature (324)..(324): n is a, c, g, or t
gtatgggcgtgttgagagaggcgcgcgcgcgcgcccgcgggcccgcgctccacatttattttcactctctcacnatctgtatccactcccccccgcgttttgttgttgcgcgcgggggtacattttttccggggagccctcncccgtgcgccccttaggggccccttaaaactgttttttccaaaacaggggggggcggggcggtattccggggtattttggaccccgcggtcccctccaattaaaggacaaaagcggttcttcccccccctcctaaggggtgtgggaaaaagagggttggttcccctttttttaaaggggggnccggtttcccaaaaaaaaaaaaatccccttttccccgggtttaaaccaaatttagccttccccccttggagccccgggggtaaaccccaggggggttttttttattttcccgcccctgccaaaaatggggaaattttgtttaaaccccgggtgggtttccccgggcccggaaaaaccggttttcccaagaaatttctttccccccgccggggggggtggttttttccccccccccaaaaaagggggcccctgcccccttttttttttaccccccagggggaggtttttttttggggggggggtccaaaaaatttttttggggaaatttttctttttcctttatttaaacctcccttttgga

SEQ ID NO: 671214 - DNA, 889 bp, Homo sapiens
ccgttcttgttaataaactaacagaaagacaaaataaaaaacacaaaacaccaagaacacacaaataatcggacttcccggcaatgggttttcggctcctcaattcgtcccttgaatcccgccattggaaaccccccaatttccaaggttacccatgtacctgcgttgcaaccgaccctgggaatacacaagaggtctcttctccaagaccccctccccgccgtgttgcaatctgtttttctgaaatacttttatcctctattggcatctcgtccccattgctccacacacctccttacgccaatgttctcctaattgttaggccttctgttccaacgacactttttccccattctccgccccccaccctgttgcgccccgaggctaccccccgttctggtttgccgcagcccgccctttacccccttttgggagacacccccccctctggtggttacccctgccacacctgcgcgggcaggatcacccaccttgatggtttctacacacttttatctgccaggaccgcccctctctttccaatctatccggcggtgttggatcgccccccttctcctcgtggtgacaaattcacccccccactcttgtggcaaaaattgcacacacacagtctttcatagcaggggccaatagccccccatagcacaccctgaccttggtataaccgacattctgaagaaaaccacccagaggttctttggaatcactttctttcgagaacatgtggatatttgtcccccatataccccaaacagaataggaggaaacccctattatcctaatattgtcccacccaaaacaaaaagtgcaccgttgtctcaaccacccgcggggaaaagaacccccctggggggcggcaaacataaca

SEQ ID NO: 671215 - DNA, 826 bp, Homo sapiens
  misc_feature (302)..(302): n is a, c, g, or t
gggagtcgaggtttcgggcttgtaccgcttggcggtgcggcctggtgtcggcttgcaggttcttctgtgttgttctctgccctgcaagggcgtagagctgctactctcctctgcaagggcctaccgtgggggccacttaaccatccgccttgccttgggtggttgcaccaaatccggccgttctaccgcatgtgtggttgctcacaacaagtgtcccagggaatgggccggtttcgtagagcagctgggtcctatgatccatgggcccaacagtcatggagaaaaaactcgttggccctcanactagacgagggatcgcgtcatgtgatgtggttggggggcccaacctctcttaaggcctatggaaaaagcttctgggtctgtgctgggttttttccctctgcattcctatgattgatcaccaatagtgttgagagactgggaaggaaaggggcacggtgaagtcctgtttagtttctcagaaaacagatgcaggaagttacaagatacagacggctacaagaaaacataaatgagctgactttagtggagcatacgcagtgggaacaggtcaaggtcttttttgaaacaagtggaagggatcttaaatttgtgtaagaatggggcgtcaataacttgggtttccaaaaaaaataaaaaaaaaaaaatgggttggggggtggagcagaggaaagtttttaacacctttgggggggggggccaagttggtgtgaaattggatacgtgtcaaggattgggtaggatggtgtggttccaaaaaaaagcggggccgggtttggaacaggggtggttggtaaggcagagg

SEQ ID NO: 671216 - DNA, 193 bp, Homo sapiens
agtactaggtaatagcttaaactagtcaggttaggtctcaaggcaggagtcaggggccaggtttgtggctccgtcaagcacaggcctcagcatcaggggcattgtagcggtgtgtgcatgctcagggtcagcacatccagcagcaaagtgtatgtgggcacagcaaagttcagcatttcacgcgcgcatgcac

SEQ ID NO: 671217 - DNA, 215 bp, Homo sapiens
tcctgctcggctcccaaagtgtgtgatacaggcgtgagaaacatgcccagcgccatgtcatttttaatgcctggattgactttgtgggaatgaggcaaggtaccttttaagatgtcagctgtatagcatactagtagtgaatgtaggctatgaagtaagatgcatctgggtgtgagctgtgactagtaatatactaggtagtgtcatcttgcaca

SEQ ID NO: 671218 - DNA, 593 bp, Homo sapiens
ggtggctatcatcccatgtcacatgccacctcttgtacattgacagtggctccctggaggctgttctgggcagagaaagaaaaggttcagtcctggaccagcaatagaggggcatgagagggacagggcagcatgcatgctgctgacccaggaggccacctgaggccctcccagcataaaacccacctcctgccctcccctgtgtgctggggagcagcccagagatgcagacacacggccaggaccatgctcccatctgggttgcacacaggtgtcattattttggaagtggtgtggcttactttcaggcccaggaaggcttgggaagcttgacctcacaggtgacagactcaggaccagggagcgcagagcctgagaaatatccccaggtgctgtgtgtgctgtgatcaagctctggcctttcccacctgaaaccaccagcagattaaccctggcccccaggtccacggcagagcctgaacacacatacacaacttccccactcactcaaacttgccaacagatccagcaaatgtggtgaaacaaaaacaagtccagagaagtaagtgctgccagtttgatatggttccaga

SEQ ID NO: 671219 - DNA, 106 bp, Homo sapiens
cttacacgcacctttcactcacctgacgtgtcactcacctggcttcttcccggaaacacggggggggttttgggtacccgcgctcgaccttcgtcctcttggtcct

SEQ ID NO: 671220 - DNA, 139 bp, Homo sapiens
gtcacggcactgcaccttgcgcacagcggcgccaccacctcctcgggggcttgccgtcccgcgagatgcgcctgagcagctcgctgtaggtgcgccgtccagccccggcctcttcctgcgcccgccggcgtcaggcact

SEQ ID NO: 671221 - DNA, 353 bp, Homo sapiens
  misc_feature (70)..(71): n is a, c, g, or t
  misc_feature (112)..(112): n is a, c, g, or t
tcttgagtacttgagctgggccttgaacgagctacagtgtgtgcagaagggtgagaaggaggggcgtggnnggacccagtggatcgagggtgatgagctgcacctggagatnagagtggaaggtgtggtctgcaaagcaaagtattcaagaaggtgcagtgaggcccaggcagacaacctttgtcccaaggaatcagcaggatgtgtgggccaggatccccctttttgcccagcattaggcaaaaatgtccaaccccccccagggatttgttaacagagtctgttttttgggtttgtcccttttcctttttttaaaacaaaacccatgcccataaagtggtcttggtgttcca

SEQ ID NO: 671222 - DNA, 434 bp, Homo sapiens
agcagcctgagttattttagtggacggaatcggaacacgctggctccatatcgtgaaattgtacattaatgtctcttacttatttgcctctgttacttcttatatctttttcctttcttcagactccgtccacggagatgctctccccggtcttctgctgcaatttagattcctttcccttctctccagttctccttcccttaccaaggagaggggagcaaatggttgtgggcaagggatttggccatacatgtcaagctggtagtgggttgttcaaggtgccatagccacccccaaactatgttttgtttaaacgcgtggggttacttaattctctgcacacccttgtcaaggggagtctagtaaagttgccgagggtaggttcatctccaggtttcgggattcccatccgtcctggcgatcctgccagcagt

SEQ ID NO: 671223 - DNA, 241 bp, Homo sapiens
  misc_feature (33)..(33): n is a, c, g, or t
  misc_feature (149)..(149): n is a, c, g, or t
gaggatccgtagtatcgccacactacttcttantctgagcctgtaagtatatttagattataattccaacccagaaatgaagctatatgaatataagaccccaacagaaaaatctgtaaaacgatcagaccataaaatcacataccttnctatatggtcatgcagagacacagatctttgttccggagtttgaatttaaatgccaagcttcagagcctgaaaatgtctaaaatatagaccc

SEQ ID NO: 671224 - DNA, 120 bp, Homo sapiens
gtattaggaaatcaccagtggcaggctgttacctggctgcttcagtatcctgttattactgggagaccatcagtatatggctctgtccagggaccttcaatatcctgttggctggcgaca

SEQ ID NO: 671225 - DNA, 190 bp, Homo sapiens
ttttttgagatagggtcttggtcacctggttggagtgcagtggcatgatcatggctcactgtagccttgaactcctgggcttaagcaatccttccacgtcagcatcctgaatcactgcgattacaggtgtgtggcaccatgcctagctaattttaaaaatttttagtaggtagagacagggtcgtcgacg

SEQ ID NO: 671226 - DNA, 296 bp, Homo sapiens
cacaggggtccagtccctctcaaagcctgatccattcattcctgtactccatcttcctaaggccctctggcaccagccaggcaataactcccatcccattttacaaatgagaaagtagaggctcaggccaggtgctgtggttcacgcctgtaatcccagcactttgggaggccaaggtggttggatcacttgaagccaggagttcgagaccagcctggccaacaggcgaaaccccgtctctactaaaaatacaagaattaactgggcgtggtggtgcatgcctgtaatcccagcta

SEQ ID NO: 671227 - DNA, 367 bp, Homo sapiens
gagggataaaagccttggtgtttataaacttctttgggttggtccctttacttggcatttctttttggatataatggtcccgggacagtgtgctctttctgagatatttattgagtttttttttaaacaggctattttttatgccctggccgtatttcagtccctggcagagatagagtctacctataattcaaacatcttgtgaccccgtaaccgcaagtatcttcttgggatattgagctctttgtatattctggggtctcatctaatattgtagtcgtgagctggtgcagtgtatgggtattgaaacatggattccaaccccacagtctagtctaggacgggcagggcaggaagagtacactgt

SEQ ID NO: 671228 - DNA, 483 bp, Homo sapiens
  misc_feature (7)..(7): n is a, c, g, or t
  misc_feature (69)..(69): n is a, c, g, or t
  misc_feature (123)..(123): n is a, c, g, or t
  misc_feature (150)..(150): n is a, c, g, or t
  misc_feature (152)..(152): n is a, c, g, or t
  misc_feature (156)..(156): n is a, c, g, or t
  misc_feature (162)..(163): n is a, c, g, or t
  misc_feature (165)..(165): n is a, c, g, or t
  misc_feature (168)..(168): n is a, c, g, or t
  misc_feature (185)..(185): n is a, c, g, or t
  misc_feature (187)..(187): n is a, c, g, or t
  misc_feature (198)..(198): n is a, c, g, or t
  misc_feature (245)..(245): n is a, c, g, or t
  misc_feature (257)..(258): n is a, c, g, or t
  misc_feature (277)..(278): n is a, c, g, or t
  misc_feature (296)..(296): n is a, c, g, or t
  misc_feature (304)..(304): n is a, c, g, or t
  misc_feature (313)..(313): n is a, c, g, or t
  misc_feature (333)..(333): n is a, c, g, or t
  misc_feature (355)..(355): n is a, c, g, or t
  misc_feature (481)..(481): n is a, c, g, or t
agaggtnccccaaatacaactcatgagggtttcaatgtcaccctccacaccaccctggttgtcacgacnaaactggtgctcccgacccctggcaagcccatcctccccgtgcagacaggggancaggcccagacaagaggagcagtccancngcangaccanntnctncagcctccttgtcctancnatctgcatcanattggtgcatttactgatccgatacagattacatttcttgaccaganagagttgcagtnntatctataggtattctcannggagcagttataaaaaanaaagagtntaaaaaacnggcgaattggaaggaagaanaaatgtttcgtccaaacatgtntttcctcctcactgcttccccctattatctttgagtctgagatattcattacacaagggtaacttctttcaaaatattggttccatcaccctgatttgctgtttttgggacggcaaaccccgcacntg

SEQ ID NO: 671229 - DNA, 558 bp, Homo sapiens
aaataactcttgaattgaaaatatatggcagcaatatacgtgtactatagtcttaatgtaattagaataatatcatgagaacgacgatccacaatgatggacactcagaaaacacgtcctacctactcggaaggcagaagcagtagcatggcatatacccggaaggcggagcttgcctcgcgagccgcgatcgtgtaactgcactccaaactgggacaacagaaccagactccgtctcacaacaaacgaaagaaagaacacagtccaaggagagaattctaatgcctgacagaagtaatggttagaatgagggcttctaactgaagtcttcacagacataggatagaactcttagcaccagatatactgccaataatagagttagatgtgtgtcatttgctcattcaaatggaggtggcatcctgtcctctaaaattatatcatgatccgaagaaaatgaaactgtacccatttctactgcatggctgaaaatgatttgggctgattataaaaattaagttgtaatggcctgtatcagtatacttacacataaaaatg

SEQ ID NO: 671230 - DNA, 406 bp, Homo sapiens
  misc_feature (317)..(317): n is a, c, g, or t
gcgaggagtcccaggctttcagactgaactccattccgtgagcgagcccacgtaggtcttctttttatccacgggcatcacgtccacgagcacccccgactctcagttgctagatgactcccgacgtgcacggctagtcttgcagaatgctctgaggtatctagcataagatgttaggttccacaacaccggtagcccagatagggcaggttcgctctttgcacgtgtgccgagacaataggattcttagggcacgtgagttagctggcgttttcaaaccgggcacagcgtgagcaacgcgtcgtgtagcagcccanaatcctgcactttcacttttgacaccatgaatgagctggaaggtttgtattcgctgagggactgcacgccgtgtctctcagacttcacg

SEQ ID NO: 671231 - DNA, 417 bp, Homo sapiens
tgagtggcatgtgacctcgtgatgtatatgcccagctgtcgcaatatcagtgctatattatctcggaacatagaggctccttatactgtaatttaagagtgctatgtgctaaggatgaagatacaattcctcagctctatggtagactatagggaagctcagctagtggcatgtctcccagatgtggtacttcaggaactctttttcaaactcacatcacagtacatctggagatagtctaagaggcagcctcttttacaccacaccattgcgaacatcggaggatcttattctcctggtcattccttggtagatatttggaataaaataatcacactgactgtgatagggtagatcacattccatattctcctgtgagtctcagaagatgcttcatttagtagaacggtgtaagtg

SEQ ID NO: 671232 - DNA, 260 bp, Homo sapiens
atacacgatctgttaaaagatagcacagggccacgtgtgatttacgccaaaggcagcgccacgtccccagcaaggaggccacagtaacttcctcaccagtaccgggggtggcaagggtgaactctaggggagtggttcatcacttcggtgcagccattccatgatctgctttttattcgggtaaaagacatgtcttgcaatagttcgttttcctcaaccaagctaatcagctcacaaaacaacatcgtctccacgtgatc

SEQ ID NO: 671233 - DNA, 273 bp, Homo sapiens
ctgagggacggaatatggcgatcactgagaaagctatgggaccgtgcatggtggattatgcctgtaatctcagcacttcggaaggccaaggcaggaggattgctcgaggccaggagttcaagaccagcctgggcaacacagtgagacctcatcgctacaaaaaataaaaacataagccaagtgtggcggcgtgtgcctgtagtcccagctactcaggaggttaaggcaggaggattgcttgagcccaggagttcaagactgcagtgagctatg

SEQ ID NO: 671234 - DNA, 99 bp, Homo sapiens
agtagatacagcaattaggagttgcaacggtctaggcagatcattcaatctatgagcgtagccacatgtaggcatactattacaggcctagatttaagg

SEQ ID NO: 671235 - DNA, 154 bp, Homo sapiens
ttacgcgcagctgtcgaaaactgtataggcaaggggtacccgtcactctgaagaagaatatcaaacggaccatctaacagaactgtactgagcggctcctcttccccactacatcttaacttcacgtggctttacggtctggcaaactttccac

SEQ ID NO: 671236 - DNA, 429 bp, Homo sapiens
agactacgtacataacctatacctactccaatgctataactaatcgctctagcagttatattactaccactgacatgactgtccaaaggacacataattagaatcaacacaaccacacacagactaattattagcatcatacccctactatttcttaacctcaacaacaacctatttagctggtccacaaccttttcctacgaccccctaacaaccacgctcctaatactaactacctgactcctacccctcacaattatggcaagccaacgccacttatccagtgaaccactatcacgagatacactctacctctctatactaatctccctacagatctccttaattataacattcacagccacagaacttcatattttatgtctatttcgagaccacacttatgcccaccttggctatcatcacccg

SEQ ID NO: 671237 - DNA, 901 bp, Homo sapiens
ccatgtgcggcgcaagcaggcaagccccagcacctcaactccgattgtgagccggggctgcgcgccgggatgttgtgcggaggtggccccgcaggtggcggggagccgggtgagtagcgccgtggaagccccgcccgggggctggtggccggtgctcagagtgttctccgtgacccgcgcgggtgcgaggaccgtcgcagggggacctgaaatgggcgggcgaagcgtccggctgcagagtcctgggcactcggacctgggcttccccgccccccgcgctttgtaagttacactctccgtggagtccacctgtcccccttccccgccttggattccgtctagcgcagctcctctcgaaggagcttaagtcaacggagatttgcctcccaaaatagcgctggagggtatgctcaagatggacccctcgagaggcctgttcccggggaatgcgcgggcaccctgagtttccgggctccttggcgcctggggcttctgtgcgtgcgcgccgtggccaggtggctacttgcctttggggctcccgttacacatctgcgttgtccagggagggcctcaccgagtgagcgggacggttcggagccgaaagacccggaaaggattggggagcggcagccgagtcttgtgcatggcttcaggaacgttggattgatgagttgttcccagatgcaaacgtggctcttccagtgaaaaggcaatagaccacttcggtatggcccctgtatcattttcccttaagaggcaagggaacaaattgcgcccgttggagaaagaaggcggttcaacgtgttcctacccagggtgcgcccttccccaatggccatgggctaaaggagtgggagcgcccttaagatcccacgggggaaaagcggcgcagtttgagtct

SEQ ID NO: 671238 - DNA, 377 bp, Homo sapiens
  misc_feature (1)..(1): n is a, c, g, or t
  misc_feature (359)..(359): n is a, c, g, or t
natatatctttaagtggatggttgcatctgtcctgaacatgtatcgccttttttcttgtcattatttcctaaacaacacagtataataactatttatatagcatttacattgtattcattactgtaagtaatctggaaatgttttaaaatgtacgggaggatgtttgtaggttatatgcaaatactacatcatgttatatcagggacttgagcatccatgaattttggtcccccacggacactggaggttgactctctctaggctgtatctctgtcaaaggcccacctacagggacccatccacatgggctggacatagggaatgggcaatgttttctttaggaaaccacataggcctntgggaaagggacatgggt

SEQ ID NO: 671239 - DNA, 2601 bp, Homo sapiens
tacgggcctgcaccgccaccgcacaaagacgcctcgggagccgccgcctgcacccgggccgcagcagccacgccagccggagcccgagccgtagcccgagcccgagcccgagccgcagccagagccagagccggagccgcagccagagccagagccggagccgcagccggaaccggagccggagccgcggggcaggaggcggcgcccgcgggcggccgggcccggcatggagaagcgcgcggccgcggggctggagggcgcgccgggcgcccgggcgcagctggccgtcgtctgtctggtgaacatctttctcaccgggagactcagcagtgcggttcctgccttagcggcctgcagtgggaagctggagcagcacacagagcggcgtggggtcatctacagcccggcctggcccctcaactacccgccaggcaccaactgcagctggtacatccagggcgaccgtggtgacatgattaccatcagcttccgcaactttgacgtggaggagtcccaccagtgctccctggactggctcctgctgggcccagcagccccaccccgccaggaggccttccgcctctgtggctccgccatcccacctgccttcatctctgcccgcgaccatgtctggattttcttccactcagacgcctccagctccggccaggcccagggcttccgtctgtcttacatccgagggaagctgggccaggcatcctgccaggcagatgagttccgctgtgacaacggcaagtgcctgcccggcccgtggcagtgcaacacggtggacgagtgtggagacggctctgatgagggcaactgctcggcgcccgcctccgagcctccaggcagcctgtgccccggggggaccttcccatgcagcggggcgcgctccacgcgttgcctgcctgtggagcggcgctgtgacggcttgcaggactgcggcgacggctcggatgaggcgggctgccccgacctggcgtgcggccggcggctgggcagcttctacggctcctttgcctccccagacctgttcggcgccgctcgcgggccctcagaccttcactgcacgtggctggtggacacacaggactcccggcgggtgctgctgcagctggaactgcggctgggctatgacgactacgtgcaggtatacgagggcctgggtgagcgcggggaccgcctgctgcagacgctgtcctaccgcagcaaccaccggcccgtgagcctggaggccgcccagggccgcctcactgtggcctaccacgcgcgcgcccgcagcgccggccacggcttcaatgccacctaccaggtgaagggctattgcctcccctgggagcagccgtgcgggagcagtagtgacagtgacgggggcagcctgggcgaccagggctgcttctcagagccacagcgctgtgatggctggtggcattgtgccagcggccgagacgagcagggctgccctgcctgcccgcccgaccagtacccctgcgagggtggcagtggtctgtgctacacgcctgccgaccgctgcaacaaccagaaaagctgtcccgacggcgccgacgagaagaactgcttctcctgccagcccggcaccttccactgcggtaccaacctgtgcatcttcgagacgtggcgctgtgacggccaggaagactgccaggacggcagcgatgagcatgggtgcctggccgccgtgccccgcaaggtcatcacggcggcgctcattggcagcctggtgtgtggcctgctgctggtcatcgcgctgggctgcgccttcaagctctactcactgcgcacgcaggaatacagggccttcgagacccagatgacgcgcctggaggctgagtttgtgcggcgggaggcacccccatcctatggtcagctcatcgcccagggcctcattccacccgtggaggactttcctgtctacagtgcgtcccaggcctctgtgctgcagaatcttcgcacagccatgcggagacagatgcgtcggcacgcctcccgccgggggccctcccgccgccgcctcggccgcctctggaaccggctctttcaccggccgcgggcgccccgaggccagatcccactgctgaccgcagcacgcccctcacagaccgtgctgggcgatggcttcctccagcctgctccaggggctgcccccgaccccccagcaccgctcatggacacaggcagcaccagggcggccggagacaggccccccagtgcccccggccgtgcaccggaggtgggaccttcagggccacccttgccctcgggcctgcgagacccagagtgcaggcccgtggacaaggacagaaaggtctgcagggagccactggcagacggcccagctcctgcagatgcacctcgggagccctgctcagcccaggacccgcacccccaggtctccactgccagcagcaccctgggcccccactcgccagagccactgggggtctgcaggaaccccccgcccccctgctccccaatgctggaggccagcgatgatgaggccctgttggtctgttgaccgctgggctcgctggtgaccgccacagccccgctttgtaaccagggaatacacagtcattt

SEQ ID NO: 671240 - DNA, 100 bp, Homo sapiens
cccgctgcctgtcaccaacgggaagggccggcccgcctccctggccggggcgcagttcggaggttcaggcaagagcggtgagcggggcgcctatgcctcc

SEQ ID NO: 671241 - DNA, 161 bp, Homo sapiens
cacgaggaggtttcccgatgacaactccctcaaagactgactttcctgttcattgactctactgaaaccgtgtaaagattttgaagtggccaatcatatgaaagatttcgctgcgaagctgtctttaagacacatcccaccacctggaccgcaccatttgg

SEQ ID NO: 671242 - DNA, 199 bp, Homo sapiens
ggggggggggggggaaaggtttggggcaggggtcatttaagatattgggcaccagtttcctcctcatgtttatcctgttccctttgcttgaaaggttggtactccagatccttgtaaaaccgtttttccccctttgagtttcaggttaaatgtcccctccttggaggggttttccctgacaatgaagctccgcccgtca

SEQ ID NO: 671243 - DNA, 158 bp, Homo sapiens
cctgtggtaacacgcacctggccaggtcttcatgggcgatgtcggcgccctggccctcggcggtgccctgggcaccatcgcggtcatcacccggcaggatgatcctgctggccgtcatgggcggcgtcttcgttgccgaagcgctgtcggtaatggcg

SEQ ID NO: 671244 - DNA, 373 bp, Homo sapiens
  misc_feature (21)..(21): n is a, c, g, or t
  misc_feature (66)..(66): n is a, c, g, or t
  misc_feature (84)..(84): n is a, c, g, or t
  misc_feature (133)..(133): n is a, c, g, or t
  misc_feature (164)..(164): n is a, c, g, or t
  misc_feature (211)..(211): n is a, c, g, or t
  misc_feature (371)..(371): n is a, c, g, or t
cccaattgtgaaaaccccagntaacattttattagagctaccaggttatgtgaaactgttgatagntttatcactttcctttcnagatataggcaggggcagtggctcatgcctgtaattccagcactttggnaggccaaggtaggtggatggcttgagcccanaagttcaagaccagcctgggcaacaaggtgaaaccctatctctaccnaaaatacaaaaattagtggggcatgatagcatggacatgtagtcccagctacttgggaggctgaggtgggaggatggcttgaaccctggaggtggaggttgcagtgattggagatcgtgccactacattccagcctgggcgacagagcaagactctgtcncc

SEQ ID NO: 671245 - DNA, 320 bp, Homo sapiens
cggctacggagagtgtggtcacacagtcgtccggaacagctgatgctctcatgcatgtttcagtgttattttcctcaaagcgagcatataagtaatttagctcatctggtaggcttgtgtcactgggcagctttccgctgtcttcccgttgtagtctgtagtagtttgcaagccttttccaaaaacaagctcgaaatcatgtttgatgcactctggatgtatttatttttgctgtactgtttattcaggatgatatgaacattgtggacaatttcagcaaatttcaacattgaaatacagaaataaccacgtttccaaaa

SEQ ID NO: 671246 - DNA, 474 bp, Homo sapiens
gctaaagggcttgacctggctggttgaaaaagtgaaaaggaaataatccggtaagattaatttttcccttcctttggtaagatctccccagctttaaatgaaaattaaaatgggcaagagaaggaaacctctcttcccgtttgcctaaggtcttgcttgcctggctaaaatccttcattcacctttgagtttccatatccctgctgttaacaaataatgcaggtttgtttatacatgtggaactggtggattttcgtcattaaaactgttaccaattggtaacacaagaaaagcacaccacaattctccctatttaatggaggttgtttttttttttttgctttaattcactttttgtttttgtttttgttttttattttgtaggctttctgaaattcatggaagcctaggtgggctggggcaagcagaaataaaaatgagagaagggagatattgtttggatttcctttatac

SEQ ID NO: 671247 - DNA, 195 bp, Homo sapiens
gaggtagtgattgacgtgaatcgcatatgtcatccccttaaaggtcggtaattcactcaagtaacttgactaagtatacagaggcataagtgtgccaattctccggggcctttgatttacgggagagggcggattcaggacgggcgatagggcactgaacgtgcaccgaagagaggggagcagttccacttaggc

SEQ ID NO: 671248 - DNA, 1693 bp, Homo sapiens
  misc_feature (200)..(200): n is a, c, g, or t
  misc_feature (209)..(209): n is a, c, g, or t
  misc_feature (217)..(217): n is a, c, g, or t
  misc_feature (220)..(220): n is a, c, g, or t
  misc_feature (276)..(276): n is a, c, g, or t
  misc_feature (499)..(499): n is a, c, g, or t
cggggagtagggcataccgctgagtctcccctggatgctatctcgggtagcagcgaggcgatgatatgcctgcacgggcatggctgacctcggtatacatatgtaccgggcagatgatggcggcacggatagcgtgccatacgcttgtaatactcaggccatagaagaggcacagggtggtgtacacgcgtcttgtatgncctacacgnttctcaantcnctctattaccggatagacgcgttaagctagttgagcatgggcgccttttgtagaancgacacaccgaaaagcaacaaaaaacaagatgttagatacctggttgtcatatgcacgtcgtgaacacgggaaatagagaggacaagactggagattattgctaaggctaacgtgggtcgagttggcatggcctgcgctgaatagataaggttgatacttaaacagtatatgcacgacgtagaggcgtctagtttcaggataagcctccgtgtacgtaggacntaaattacatttgggtacttgggagggtttgcatagagatatgtacagatagagcgaaacacatagggaaaactattaaaggccataactgggcatatgtatccaaaagaagagccaagttcctagttttccgattccagatggagcccgagagttatgcccaagacttatggcatgcccacagaacaagtttctaaggttctcattggagacctatttcttataaccaaaacgagtttctagaacaagagccaaaagctatgttgtttaggaacaaagacaagcgttatggtgtagggcttaggggttaacttgtgagggaaccatctttgtgtttaatctagtcatagcacctttgcttcttaataaggcaatacttgaataactatattaacttacattactttggacaatgttttggcgataacattttttttttataccccctttatttttcgagggcttctatggcattgagatggccattacgggaattcataatggctttggtggaatttgtctcccgctacactaaacccaggtttaaggacaggcgtaaatgcgttcacattttctaatccttatataacacagggaatctccaacagaggggggacatatcgcgagtgcatgggtaaggggcaacaattatatatgggcaaccaattttctatgggtgttttagcgccgtatggggaaggggatttgtggtaagataatgataggcgagcaagagaatatatggggctgtgtgaaaggatgtttttttaccacacccggtaaaggagttccgtaacagtggttcttattttaattttcgccgctgcggcgaatttccccgttggcgtccgctgcaaaacaatgcgtggttggttttcactcccggaaggcgcctttggggcccattggggtgttaatcccactaaatcttatcctttcccccagatgttccgctttctctcatcttttcggacaccgttttgggaacctaaccgggttatacacgcgacagggaaaataggaggcggcgtgtctactgttcacagcgaggcgtagacacagcgaggaaggccaattatagatttttaacttcacccccctttaactagagaggctcgctggtaattacaggagcgtgtagcgcaccccttcacaacggccgcaggggctacacagcaaatcccattcggcacc

SEQ ID NO: 671249 - DNA, 1656 bp, Homo sapiens
tgtatcaatgctggtggacgggtagtgtgtggactctctcaccgcgtgcgggcgggttgtttctcccgacgacgctgcgtgtggcgtgcggtggctgactggcgttctctgggtgttagtcgagcgcgtgtttctgctctcgggcggtattgtcggtggcgctgcccctagttcttgtgtgtcgagcgtgcgggcccgtgcgcccgtaggtaggcgcgtcttcctgcgtggggtttctctcgtggtgaagctcgcgatgcttgttgggacgaccactctgtgtcgctcgtctggtctatctatagcgggattttttcctctgcccggcgggggctgctatatttatcttgtgggaattttttgcagggggagcccccttttgtggtgggtgggggccccagaagcgccttgtgggggggcccctttgtgcccttggcacccgttttggttattggcgcgacatgtggccctgtggggggccaccaccgtggtgttatttatgccccggcgaatttccaatggggggggccgacgatgaatgtgtgcccgcacctgtgggaggagatcaaagttgttggggttacaagctggtgtatcccttttgggggggacctgtgttcacaaaaggtcgggcgtttataaccggcccgggggatgttccccacacaggtagggtgtgggtggggtgggtagcgccctgacaagtgtgtgttcccacgggtgatatggaaaccccccgctgtgtggtgaagagcacccgctgttgggccttggggaagcctttccaccctggggggaggttttatgtcgaaagggttccccccctcggtggttgtgtttatagccgtgttggccgcgcgtggtggggccccccccgggcccccgcggtgcccgcttgcgggccgcctctctcgtggggcctggcgccacagtgttctctcggagaggagtttctttaaaggggactcacgcccgccagcgcccccctgggactgcctgggcgcaggtggagccccacgctcgcccccagggagctgcgggcgttttttctggagcgccctcttttctggggggcgtgtaaaatatgtggtgtattgcaagatgttacccacgttttctcagtgccaccacgtgtagtagctatgttaattctccttttgttaacttctttgtagattgtcacctttggggctattctgttgtgtattcttctttaaactcactatatttggtggttagacaattttagacggtaatttatattgctgctgttgctttggaaggtattgcccccaaaggttattggggcttggccaccccccacgggcacaccacgtttttgggagggttagggtggtcactaaagaggttgcgagttaaggtgcacccaaggactgctctttcctgactcggattaatgttcgttattcccgcgagtgggttatgttatacactaaagactgacttcgttacccaaaccctttggccccctcttgattcttttgctctcacataactttgttgccctttcacctctgccctgggatgatctgccccaaagtcctcatcccgatccctgctcttggactcctggcctgccagaaccccccgccccaattaatttctgttccattattaaacaaaaaaaaaaataaa

SEQ ID NO: 671250 - DNA, 102 bp, Homo sapiens
gacccactgtgtctgtggtactacctgtatggcccaccataattacccccatactccttacactattcctcatcacccaacctaaaaatattaaacatgtgt

SEQ ID NO: 671251 - DNA, 896 bp, Homo sapiens
  misc_feature (31)..(31): n is a, c, g, or t
  misc_feature (72)..(72): n is a, c, g, or t
  misc_feature (90)..(90): n is a, c, g, or t
  misc_feature (103)..(103): n is a, c, g, or t
  misc_feature (132)..(132): n is a, c, g, or t
  misc_feature (136)..(136): n is a, c, g, or t
  misc_feature (145)..(145): n is a, c, g, or t
  misc_feature (148)..(148): n is a, c, g, or t
  misc_feature (150)..(150): n is a, c, g, or t
  misc_feature (161)..(161): n is a, c, g, or t
  misc_feature (163)..(163): n is a, c, g, or t
  misc_feature (167)..(168): n is a, c, g, or t
  misc_feature (176)..(176): n is a, c, g, or t
  misc_feature (178)..(178): n is a, c, g, or t
  misc_feature (182)..(182): n is a, c, g, or t
  misc_feature (186)..(186): n is a, c, g, or t
  misc_feature (188)..(188): n is a, c, g, or t
  misc_feature (196)..(196): n is a, c, g, or t
  misc_feature (201)..(201): n is a, c, g, or t
  misc_feature (205)..(205): n is a, c, g, or t
  misc_feature (209)..(209): n is a, c, g, or t
  misc_feature (232)..(232): n is a, c, g, or t
  misc_feature (234)..(234): n is a, c, g, or t
  misc_feature (239)..(239): n is a, c, g, or t
  misc_feature (257)..(257): n is a, c, g, or t
  misc_feature (260)..(260): n is a, c, g, or t
  misc_feature (264)..(264): n is a, c, g, or t
  misc_feature (271)..(273): n is a, c, g, or t
  misc_feature (275)..(275): n is a, c, g, or t
  misc_feature (277)..(277): n is a, c, g, or t
  misc_feature (285)..(285): n is a, c, g, or t
  misc_feature (290)..(290): n is a, c, g, or t
  misc_feature (294)..(295): n is a, c, g, or t
  misc_feature (298)..(298): n is a, c, g, or t
  misc_feature (308)..(308): n is a, c, g, or t
  misc_feature (310)..(310): n is a, c, g, or t
  misc_feature (320)..(320): n is a, c, g, or t
  misc_feature (349)..(349): n is a, c, g, or t
  misc_feature (358)..(358): n is a, c, g, or t
  misc_feature (365)..(365): n is a, c, g, or t
  misc_feature (372)..(372): n is a, c, g, or t
  misc_feature (374)..(374): n is a, c, g, or t
  misc_feature (378)..(379): n is a, c, g, or t
  misc_feature (381)..(381): n is a, c, g, or t
  misc_feature (398)..(398): n is a, c, g, or t
  misc_feature (402)..(402): n is a, c, g, or t
  misc_feature (404)..(404): n is a, c, g, or t
  misc_feature (406)..(406): n is a, c, g, or t
  misc_feature (408)..(408): n is a, c, g, or t
  misc_feature (411)..(412): n is a, c, g, or t
  misc_feature (424)..(424): n is a, c, g, or t
  misc_feature (427)..(427): n is a, c, g, or t
  misc_feature (431)..(431): n is a, c, g, or t
  misc_feature (449)..(449): n is a, c, g, or t
  misc_feature (454)..(454): n is a, c, g, or t
  misc_feature (457)..(457): n is a, c, g, or t
  misc_feature (463)..(463): n is a, c, g, or t
  misc_feature (473)..(473): n is a, c, g, or t
  misc_feature (488)..(488): n is a, c, g, or t
  misc_feature (637)..(637): n is a, c, g, or t
acaaaatactaaaaacaaataaaaagacaanataaaaacattaaaaaataaagataaataaaaacaaataanaaaaaaataaacacacanaaaaaagaaaacnaaagttgtccacaaaacattctcctttcnttcnaaaggtttnacnangcattgtaatnanaaannaatctttnanaaanaaantnaaatagcnaattnaaanaaanagttctaaaaccattcttccacnantaatnaaaaatggggtggcaggnatnaggnaaaaaannnantnaaccttcnaaacnttcnnaanaaaattggtnancttgcaaacncaaaaagccttcttgtccactgctttaanaaaacccancgaaaanatatgtntnaaannanaaaaaaaaaagcaaccnaaangngnanaanntaaaaagctctnaanaaanatgggcttgcaaaaaacnatatnaanaatggnagcatacacnaaaattcaagaattnaaaaccatcttccagctttttaccagaacggcgatcaatcttttccttcagctcagcaaacttgcatgcaatgtgagccgtgtggcaatccaatacaggggcatagccggcgcttatttcgcctggatggttcaggataatcacctgancagtgaagccagctgcttccattggtgggtcatttttgctgtcaccagcaacgttgccacgacgaacatccttgacagacacattcttgacattgaagcccacattgtccccaggaagagcttcactcaaagcttcatggtgcatttcgacagattttacttccgttgtaacgttgactggagcaaaggtgaccaccataccgggtttgagaacaccagtctccactcggccaacaggaacagtaccaataccaccaat

SEQ ID NO: 671252 - DNA, 260 bp, Homo sapiens
ttcaaggacgactcagattgtcagaccctgatacagccgtcagaccccactcagacgcagttcggaccctgatacagccgtccaaaccgcgggcaagattctttcagaccttggatcagagacgtgcagactcctctcagagtctgttgcatgagccctggcttgaggcgtccagacgccactcagacgcagttcatgaccctggatcacagccgtccagaccccactcagacgcaggtcgccggcttagctgcagctcg

SEQ ID NO: 671253 - DNA, 208 bp, Homo sapiens
gtctagaggatcccgaaaatgacatagaggcaggtaactaaaacacctcttagtctaggtagacactttcactggataggtacaggcctttcctacagggtctgagaaggccaccacagtcatttcttccattcgttagatataattcctcagtttagccttcccgcctctatacagtctgataacagatgagcctttattcagtttt

SEQ ID NO: 671254 - DNA, 211 bp, Homo sapiens
aacgaacgtttagaggatcccgcactgtggctccaggactgtctccagttctgacctcatgatgtgtcacttcggccttccaaagtggccgctaagtggcccacttcgtgccaaagtgcacttcggccttccaaagtgcattaccggcgtgagccaccatgcccggcctggcctttttttttttttttttttttttttttttttttttttt

SEQ ID NO: 671255 - DNA, 165 bp, Homo sapiens
gcatcggctctactgccacaggaacagctcaccactgggcagttggcaccatagaggatcacctccgtccttatatgccagagtagagtactgactagcaaaatggagaagatcagagaatgcagcagcacgttttttatttcttggttttctgtaccacgttta

SEQ ID NO: 671256 - DNA, 674 bp, Homo sapiens
  misc_feature (427)..(427): n is a, c, g, or t
  misc_feature (433)..(434): n is a, c, g, or t
  misc_feature (439)..(440): n is a, c, g, or t
  misc_feature (509)..(509): n is a, c, g, or t
  misc_feature (586)..(586): n is a, c, g, or t
  misc_feature (674)..(674): n is a, c, g, or t
cattcttctaacatatatttgtagaaatctgatgattatgtccaagaatggattctaagggccttagaatttgatttgactgggccaaatttatcagtctaggtgcacttaagagaaactttgaattcagtggtttacctagagcagctggaagtggctctatttggttgaagaactaaaatcttggaccaaaaaaatggcctcctttaaacagaattgctttccagaatataaaagaaggaatccaaagtcttagataagaatgccagaatggatttattgtgacctgctcccccatcctctaactctagtttatgagattcctgaggatgctttgttatatcaggcatcgaaaaatacatttccaaggagagcaccagcatccttggaaggccctgctggcatcgtctgtaggctgggggtgtgnagcacnnacccnnctggtggaaaactgatcacagttgacccattccctcatggagtagtcagcaattttccatcacagtagnagatatttatttattctgtctatggatgtgtctccgaggcccacaaggcctttgctgctcatcacacaaaacttccncaaatgcctgattatcatcacaatgtttttgctttggcattacttcttacaaactgtataaaacgcgacagattaaaatgccacagcn

SEQ ID NO: 671257 - DNA, 1380 bp, Homo sapiens
  misc_feature (905)..(905): n is a, c, g, or t
gtctaggatacgacgtgcagaaatggcacctcgtaagaggggaaggacaagaacgaacaacacgcgtcatcagccgtctgacctcaggtggctagactcgagaaaatgtactctggtggtctgccatatcttattgcattccttcaatgtacactctatctgtccaatgatcactgactcgttatctggcagaggcacaactcatcgtgtcctgttgttgtacatggttgggattgaccgtaatagtgcatgaccgtatgactcgaattccgtcacctatatgcatgcgtatgttggcgtgcccgaggaatgtgcgtcgcaaagtgtgctagagggacgctggcgtatcaactctgaccgtactactagtcaagagcatcctgaggcctactaaggaatgcgataataaggaccgatacgagctgcatgtgtaaccctggggggggcctcaatgttcctgggccacattccaaaggcaggctccgcttcttgcacccggacttactgggccgttaattggacagggaagtccagtgtgccagagtagttgaggtaccggggaattagattcaacccccaaccaagttaccacgcattcgtgacactaggtcaagcgtacggtcgagggcaaaagaggaaacggtcccgcgctccgtgatggggaatcagaactccgagggctcttgagtggcaagaccttacagaataatctcccttctcaaaatggataactgaatatattcgctttggcttctagaataagaagacatttcggcgccatttttccagtggattcatcgacacaccaattaatccatagggacacacaaaatcgggcgaatgggtgggcacaattgcccaacactaaaagagtagatttatgttccctcacgtgcgaagagggnaggcgccaccccaagttgtccctttaaactgcgcgtgttctttccccacgaacggttgtctctagtggcgtgcggttaaccccaaacaaggctgaggaggttggcaccgcaaattatgtggacggaggtcggcaatgccgtacgggagatttagtatgggaattacagaccgccccacttaagtgacgctcgacacacttttgtcgggaccacttacacacatggtaatatcactttaccccaacagcagtgtacatgggttgcacgacccttggggtgaagcaactcaaccatcgtgttggccatcagcggcacccattatcggctggcgaacattgtccctcagagggcggcgtcacatttgtgtgagcactccgttctattaacattgctcccttggtgagagacagtcggaggacagccgacaaaaatactttgtgggcccaggcaaatactccatcacgcagtcaacaga

SEQ ID NO: 671258 - DNA, 1028 bp, Homo sapiens
gcactggtcttgtcctcttctccagacgatggctgtgtcttgaaagtctaccctgcgaggctcctgttttggcagcgtctgacagtgacattgacggtgctgagctccccactggcgtttggctggggacacccaagccacgtttgcttgagagcaggctaacgtgtgagtgtcatttcctcaactgggacggagcgagtgtggaactctgtatcatgatacatctataaccaacgaggagtacgcgctgcatagaacagtgacctgaggggagtacctagggcgagtgatcggagctggggctgtgcctgacgctgagtactggaacagccaaaagggaccttcctggagcggaggctgatccgaggctgtacacctactgtcagatacaactacggggttgtggagatcttcacagtgcattgcggctgattccaacctaacggtgactgtgtatccttcaaaagatccagaccctgtagcacgctagtaacctcctggtctgcgtctgtgaactggtttctatccaggcagcattagacgtcccggtggttcccggaacaggtcaggaatgagaaggctgcggtggtgtccacaggcctgagtccagaatggagcactggaccttccgagaccctggtgcatgctggaactcacgttcctcggagtgcagaggtttacagctgccaagtggtagcatccagtctttgatgagccctctcacggtgcaatggagttgacagactgaatctggccagcattcaagatgctcgagtaggagctcgggggctttgggctggggcctgcctttccttggcgacaggcctgttcatctacttccgaatccaaaggcccctctgggactttcagccacaggactcttgagcttgagtgcgataaccaattcaagaagaacttctgcccagtttgccgatgaaagttcccactgggtctatcttcccagaagttggcgcgaccggtgtacttggtagcatctcgaaatgtccccctgtggctctaagtcggtg

SEQ ID NO: 671259 - DNA, 105 bp, Homo sapiens
ggggggggggttttaacctgggcatttttcttgggtccccggggggccagggggggtctttgctccagaccccccagtttgggtaaaaaaaggccctcttgggta

SEQ ID NO: 671260 - DNA, 149 bp, Homo sapiens
tagacagtgggatgaagggtgcgcgactgatatacttacaacgatcgtcaacgatgtgatattggtgtttgatcccaaagagctcagcaaagattccacgaagtcagcctctcccttgtttgcatacagttgattgaacaggatcctgg

SEQ ID NO: 671261 - DNA, 153 bp, Homo sapiens
tgagaatccaaaagccctaacagactaaataggctgccaactaagccggtggttcttgccactctaaacggttcctatctggaatgcttaaggctcattgaggatccctcctaactctcttttccctctttttttccatttctcctgggatga

SEQ ID NO: 671262 - DNA, 270 bp, Homo sapiens
ggtaccctgatgttatcgccccacacagataatggaaaattactttgattcttcccgagtagatacattactgttaaatccctgggatagtttaattactgttaactatcttcctatcttaaaaatgtttacaggtgttagaagaaaattcttgccttcttgctagtgtttttacaggtattggtgcttctgccactcaaaagccttttttttttttctgagaagtgctttgaaaggtgtgttggggataacgtcacgtgaactctaagg

SEQ ID NO: 671263 - DNA, 186 bp, Homo sapiens
agcgcgaaggctccggtgtttatcagtgccaggctctccggttcagcgggcccggtcgtggtgatgcagcaccgttggccgcggatgccagaagcagaacgctacccatagcgtggcccaggcgtcttgtcccgccaggtggtactggtgtgtacaggccgcagatggggtactcggccgtgaacg

SEQ ID NO: 671264 - DNA, 243 bp, Homo sapiens
  misc_feature (2)..(2): n is a, c, g, or t
  misc_feature (68)..(68): n is a, c, g, or t
  misc_feature (75)..(75): n is a, c, g, or t
  misc_feature (79)..(79): n is a, c, g, or t
  misc_feature (91)..(91): n is a, c, g, or t
  misc_feature (99)..(99): n is a, c, g, or t
  misc_feature (102)..(103): n is a, c, g, or t
  misc_feature (106)..(106): n is a, c, g, or t
  misc_feature (115)..(115): n is a, c, g, or t
  misc_feature (117)..(117): n is a, c, g, or t
  misc_feature (120)..(120): n is a, c, g, or t
  misc_feature (130)..(131): n is a, c, g, or t
  misc_feature (136)..(136): n is a, c, g, or t
  misc_feature (139)..(139): n is a, c, g, or t
  misc_feature (142)..(142): n is a, c, g, or t
  misc_feature (144)..(144): n is a, c, g, or t
  misc_feature (150)..(150): n is a, c, g, or t
  misc_feature (153)..(153): n is a, c, g, or t
  misc_feature (157)..(157): n is a, c, g, or t
  misc_feature (165)..(165): n is a, c, g, or t
  misc_feature (169)..(170): n is a, c, g, or t
  misc_feature (210)..(210): n is a, c, g, or t
  misc_feature (216)..(216): n is a, c, g, or t
  misc_feature (232)..(232): n is a, c, g, or t
  misc_feature (235)..(235): n is a, c, g, or t
  misc_feature (239)..(239): n is a, c, g, or t
anaaaagggggcgcgctgctccatgatcgtgcacagagcgtgtggtactaataactctcgaacctacngagagangccnccccccccagcntcccaaantannggntacatacangngtnttcatcgcgnnccccnccntcncnatacanagngctntcagcccngganncgccggaccggccacgcagctctgcttttcctacaacccncgttcntgtctaatgctgccanctnacanaggc

SEQ ID NO: 671265 - DNA, 335 bp, Homo sapiens
  misc_feature (187)..(187): n is a, c, g, or t
ggtctgacctcccctgcagaattttttttccttcttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatacaaaaaanaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctc

SEQ ID NO: 671266 - DNA, 866 bp, Homo sapiens
gcccggtgggtgtggttcgccggtgtttaactttgggtggcaagggatgtgccgcgtcgtttgattttggcgccgacgttgtgttgtttggaccgagaggtgggtgcgcgggaggcactgttggtgggtgaagacgtgcgttccccgggggtgccgcccccccccgcaggtcgtttttgtcagggcgggttatggagcctcatgttcggcgtttccggcgcgacacgttggttgcctggtggtgttgcccctgggcccgcactttattcttctggcggggtgcccccccacggtgggccgggtttaaccagcccggggtgatttctctccatatgctcctccctccatagaacctactaagtttgaaattatttcaccacccccacgcatcagactcaagttcattcttcctttgatgggaacaaggggctactcacccagcctatctttgcccccaccgtgcaaaaccgaatatcatgtcaaaccaccacttcgtacgcagacaccatgtttgacgcataaggatactattctctgcgtcgtttgtaagacatatcctagttgttgctctggtccccgtgagaataaaaaaatgtatcttaatacacactatgtgttttccacaaccacataatgtccttgtagatgtttatcccacgttcctgtagtagaatatgaccctcccctctaaatcacagcgggtaacacacacattcttgcacaccacttcctgcttaagcactactgcccccctcctgataccctgacaaatgtttaataataatggacacccattttcactcaaactcaataaaaatgcacaaaatctttcacaggtgtaacctgttttctctttcaacaaaaca

SEQ ID NO: 671267 - DNA, 194 bp, Homo sapiens
  misc_feature (194)..(194): n is a, c, g, or t
agcgaggggtaccgaggccgcccctgaatgaaccggttcagccaaacccacggggtatgcggccggccccggacgggccgagacgcgcccgacaggcgaagccgcggacgcgcacacaggacggcaggccacgacacacaacgaaaccgggcaaaaccccagagggcgccgccgggtagcgcctcggcaacggn

SEQ ID NO: 671268 - DNA, 228 bp, Homo sapiens
  misc_feature (215)..(215): n is a, c, g, or t
gggacacttggagcaggaggacagcagttccaagaaaagaaagcttttataggaaaggcccagtacatgggccagcagccacagcatattgtaaactgaggatgaccagcttcgtgggaccatcttggataagcttgttttttgtaagggagtttttgtccttggaaaacatggaaaatgcatccttaacaccttagcctgctggtcatcttcantattttctgtcat

SEQ ID NO: 671269 - DNA, 125 bp, Homo sapiens
ccccactaatcgtggattgggtcagaaatcacagagggacttagtatcccattaatacaaatgggaaacattaagtccatcatcagatgataagagggaaaaaaaaaaaacctgtattactcttc

SEQ ID NO: 671270 - DNA, 274 bp, Homo sapiens
atttgccaacgttagctttgtggcgaaagacggcaaactgaacgaccttaaatcaaaggcgaaccggtcgatccggcgaaaacttaccgtatggcgacattaaacttcaatgccaccggggtgatggatatccgccgccttgataacaaacccgggctatgtgaataccggctttattgatgccgaagtgctgaaaggctatatcagaaaagctcgccgctggatgtgagtgtttatgaagcgaaaggtgaggtgagctggcagtaatccgaaa

SEQ ID NO: 671271 - DNA, 283 bp, Homo sapiens
ccttctccctcgtgggcagaagcatcagacttcgcagatcagtccgataagagggacactagaggaggcgaggaagacatactaacaaaagtagaattcagctgagagctagtaggagctctgaggtgtctcctcccctagatcacgcacacgagagagatgctaaagaaagcattaaattccccacagtgaggaggaccagacggggttggggggacactggacgggacggacaaagctcctaatggagagaagggtgcacgatacgagtttacaagtcctg

SEQ ID NO: 671272 - DNA, 817 bp, Homo sapiens
tgataagatgatttctggcattattgttggtagcgttttatttttcccaacattaatgtttcttaaaacacttttcctactatgtttgacatgggaactttcgcctgagtcactgtcatggttagctttgttgttgttgtttttgtttctgtttgtttaaacaatactaccttgccaaaaatagaagaatgtgatttggtagagtagggttgtttggtttgtgtttgaataagagtatcctacagaagccacttttttttttttggagatggagtttggctcttgtggcccaggctggagtgcaagggcgcaatctcggctgactgcaacctccacctcccgggtgcaagtgatttgtcctgcctcagcctcctgagtagctgggatatacaggtatgtgccatcacgccgggctaattggtataacaggggagatggggttctccatgtgggtcaggcgggtctcaaactcccgactcaggtgatccgcccgcctcggcctcccaaagtgctgggattacaggtgtgagccaccgaacctggccagaagccataactaaaataaggcacacttgacacacgcatgtggttaatagctgtgtctgtgaaattatcctctagattaacccaatttcagtggttgtatttcgcacaggatctgggccttcagaagctatcttatgatccctggcggatatactcttagggcgatcctgaaccaggaaaagaacacttgcgttggaacatggggtctattaccccaatgtgccgtcttttggatacagcttttgaagattacctcagctgaaagggaatg

SEQ ID NO: 671273 - DNA, 884 bp, Homo sapiens
  misc_feature (884)..(884): n is a, c, g, or t
gagcagtcctagaagctgtccaaggtgattgagagatgggcggttcctttgattcggcattacatgcgctctgtcacttaaagacagaacgaacgatcctgctgattaggcttcctggctattcatgactcactttgaggctgtaactaatgattaagtcatcacgacgactgagcaaggagactcagacgagacctcccgttcagaccacattggacagacaagggtggaagaccgcaacgtaaagtactcgatgccttgcgaactagtcagagattaacggcctgacaagagatccctattgccggcctcattatttactgtccaagtgacgccacgggaataaccgaaacaatgtcgatttactatagtgacactaagacccaagcgctttctatcaacgataactgagatctctaacacataaagggaacacaaaactagtgagtcgggcagctatgcgaacattcgcccactttggaagagcaatcgttaactaggcaacccgcattagtattgtctgtgcacaaccaggaagagaccccctaaattggtcgtaaatcccatggcgccgttgctggcgtttacttggagatctcccttacaataaggggaatattcaccctcctcagaattcacccggtatgagaacgaccccagagtaatcccattaaacaaggcgtactactttactgtggaattaggagagattcgtttgacacctaacacccatgggtgacaggcgcccgataaggtcacttcggaacctgtaatttaggtagatttaatctggtgcttaacctcatattgggtcccaaatataaacagaggtcttaccaagggcaattttccccgcccacttcaaaaatcgctaaaagaaactn

SEQ ID NO: 671274 - DNA, 509 bp, Homo sapiens
tcgaccctccagctccaaagtgctgggatataggctagacgcactgcacctgcagattgctttataattgtttgtttacacttctctattcttcccagaggctagaaaccatgtcttattcatttttaccttacctgtgtgaaacatttgagggaaggaaatcggtaggatgtgagggaataggtagggattgagtaaaaaatggcccagattttgagtttgagtgaccaggcgagtgatagtgtgttatatatacaaacatctgagttgcgggtttggggtgaagagtttaattttggacatgttggagtctatgacaatgtgggaagaccatcccagtcaacaaatggcattgggaggacattcgagtggctgttcaataggcagttagaagtggtgaattatatcctggagctgttgaaggatttgggcatcatcttcatgtgattcatcaggtgaatcagatctttgaaaaggaaagtaaaaaatgaagctaatgaggaatgcct

SEQ ID NO: 671275 - DNA, 1284 bp, Homo sapiens
cccacgcgtcgtgggaaggccgcccagggacgaggcggagtgccccgtgtggggatggcctgagcaatggatgggaccgacgaccatccatggcccactacaagagcgcccacttggaccacctggcacccaggagatgggctccatccatgatcagatggagaagcccgagcaacacctcaggaccagacgaccaatgggacacgatcccaaaccgcgatccaaaccaacaccacgaacaagacacagaagactaggagaaggtcagggaccaagtgcagatcccgacaagacggtacacgaggcagcatccaacctgagacggccaccccgcaagcggcagaacgccaacaacaagtccgcaacaaaacagcgcacaacacggcagagaccacatgggagccagaagcacacaacagacacacaaacgcaagcgctcacactcgcaccaaaaccaatcacgaacgaacacatcaacgcgaagatgcaggacacacacgaacgcaatgcgcaacgcaagcgaaaacgcatgacaacaaacacaacaaaaaaagagagaacaaccgactagagacccccagcaagaaagacaggccgcagacacacaaaacaaagcagaagacacagagcaacacaagagaaacacagacacaccaagagaagacacaacacagaagacaacaagaaagccaacaaaagacacaaaaaagacgaaaaagcccagaacaaaaaggaaccaaaaccgatcaccaaaaagaagacacaacacacacgaagaccagacgaaaaaaacaacatgaaacacaacaacaacaagacaccactacaaacaaaaacaccaagtgcgaaaacgacaggaaaaaaaagcacacaaaaaaacgaaacaaaaaaacaatgaaaaagcacagaagaaaaagaagacaagacgaacaaaaagcaacaccaaaaaaagggcaaacgacacaacaacccaaacaaacagcgaaccaaacaaacagaaacaacaacaaaaaccagacaaacacaaaaaaagagaaataaacgaacaaagagcaaagaacacagagaaaaacacaagcgacatcgagcagaaaaaacgaagaagcgggcggaagaagacaagaaacaaaatacaacacaaaaaaaacgaacacaccacgacacaagcagccccacacgacggacactacaaggaacgtacagcacacgaccaccacgccgacaaccaagcacagccgaccgcacagaaaaaatcaaacataaacaaaaacacgacacgaacat

SEQ ID NO: 671276 - DNA, 200 bp, Homo sapiens
atcatgtgcacacatctcgtcgtccacatttctgacgtggatgtccagagcgactcagacgcggcgtgtggctcctgtgcttcaaggatgtgactgtcatcatcttctgtggtggccaacaacaacttactacatgtgctcatcggtggaggaccagcataccaatctcggctggctggatcgctctggaacctcttcag

SEQ ID NO: 671277 - DNA, 218 bp, Homo sapiens
gccaatcttcacatcattcatttcgttcccaacatcttccacagccgtcaggtacacatctagtgcgtctcaaccaccaggctttgtcaaaccacagcagcactcatttcattttccacagggttttcatccagcatatttccacatcccagcacacatcacatgttccacagccatcacgcacatttcatcacctcacacacacacatcatgtcttg

SEQ ID NO: 671278 - DNA, 109 bp, Homo sapiens
  misc_feature (105)..(105): n is a, c, g, or t
agatacgacacacatttagcgacccctgttttttccacagagcttctgctgtatccctcctttactctgacagtgtcttcgtgtagctcatgtaaagtacttacntgcc

SEQ ID NO: 671279 - DNA, 738 bp, Homo sapiens
  misc_feature (488)..(488): n is a, c, g, or t
gcccgggggccgttggccgccgcggactgcggctgctgctgccgctcctgccgctcctgccgctgccgcaggtgggtcgggcggcgttctctctcggttcggccaccgcggggcgggtcctgctcgtgaccacgcccctcccgggctcacccttgtccccacaggtgtgcgctgggcttctgcggacggcagctgcgaccctcggaccagtaatgtcggggtgtgagggagccggggcctggccccgctcctatggggaggcacggggctgcgagtgtcgggcgtcccatgcctccgcctgctccatgtgccgccgtccccacaggtgcccgccccaggcccgctgtgagcatgctgtggcacgtggggtaagtggaggccgcggcggagccgtgcgtccgacggttctggggcgggggtcaccgtgggccatggtcccgtctaggccccttacctcatccagtgccgtgctccgcttgtcgccccangtcccggaccgtcttggccgggaactgaccttggagcaagctagtgaccttccctcccacctctcccgccttggtctccggcgggagtcccctacggatcccggctcagcatgttggggcacttcgctttgaggacaggaagtccgtgggaagttgagcctcgaagggcaccctggtcgagcccagtgagagatagccagggtaggcccagaatcccgaggccagggctctggccatggcggtcttacga

SEQ ID NO: 671280 - DNA, 405 bp, Homo sapiens
tcaacacccaaatagtacaggcagtgggaactcaccacctagcagcagtctgactcctcccagccatgtcaacttgtctccaaatacagtcccagagttctcttactctagcagtgaagatgagttctatgatgctgatgaattccatcaaagtggctcgtccccaaagcgcttaatagattcttctggatctgcctcagtcttgacacacagcagctccggaaatagcttaaaacgcccagataccacagagtctctgaattcctccatgtccaatggcacaagcgatgctgatctttttgactcacatgacgacagagatgatgatggggaggctgggtcagtggaggagcacaagagcgttatcatgcacctcttatcacaagtcaggctggggatggacct

SEQ ID NO: 671281 - DNA, 328 bp, Homo sapiens
cgtcgacggccagtcaggagcagtggagacaaaaggagagagggaaggggagaaaggagttagggagagaagggcggaaagtaagagaataagaaagagaggaggaacaaacagagacacaaacagagaaaggcagagagagagagaggcagagacacagacagacacacagagacagactgaaagagacagagacagacaaagagagacaaagacaaacagagacacaaacagagaaaggcagagagagagagaggcagaggaagagatggagagactgagagagagagacagagaggagaaagagagtcaggtctaaagtcgacgc

SEQ ID NO: 671282 - DNA, 203 bp, Homo sapiens
atcatttggatgtttcatgaaggttccattggattagtatttgatctggacctgcatagccggaatgtagccactcaaggtatatagaccacctacccatgattaaatagagtggactgtcttcactaacgtgaagggtatactacagaatagcgagaatggatcgaacgatcttcgaaaatccctattactaccgtccacat

SEQ ID NO: 671283 - DNA, 800 bp, Homo sapiens
tggaaaaagtcatggaggccagggggttggcttgaaaccagcttgggggggttcgattccttcctttttggtctaaattaatgtatacgggtccttcgaatgtgtggtagggtggggggctccatatgtcctccaggtttatggagggttcttctactattaggacttttcgcttcgaagcgaaggcttctcaaatcatgaaaattattaatattacggctgttagagaaatgaatgagcctacagatgataggatgtcccatgtggtgtactgcatcggggtagtccgagtaacgtcggggcatccggataggccgagaaagtgttgtgggaagaacgttagatttacgccgatgaatatgatagtgaacagggatttgggcgtaggtagggtctagggtgtacgcctgagaataggggaactcagtgaatgaagcctcctatgagggcaaatacaggtcctatggatcggacatcggggaacgtgagctacaacgtagtacgtgtcgttgtagtacgatgcgccaccgaggtcgccgcgtgagacttctccggcgcaaaagcgccgcgaatgcgctaaggtggctcctacctggtgggtgccctaagggggaatcctcccccgagggcaaggacctccagaagattggggaccagctgggtatcagaggggatgagacgggtcaaacagtatcagggggcgatggaaacttggaaagtcttgcccaggtatggagctgcagtcctgtggggggtgaccgcttgtgccagttgacccggtgtctgcctgtgaagaaaaa

SEQ ID NO: 671284 - DNA, 441 bp, Homo sapiens
ctggctcgtctgggttatggaagggtggaagtacccttccaattactttttctatgatcttagaatacagaaatccagcacagtagtattttatatgattaaacattagattattagctgagccaggctagtactccttttcctaagaagtgaatgaacacatgctaatcatttgcatagaaggcgttctgtggaatgggaagaggatatagaactcacatcagtttacttacaagtgtcctttcaggtcaacgtgttattattatgatgcttaagtgcttattacaaattgttgctatcatcttattatagcaacactttactagaaaaccacaaacaacaatgcagtgggacataatggaaagggtatcggcatcaaatgacctagttacctcccagctgtaccacttaactagttaattaggatggcactatgtccgt

SEQ ID NO: 671285 - DNA, 137 bp, Homo sapiens
gacagtgacccaggcatgcactgcattctctggatgtcgaggctggtattcaccactgaggtggatgcctccctgtaccaagttccgtcgagacgtgagcaccgtgctgacctccaaatatcgttcagctggagcct

SEQ ID NO: 671286 - DNA, 981 bp, Homo sapiens
  misc_feature (1)..(1): n is a, c, g, or t
  misc_feature (88)..(88): n is a, c, g, or t
  misc_feature (125)..(125): n is a, c, g, or t
  misc_feature (223)..(223): n is a, c, g, or t
  misc_feature (272)..(272): n is a, c, g, or t
  misc_feature (278)..(278): n is a, c, g, or t
  misc_feature (301)..(301): n is a, c, g, or t
  misc_feature (310)..(310): n is a, c, g, or t
  misc_feature (313)..(313): n is a, c, g, or t
  misc_feature (318)..(318): n is a, c, g, or t
  misc_feature (322)..(322): n is a, c, g, or t
  misc_feature (346)..(346): n is a, c, g, or t
  misc_feature (349)..(349): n is a, c, g, or t
  misc_feature (373)..(373): n is a, c, g, or t
  misc_feature (379)..(379): n is a, c, g, or t
  misc_feature (389)..(389): n is a, c, g, or t
  misc_feature (417)..(417): n is a, c, g, or t
  misc_feature (422)..(422): n is a, c, g, or t
  misc_feature (434)..(434): n is a, c, g, or t
  misc_feature (453)..(453): n is a, c, g, or t
  misc_feature (471)..(471): n is a, c, g, or t
  misc_feature (487)..(487): n is a, c, g, or t
  misc_feature (865)..(865): n is a, c, g, or t
  misc_feature (975)..(975): n is a, c, g, or t
naaaatataaaaaaagtttttaaaaaaaagaaggatggtaaaggtaaggaattaaagggatgaggtgaaaagatggagaggaaaaaanaggtgaggagaaggaagagggggaggatgtaaatgtnaggaaggatgaagagtggagaagtataagaagtaggttggaggatgtggggggtggaagggagaaaataaaaggaagaagaagtaaaatgaggtgganttaaataatagatgatggagaaaggagggagaaggttgatggaagggtnaaaatnaataaatatgattgaaggggatnaagggaaanaantatanggantaagtagtagaaaaggaataagtnaanaaaaaggtataaaaatataaaaanaaaatnaaaatataangaaaaggggaatggggataagatgagtngatangtgatggaaaangaggaagtagtgtttgaantggtgatgagaataaaanaaaaagtatgggaaanataatagtggtgagaagtggaaatagaagtgaaggaattataagtaaaataaaagtaggaaaggatgataaagaagggaagagaagtattaaagttaagaatgtaagaaaaaagtggaatattgaaagaataaatggtaatgaatttgattggaatagtaatgaaggagaggtgaaagaatgatgggaaaaagttatttgagagttttggaattgtggtggaagaaaatggaatggaagtggaaatattataataagtgttggagataggaataaatagaaaagtgaaaaaaaaaaattgtgtaatattgggattggatggaggtgttataatttatataatgaagaaatagttgagagtgggggaggtgatagaatnatggaagtaattatgatattagtttatataaaaatgataatgatgtaaatgatgaaaagatgattaaaaaatggtgaggaatgatggtattgggtggaataaatttgtantaaaaa

SEQ ID NO: 671287 - DNA, 546 bp, Homo sapiens
  misc_feature (14)..(14): n is a, c, g, or t
  misc_feature (23)..(23): n is a, c, g, or t
  misc_feature (27)..(27): n is a, c, g, or t
  misc_feature (46)..(46): n is a, c, g, or t
  misc_feature (107)..(107): n is a, c, g, or t
  misc_feature (178)..(178): n is a, c, g, or t
  misc_feature (204)..(204): n is a, c, g, or t
  misc_feature (260)..(260): n is a, c, g, or t
gaatgagagaaggncctgagccntggntgtcagatttcaaaacaanccaaaacctggtgacacgcagatccaccaggttgtctgggttgtctgtttatacaaagacnttctgtcaacaaaacaattcaactcttcctgcagctcaacatcctggtctgctgtgagacagggctttccnccatcgtgtttgggtatcagttaatnttagtcctacaaaaacaaaattacgtccctcagttcagcagcccaaaagcagatgntggccgggtgtggtggttcacgcctgtaatcccagcactttgggaggctgaggctgatggatcgcttgaggtcaggcattcgagaccagcctggcccacatggtgaaaccccgtccctactataaatacaaaaaaaattagccaggcatgctggtgtgcgcctctaaccccagctactcaggaggttgatgcggaagaactgcttgaacccagaaggcaggggttgcagtgagctgagatcgcgccactgcaccccagcctaggcaacagaatgatactttgtctt

SEQ ID NO: 671288 - DNA, 1660 bp, Homo sapiens
  misc_feature (1)..(1): n is a, c, g, or t
  misc_feature (191)..(191): n is a, c, g, or t
  misc_feature (363)..(363): n is a, c, g, or t
  misc_feature (624)..(624): n is a, c, g, or t
  misc_feature (1092)..(1092): n is a, c, g, or t
  misc_feature (1455)..(1455): n is a, c, g, or t
nacttttgcacacccattattttcttatcggccgcccctataattttcgggccgccgcccaatttctatagagaggttttccctttctccgtgctcctcctatagtattaataactccacaagctgtgtgtccacaacgcaaacccccccccttctccctagaagccccccaggaaaaggcccccacaagnggccccccctctccctaagaccttctcatagtatttcttccttaaggcgaatacactttttctgccgttaatatgtattatctcttcccccaccgacgcacctcccttgcttgtggggagaaaaccttgtcaatagttgtttttttgggctttggaaaagaaaaattaaggngaatatctcccgccgttttaaacacatataacgggagggttgcgcacaaaactgtggccaaaggatactttgagaacagaattataatgggcccccacacaaccagggttgtctggtgtccacccctggcggattgtcgttcccacaagagaagtgttgtggccacgaccccccgttgtgggagaccaccacttcaggggcgccacacactggagaacaaccccaaccaggaagtagatggggaagaaaaaaggggcgggngagaccaccaccacagttgttgtcgtggccgccaacacttgcggcggggagaagaagtagtttttgtggacgccaccccgtgggttgcacccacccccccccctgtggcacacctgttgtgtggtggcgtcgcgccgcaccatcttttgtggcgccccacacaaggcgctccgtgtggccacacacacaagggggggcgaccttgagaggccccccccacaactgttgagagacgcccctcttcaccctactggatagtagaggaagatatacacactcttatcacacgcggacaacactcacacagcgggtgtttgttgccccttgtgagaaacacacagagactgttttgtgaaaaaaactgttggagacacactctgcgagagagactcgggcacacacttctggagactctgttagagggtgtttgtgtgtgctctctgttggagaatataacacgcgagaagnctcacccaccagcttgagagagacacataaataggcccacagtttcgcgcacacaagaccacacattttctcacacagagagagacagattttgacacacagctatagaagagattatagctctcgcgcgaggttatatctctcttgaccacaggggccttgatagttggattatactcgtgtctctctccacagagagtgtgtcgcacacacaccacagagtgtgggacacacacagtgcacttaagcgcgtgcacagaattaagctcgttaaaagtgtggtggagcctcttcttggtgaacacatgggattcttgttaagccacactttcctttcctttgtaaccaaaacacatgaaaatncctatagaaatgtatatgaagaaagttcacaacacacattaaggcacataaaggaaaactcctttgcacaggctctctgtcccgaggctgcttccgcgtcctcggaggggcccctgaattttaggtatagtttacttcttattctcaccattgtgtttttttagaaaaatgaatggtccaataaatggcttatcctttcataata

SEQ ID NO: 671289 - DNA, 455 bp, Homo sapiens
  misc_feature (9)..(9): n is a, c, g, or t
  misc_feature (250)..(250): n is a, c, g, or t
agaagaggnaatgcgcttgttcatcgtgtgaggaaagaaggatgcttccactgagggcccacgttctgcatagcccaacaactataaagttggcgaggagggaccagcagagtcttgcataggagtggacctcatcttacagtatttctaagcgggtttcctttgatgaagtgcctaaacttgtgcttttgtatggtactctcatgatgtgctgctgttcacatctgtttctgctgttcataggttggangtcgctaaaagaacatttctatgaggatgccatttttaagaactcacattcttttaaaacctcagttgtggtttgaaattcgaaatagtacatgtacacgtacccggctagaaattgtcactgttaagagtgtcacagtgtgaagaattgccctaccctgctgccagtactttgtcccagtgaagctactgttggtcattggttt

SEQ ID NO: 671290 - DNA, 573 bp, Homo sapiens
  misc_feature (249)..(249): n is a, c, g, or t
ctagtggatccccctttctgcaggaattcggcacgagcattatcttgccaatttactacaacctaggcccaatcctcagtcttataggttcagaaatttatttttatcagcatcaacagggtagctacattgcttagaagcaaacaaaattaaccatgcttcaatagaaatcaggatatagatgtattaatacagaatgacaaatataactgtgacagaaataggaatgcctgtttatggtcatatacngccaatactttcattacagccaaactcatacatgcagccaaataagaggcccctggatacacagggaatcagaatgaagaactgaacatttaatagtcttctttcattcaatcaataattttttttaattaagcaactactatgtccgggtaaccttctaggtcctggggatacagaggtctctgcttacagaagtcatatgtaagtagcaggtgaagagtatgtgtttcacagaagtttattacaatatattaacaagagcaaaaaattttggaagcaatctaaatgttcaataatagagctccaattaaataacaataaatc

SEQ ID NO: 671291 - DNA, 187 bp, Homo sapiens
atgactgaagcagctcgaaagaaagctgtaacaaagtgacaagaatatgttcttccactttgagactgttcgattcaaacatgagtccaatggcacgtatccttaaggggagatgctctgctgctgtctcatttgccagattatccttcgttccaggctttcaacaggatatgactggttcatgctc

SEQ ID NO: 671292 - DNA, 734 bp, Homo sapiens
gcagcggtgtatgcggaactatataaagtgcagaaaagcaggtctcgaagatatgactccaggaccactatatgttctccagaaggtcgcttataccaagttgaatatgccatggaagctagtggacatgcaggcacctgttgcgggcaactgttagcaaactgatggtgtgtagcattggcagcggagagacgcaacatccacgagcgtcttgatgaagtctggtgtagctgaaaacatttataggactcaatgaggacatgggttgcagtgtggcaggcataacttcctgactgctacatgtactagagctaatgaactaaggctcatggctcaaaggtatttataacagtatcaggagccacattaccttgtgagcagatggttacagcgctgtgtggtatcaatcaggcttatacgcagatttggacgggagaaacgtcccttaggtgttgcatcgaagtacgattggctgggataagcgctatgggtacagctctatctagagtgaccctacgtgcgcaatattacgggtggatgggagaggccagatgccttggaaattaattagcgctgggctgtcgtcattgtttgaaacaagactatcgggaagggcgaaatgccttggagtgaggaccttgggtgggtatccagcactaatagagcttggtgttaagagctccctggggacaaggggaattggtccctgcccaaaaggggggcgaccgggttcc

SEQ ID NO: 671293 - DNA, 1010 bp, Homo sapiens
  misc_feature (8)..(8): n is a, c, g, or t
  misc_feature (54)..(54): n is a, c, g, or t
  misc_feature (69)..(69): n is a, c, g, or t
  misc_feature (129)..(129): n is a, c, g, or t
  misc_feature (244)..(244): n is a, c, g, or t
  misc_feature (389)..(389): n is a, c, g, or t
  misc_feature (391)..(391): n is a, c, g, or t
  misc_feature (397)..(397): n is a, c, g, or t
  misc_feature (569)..(569): n is a, c, g, or t
  misc_feature (598)..(598): n is a, c, g, or t
  misc_feature (601)..(601): n is a, c, g, or t
  misc_feature (617)..(618): n is a, c, g, or t
  misc_feature (626)..(626): n is a, c, g, or t
  misc_feature (919)..(919): n is a, c, g, or t
gtatgttntaactgccacacctgccatatttttacaaaacgtgtgctgtgaatntatcactcttctttntaattcacaggttgtttactattatatgtgactatttttgtaaatgggtttgtgtttggngagagggattaaagggagggaattctacatttctctattgtattgtataactggatatattttaaatggaggcatgctgcaattctcattcacacataaaaaaatcacatcacanaagggaagagtttacttcttgcttcaggatgtttttagatttttgaggtgcttaaatagctattcgtatttttaaggtgtctcatccagaaaaaatttaatgtgcctgtaaatgttccatagaatcacaagcattaaagagttgntntatttntacataacccattaaatgtacatgtatatatgtatatatgtatatgtgcgtgtatatacatatatatgtatacacacatcgcacacacagagatatacacataccattacattgtcattcacagtcccagcagcatgactatcacattcttgataagtggtctcttgcatanaataaaaatatcctatcagcgctttctangangcctgaattgaccaannaaccatcncaccaccactttataaagttgattctgctctatcctgcagtattgcttagccatcttctgctcttggtaaggctgacatagtatatgtcaatttaaaaaataaagtctgctttgttaatagtaattttacccagtgttgcatgtttgagcacacacaattgataacttaagcccactacttattgcatcaatatgacacaagtaggatagtttgcaactttcacacggatttgctcgaattggtccactttgcttgacctgcactgttgatgttatcttgctatgtgctgacntatccttcactgtacaagctaattggaagcctcttcagggtaaggaacaatgtttcccgacctatttgatggattatcataggttgcgaac

SEQ ID NO: 671294 - DNA, 182 bp, Homo sapiens
tcatccccggtacctgggtagaaccgcgctgtattgggtgtgaacagagtcatcctctgcaggcagggaagtgtagaagtttaggaggggacactgagtgggagtgtggtggtattgctgaaataccttctctggtacgtcaggctatgagcggttttagtttttatgtttggttcagttgc

SEQ ID NO: 671295 - DNA, 281 bp, Homo sapiens
  misc_feature (30)..(30): n is a, c, g, or t
caggtaacagagagcttcgccttccttcantggtgcttttcccccatcctgtatgccttttccagtccccgcttccgccagtacctgaaggcttttctggctcccgggcttggatggcccctggcccctggccctgcccaggcctcattatccagttgttttgagagcagcatactttctgcccaaaaggaaatggttggcatgaatgcccttggagaggggcagtttgagacctcccctaacaagggggatgtggggaataaatcagcctgggtgcccca

SEQ ID NO: 671296 - DNA, 209 bp, Homo sapiens
ctgcagaggagacagggtatcaccagtctcctgggacctccgcctcctgtgatggtctccatctcctgacctcgtgatccgcctgcctctgtctcccaaagtgctgggattacaggcctgagccaccgcgcccggccagatgggctcaaggacagcttgcctgactgcagccataagggtgaagcctcttcaggtagagaaggactcca

SEQ ID NO: 671297 - DNA, 203 bp, Homo sapiens
gtgaccctgcatgctgatgccattcaccggggaggtggccagatcatccccacagcacgccgctgcctgtatgccagtgtgctgaccgcacagccccgcctcatggagcctatctatctggtggagatccagtgtcctgagcaagtggtgggtggcatctacgtgtcctgaacaggaagcgtggccatgtgtttgaggagtcc

SEQ ID NO: 671298 - DNA, 200 bp, Homo sapiens
  misc_feature (128)..(128): n is a, c, g, or t
gagcttgctgagctccggggcccgcggagtcgcgccaggctcctgggaaaggacggggagtgttacctgggagcagctgctccattgtgcctcgaggccccgatcgggctaggccgacggctagcctncctatcaactttcctctactcggcggggttcgtgcgagcgggcgagtgtacttcggccacgcctctaaaagg

SEQ ID NO: 671299 - DNA, 830 bp, Homo sapiens
cttacccaccctccacctcactccttacaaactagctagcgcacttgttaagacccccacacatttattggcaggcacgaaacaggagagatgctgcattaaaagatgtcaccttgtggaacataaaaaggacatcagcaaacaggatcagttaactattgcatttatatgtaccgtaggctttgtattccaaaattatctatagctaagtacacattacgcaaaaacaaaacgaaaagaaaattctccgacgtaccgctatatcaaatgtatactatcataccagtaggcgcttataataaagaaatgagtctcttggccttaccggaggcagctctgcacgcacctccatatattgagggataatccatgaccccccttacctccactccaccgctcgtactctttgctcgcttcagtggcctcaccccattcaaatccttttatactgccatccacattattcaggcgataatccaagtaaaaacatgcatccaaaggccatctatacgccatcaacccctaacagtcctttttgtttgcccatacccataggcccagccccccccgacagccacccacctctccatccttctcttatcaggtcgccaaccctttcaagacttactttgcctcccttctcttaccccctcataactcctttcctcccctaccatctttcataccctcccgatactactataattgatcctacctttctccgttcatgacacagcactcgatatttgctctctatctctctccccccctccacaccgattaaccaccatcttcctacactccgaccaaaccgcactcactcctctata

SEQ ID NO: 671300 - DNA, 148 bp, Homo sapiens
cagtagcacctgggcgcggcgaccaaaaatctctagcaactgaccagcatatgcggtggaggttcgttggcacgggtcagcgcgtagagagtgatcggcagcggcggggtgagcgttcggatatgggtggtggccgtgccgcgcagag

SEQ ID NO: 671301 - DNA, 376 bp, Homo sapiens
cgttatagaggatccaggcacaaatttgtaagtagcatcccaccaatggtcatgagattttccccaaagttaaagcagagaggttgggcacgatggctcatgcctgtaatcccagcactttgggaggccaaggtgggcagatcacctgaggtcaggagttcaagaccagcctgggcaacatgacaaaaccctatctctactaaaaatacaaaaattagccagttgtgatgatgggtgtctgtaatcccagctacttgggaggctgaggcagggagaattgcttgaacccgggaggtggaggttgcggtgagccaagatcacaccactgcacttcagcctgggcgacagagctagactccgtctcccaaaaaaaaaa

SEQ ID NO: 671302 - DNA, 902 bp, Homo sapiens
ggtctgctcatcgccagcgtaggtgttacctacccgctgccgtcgccggcgacattatgatggcacggaacgtagtcctgcattctgggagcagctgcagacaatggtgatcactgtactaacttgccctacaggaaatctatttcgcgaactatcttctccagcggagatggccaatggtgcttagtagcagtaggaccagagcatggttaacctatctccccaggatttggctcttgggtcaaaagggttgtcatgtcccaaagccttttcgactgcgggatcactcaggtccggagtgagtcgtcactgtggctgttgctgacgtcctagatattgctctcgaacagttgttgcctggtgaaccctatgggacccttatgcactctcaagatcaagtagcgttaccagcttccgtggatacagtaggtatttgatggtcaacctcaatgggactgcttcatcagatgacctgcctggttcataaaactttgcctgatgttctagcagaacctttatcaagtgaaagacatgagtttgtgatggcaccatatgtgaatgaattccagggtattgatgcacctgttgaacaagaaattaacagtgcagaaccttacttttgaaagtgccacgagtagagtgtgcatacaaacctgtccagaaatggctggaaaagatttgaatcacctgttccagacattagctaatggaacctatgattctgactgtacccacaaacatagaatgttgctgttggcgtgcacacattgaattggagaaactgcctttcaaatctcccgggggcggaaaaagttgtctcacagaggattggcgcgcatggccccactgtggctttgggatacaaccctttttggcggccaccagatctctacaccgaaaca

SEQ ID NO: 671303 - DNA, 558 bp, Homo sapiens
taccggttccatgtttcccagtaaggaaaactaagaagcgtacagaaaaaaagatacaagggcaaaagttcaaagatttaaaagtaagtacagattgagctgacatggaggatgaccttgtttgagcataggagacttctcctgtgcctgatctctgcacctcatcctcccccattacccagtgtatgcattcacgggagactacacagataatagtgtacaagaagcatcagaatggggaaaagataagtaagatgaacttgcattgtggaaatatagtgatctattttaaaaacacgtgatgtgttagctcacgttatctcactcacgtgaggaggacatgaacatgaaatctctgtttttataacggagacgaatgagactttcaggtagatcaattacttcccagggttagtgctaagaggaggtagaactactcctagctctgaagatttgccagtactttgctgcactaatagataataacagtctattagaggagttctagtaggtaaggaagagcctatgttgggatactatccgggagaaaactcacca

SEQ ID NO: 671304 - DNA, 200 bp, Homo sapiens
ccgggggcccccccccggcctttcccccctttgggggcctttggggggggggggggggccccccccttcctttggttttttggtttttttttttgcctttggtttccccttttggccggggggttcctttttttcccccggggttttcccccccccccccggggggtgggggttttttcctgcctttccccttgggttta

SEQ ID NO: 671305 - DNA, 862 bp, Homo sapiens
  misc_feature (233)..(233): n is a, c, g, or t
tatccataggtttctctccctccttctccttctcacacacaactgtccatactaacaagtttggtgcatgtctgttcttctgtagggagaagctttagcttcattttactaaaaagattcctcgttattgttgttgccaaagagaaacaaaaatgattttgctttccaagcttggtttgtggcgtctccctcgcagagcccttctcgtttcttttttaaactaatcaccatantgtaaatttcagggttttttttttggtttaagctgactcttgggctctaatttgggaacaaaagagaaaggtgaagggtcaattccaaggtatgtgggttatctggtgaaagtggcacagcgggggcttttcctaaactgggtggtttttccccggcattggggggatttttaattattattcaaaaacataactggagttttttaaaagaggagaaaatttatatcggggtaaagggtttatcatatatatggggtacttggtaatatctaaaaatttagaaccggaaatgggaatcctggtcacaaaatcattttaagatctttgcgaagctgttaattttccttagtggtggtgggacatggcagactttgtccagggctcccagggcctgtacggacactgtgggaaggcttccctctgtcgggctttgtgccatctgtggatatgccaataggttggtgaacaaatccggagcaagggggagtcctttcaggcggggaagcacttggcgcgcatttcccctgcaattcctctatggtactcatgtatgtcatggatttccatcattattggcgtgccacaaggcgtttgcaggccccgttgtcgcggccacggggggttgcgca

SEQ ID NO: 671306 - DNA, 782 bp, Homo sapiens
ggcgcaggattgcccttgctgtagacagagcgcttggcagctgatgatcacgtgagattgcgcagcgacgcagtgatgagtcttcgaggacgactagatggaggccagtgtcacgaacctactagagacaccctcatgccagtcgcagatgtttccggtcgccaacatgccaggataagccagcccatcccgctaggtcgcgttcttgcctagcgtagtacgagtagattgagtcaggatggagctggtcggaagttgtcgcggtgaatcaacgcgacgcatacctggtctatatgccaggtccccgagcgcgggccttgtggtagagcgcgtgaaaggcgggcgatccctcttgagctcggcacggaactatccttcgcgtgacctcgctgacggtccgcttgtcagcttccaacatcgtcgcggctgcggacgaccatgtatgcaaatctgccgagaactacgatcatgagagcactcagctctttaacgccatgaatctgcttcatgggcgccgtgaacaagatggaccagacggtgatggtgcccaggcgttgcatgggcgacgtgcccctggctgagcccgggttagacaacgatgttggcgtggaggtaggcggcagtggcggctgctggaggagcgcacgcccccagtccccgactcgggaagcgccaatggcagctttttcgggccctctcgggaccatgtacagccactaccgtgcttctcaagtccatccgcaacgacatccgagtggggggggtcctgcaccaggcgcctc

SEQ ID NO: 671307 - DNA, 751 bp, Homo sapiens
  misc_feature (259)..(259): n is a, c, g, or t
agcggaaaacatcgtgcttcgcacagatcggttcatatatttgagaatacaaccttatgacctgcttgtctctgtactgtccgtagtgacttggaaggtaaatccagagtatacttagagcgatacaacgcaagtatgctatttcctcgtagaaggtgacattagtgtgatcactctactgctcaacagtagaattgctagtttgcatctgcgttcctctttcagttcctgtgtaagcactgatgtatgtacccgatantcaagacaggatgtgatatttatttctcaaatctactgggaaaaactagttggtactagatgagcaatatacatgcctttttactcctcactctagaaataggaaaattaagaccacttacaggggagagaatccttatgatgctgatgaattaatgaggagtgtaattatacaccttgctgtatcttgaaggtcgtagagcaagaggaggaaatgatatgacaaggtaatactaacatggtgtgcctgaagctgtttgtgacttaaatggtgtgtagttgactagaaggctgggagagagtgcacaacacttaggcatcatgtttatctttttataaagaaactgggtacacagcgttttgtaattggttttatgtatcacaggaaacattaggccaagatatacttgtaaattcgtaacgaatagttttagtgagatactctgataggcaagatataatatcccttcggtgaaatgtagaaggaaatcct

SEQ ID NO: 671308 - DNA, 275 bp, Homo sapiens
  misc_feature (7)..(7): n is a, c, g, or t
  misc_feature (9)..(9): n is a, c, g, or t
  misc_feature (32)..(32): n is a, c, g, or t
  misc_feature (70)..(70): n is a, c, g, or t
taaaggnangcttgcctgtgttgggaatctcnaggatcccccgcaaatttccttccactcgaggataggngttggagaccagcctggccaacatggcaaaaccccatctctatgaaaaatacaaaaattagccaggtgtgatggcacatgcctgtaatcccagctactcgggagcctgaggcacaagaatcacttgaccccaggaggcggaggttgcagtgagccgagatcaagccattgcactccagcctggcaacagagtgagactccatctt

SEQ ID NO: 671309 - DNA, 1223 bp, Homo sapiens
ctggtggctagtggagcgctttctcccgggaacctgcggctgtgacccaatgtgtgccctggaccatgttttgtgtgtgcttgctgtgctggcctgcctcaagtcaaccatgtgtactgtcaggtctgtgctgtgcccatgctctgtgctgctgctgtgtgtggagcctggagtggctgacagtcatgatgcctggtgtgtgccatgctgtgtgacagctgacctgccaagatccacttagtgacccctgtctgattcttgcgacagctgtgccactgtcttgagtccctggtggcctccatctggtgcttgcagatgtctgccgttaggacctctggccatgtgatacccatctgcccatggctcttgattgcttgccctgtgatcacctgacttgtgcccttgtaatgcaaccttctgcagcgaggaatgcccatgatgcttgcgccatgccctttcttgaagtgcttgatggacagaggtttggcacgttgtggtgctgcatcctatagcttgaccccatacacccattttgacgggtcttggtccggaacctgcccatatcagttgtttgacgcaatcccacaattggtgttacccctagacatctgggtgtgtcatgtggaaagccaaacccactttgggcaagtgaccccagcatctggtgggccccgggtggcctggaaagccagagccttctggcacaacacaatcttatccccagtgaaccgcccctgaagacctggcgtgccacggactccaaagacccttgatttccaaaaagtgcatgccgagtggcacccagccttggacccgcgggaaaacgtggcccaccagattccatctggggaacttgtgccgtgcgaacccaccggtggtgggactggagggccccatcaaaggacggcattgagaccaatgcacgaagggacccaccacagggccacgaagacgcccctgggggcaagtactgcagcaaacaccacctgcaagaccggccgttcaggcaatctccgtgggagcccccaaaactaggcagctgtgacccaaggcccaagaaggggccaagacgagagcaccaggcactcccacatggcagcagatacctggcacctccaagagcgagcacacagcgtgcacgaaaaccgcgccgaaacggcggggacgaagggcccacagggagcagcacacacggaccgacctggaccagcgacaaccacgcg

SEQ ID NO: 671310 - DNA, 726 bp, Homo sapiens
gagctggccgggggcatgtgagtgatggtgcaggaaggagagtcaagctgactgttggagtgagcgggagagctgagctcagctccaaccctgcctgctctgcgtgttggcatcgctggagccgccggcagctcctggcaccctggagaatgacaacccctgcctgtggtgctgaggggggatgctggtgctgcgtgtgccgtgggcgtgcagtgagtgggctctgtgcgcgttccctctgcgtgtgtgaggtggaagtggattttattggaagagcttgggttatggaacatgagaaaagaactctttagaagggctccaggagattgggaattaacatacgatagctttgtatgccccaaaaagatgactacaaacataggatgttttggcgagagatgtattcagtggaggaagcttgagcaagcttatgacgtctcatctcgtgctggagagagaaagtactggaggaagtaggacaataacacgtcctacatagcgaagccctccaagcccttgggcactttggggcgatccttcaaatatcgatacctataacgccaccaaacagggtacggatactccccaggaattcggacacacggtttaacaaaatggggagccaaggtggtatatctcagaaggcacggcgaagcggccgacattcaatatggggccacatggcttaatgtgcaatttcacgtataacgaccgattagctagtgg

SEQ ID NO: 671311 - DNA, 402 bp, Homo sapiens
  misc_feature (83)..(83): n is a, c, g, or t
  misc_feature (94)..(94): n is a, c, g, or t
  misc_feature (97)..(97): n is a, c, g, or t
  misc_feature (99)..(99): n is a, c, g, or t
  misc_feature (136)..(136): n is a, c, g, or t
  misc_feature (172)..(172): n is a, c, g, or t
  misc_feature (196)..(196): n is a, c, g, or t
  misc_feature (224)..(224): n is a, c, g, or t
  misc_feature (237)..(237): n is a, c, g, or t
  misc_feature (255)..(255): n is a, c, g, or t
  misc_feature (318)..(318): n is a, c, g, or t
  misc_feature (358)..(358): n is a, c, g, or t
  misc_feature (364)..(364): n is a, c, g, or t
  misc_feature (377)..(377): n is a, c, g, or t
  misc_feature (390)..(390): n is a, c, g, or t
gactttgccttggagagccagagcttccgcattttctttactattctttttaaaaaaagtttccctgtgtagagaacatatangcataaacatnggncnattatatgtctcccttagaaaaataataattggaaancatgttttagacctagttccaaaaataatttaaggngaaatctttaatttttataaaagnagcaaaataaaggcataattaaaatatntttggccataccngccttggaagcagatganccagccttctttttttcataaccgggttagggtaagaaattgccctttgaaccaatccctttnggaactgacccttatgaaatatatgtttttcatggggggntttttntagcccagtttgngcaattaaatagnttcataagcata

SEQ ID NO: 671312 - DNA, 198 bp, Homo sapiens
  misc_feature (1)..(1): n is a, c, g, or t
ntatctcatatagttcaacactgttactgtcgtcaatgcttcgactcggcgctctcgtctgacaccgtccgtaattggaaaacccctgcggggcaccatagtgatcttccccgatggtgggcacgctgtggaacgccttcttcctgggcggcctcaagtcaccgagatgcctggtgagcggtgagcagatcaacaaca

SEQ ID NO: 671313 - DNA, 848 bp, Homo sapiens
cttatgcgtttttctcgaccctgatcacatcacactcatagggcgatgttatagcacatgcatgatacctttttggtgctctcctcaccctccacttctcttcttaatgtgtgttttatcagcggccgtgtctttatgattgattttcccccgcgcattgttttttttttctcgccgcagattatttttggtgccccgttttctctcccctccctccgtctctctctctcccctccccccctcggtgtgggggtgctgtctcccccccctcctacgtggttgcttctcccgcctggtttcactctcattaagagtggaccctcccctctttaaacacatcatcactcctgttttttttgctctcaccgcggcggagtattatctactccctccgcggtggccctcctctttctctttcttttatagtatagtagactccacccccctcctcccctctcttgatttttttacgtactctcgctctcgtttgtatcactcacattcttacgggtggtgttttttggttctccccctccccctcctcctcccgtgtcgtgtttgtgatgtgctctccttcatctctcttcttcgtggggatgtttgtgggggggccctcactctttgttggtgctcaccacggcgtctctctcgcgtgtgtctctcctttcattctgtctgggtccaactgtttttctctcttgttgggttgtcccccccccccaatatgtttcgttcgtcatacccccccaaaaccctttgtgtgtagaccacccccccccgcggcccttttttgagagggaggggtgttttttttttgtttgtcccttttttgggggggggggtgttta

SEQ ID NO: 671314 - DNA, 91 bp, Homo sapiens
tgctcagataatcccgcaggtgtaatcacgaggattatgaagcaggagtttgagactggcctgggcattatagtagagactctgtcactat

SEQ ID NO: 671315 - DNA, 211 bp, Homo sapiens
aatataattcaagtatcacacaatatgtaccaaatacactctgtaactacatggccatttcttcccaagcccacagaccaagatgagtgtaaggctaacattcagagccctgtgctctatcctctagatgcagtggacaaacctgcgacatgcatagggccaggctcccaccttctcaacagggcttcctcccacctcatccccggctaat

SEQ ID NO: 671316 - DNA, 641 bp, Homo sapiens
gaaactaccttttattaaaccattttatcttgcgagacttattcactatcataagaatagcatggggaagacccgcctccatgattcaattacccccccactggattcctcccacaatacgtggtaattaagggagctacaagtcaaggtgagatttggatggtgacacagccaaaccatatcaccatgtaagagttatgaatcttgtctctaacttatttgggactcaaattataaattagtctttcactgggcatatgcatatatcagctagcttttactacgtgatgaattaccccatacttagaggattaaaacatcacacattcagattgttcattggtctgggactcgactatgtagttccctatgatttgtactggctctattagggttggatgatccatgatggtgccagatgggatgcttaggggctgaagtcttcttctctgcattgggtttaatccttgaacaggtcagctggggcttattcaccatgggagcaagtcttgtgtgcttaggcagtcttcacgttgtggcttgcataatatttgctagtatcctgttctttaacctagaattgatggttggcgaaaatgttcctatttcttgtatgtatggtccttcaatgccttatggtc

SEQ ID NO: 671317 - DNA, 249 bp, Homo sapiens
caggaaacgtgatttttgagagcctttggctatggtagaaaaaattaacaaacctgactcagtggcaaatcatcctgacttgactccgatcggcagcaggtgggttctcgagcaggaccccgtcgtccgtacacacaatcttattcagcaactcatgggcttccggaatgggagggccgatgtcctcaggatctgggctgaggaaggcctcctcgggtgtgagccccaggcgtggagggggccgcgcgg

SEQ ID NO: 671318 - DNA, 1317 bp, Homo sapiens
  misc_feature (1249)..(1249): n is a, c, g, or t
gctgcgcgcgggcgggcgggctatggcagcagtgcgggttgtagtgggccggcgctggtggcggggccctggtagcatggcaggtcatgtcggcggagtcgccctacggggtgctgtcagatttgtgacccagaaggaactctctgacctcagctgtggctctatggttgctaggccagaagccaaacttcatgtctgagtgcactgagcagcagtttgccatggcagagcttggggctagccacacggtgacccttagtgatgggacaacagcctacgtacagcacagcatgtcaaaggagagcacgcttcttgccacgggcaggtgatccagctacgaggatgggaccaccgcatacattcaccaggtgacggtaccgacaagaagctctctcctttgaggatggtcagcctgtgcagactggacagatggcagccatggcttacatacaccgggacacccagcgccggctatgaccccaggcaacctggcaagccggccaaactggcagatggctccactagactacatacaccaccctgtggctagtgccatcggaggagcaccatcctgggcgacagacagaggtgggctaggaggacatggccaggaacgaggatgctgcggggctccagaagcagacgcagaggtggcacggcagcggaatgccagcaagggagcgacaatgaacaggcgcgcaaacccggcaacgggcacacacggacaagagagtgggcagcacagatgcaatttcagacgtcagcggcatcaactgggatagtaggggccgagtacatacgcgaccgagcgtctcatctcgctttaacgtgtgcctcttgaacgacgccatccaccacggtggtacacggcagcaaacagaatgtgacctatcccccaccagtgtgccacacggccccctggccccacgggcagacgaccctggagcgcgcttgcgtcacacaatgagagcaagagcaccgacagggcccagcggaacagcgccacgacgggcaaaccagacgagggagacgacgagacgagatcgaaacgcacacgggaacgacacgcacacagcaccacaggacacggcaagcaacacacgacaccaccagccatcggacccaccgcagctgcacaacacacgacaccacggggcgatacggagccagaaagaggcacgagagacagacggcggcgggcacacacggatacatagacgcaagaagacagacgcatgggcggtcctcnaggcagcacaggccgatacgcagaacacagacacgcgcacacgaccggaaagaccgcacgccggagca

SEQ ID NO: 671319 - DNA, 471 bp, Homo sapiens
  misc_feature (203)..(203): n is a, c, g, or t
  misc_feature (264)..(264): n is a, c, g, or t
  misc_feature (311)..(311): n is a, c, g, or t
  misc_feature (470)..(470): n is a, c, g, or t
attacgctcctagacgggttgtgtttcaggatgactctttagagttaaaatgggacagtgataatgatgaagaaaatgaggatgtccctatttcaatgaaagaactaaaaccctttacagagaaaaacagataaaaagttggatgacataagttctaactacacagaatctttcagcacactagatgaaaatgaccttttaantccatcagaagatataattgcagttcagttaaaatttagagcatgtttaaagattctcacngtagaacttcgtactttatctactggctatgaaatagatggtggaanattgcgttaccaactataccactggcttgaaaaagaggtgatagctcttcagaggacttgtgacttttgctcagatgctgaagaactacagtctgcatttggcagaaatgaagatgaatttggattaaatgaggatgctgaagatttgcctcaccaaanc

SEQ ID NO: 671320 - DNA, 656 bp, Homo sapiens
gtcggccgcctactactactaaattcgcggccgcgtcgacgcgagaaaactgaaaatcacagaaaattagaaatacacactttaggacgtgaaatatggcgaggaaaactgaaaaaggtggaaaatttagaaatgtccactgtaggacgtggaatatggcaagaaaactgaaaatcacggaaaatgagtaatacccactttagtacgtgaaatatggcgaggaaaactgaaaaaggtggaaaatttagaaatgtccactgtaggacgtggaatatggcaagaaaactgaaaatcatggaaaatgagaaacatccacttgacgacttgaaaaatgacgaaatcactgaaaaacgtgaaaaatgagaaatgcacactgtaggacctggaatatggcgagaaaactgaaaatcacggaaaatgagaaatacacactttaggacgtgaaatatggcgaggaaaactgaaaaaggtggaaaatttagaaatgtccactgtaggacgtggaatatggcaagaaaactgaaaatcatggaaaatgagaaacatccacttgacgacttgaaaaatgacgaaatcactgaaaaacgtgaaaaatgagaaatgcacactgtaggaaggtcgacgcggccgcgaatttagtagtagtaggcggccgc

SEQ ID NO: 671321 - DNA, 310 bp, Homo sapiens
tgtggtcttgcagaacaataataaatctttgcaatctttccctaatgaacacatctcacattctagaaattctgatcattctaaattctggagattaacattatggtcccataacttacatgacagcacgctgataggtcccagatgaaaaggaaacagccaggaaattaaatggctgagttaggtggcaaccagagaattagaagtcccagaaaaactccagattcttggcacccatggttaagtttcagaaggtccaaggtctggtcctgtcaggatattcccttccaactggaaagaggtaccgagc

SEQ ID NO: 671322 - DNA, 814 bp, Homo sapiens
  misc_feature (687)..(687): n is a, c, g, or t
  misc_feature (736)..(737): n is a, c, g, or t
  misc_feature (748)..(748): n is a, c, g, or t
  misc_feature (751)..(751): n is a, c, g, or t
  misc_feature (765)..(765): n is a, c, g, or t
gtcggccgcctactactactaaattcgcggccgcgtcgacgcgagaaaactgaaaatcacagaaaattagaaatacacactttaggacgtgaaatatggcgaggaaaactgaaaaaggtggaaaatttagaaatgtccactgtaggacgtggaatatggcaagaaaactgaaaatcacggaaaatgagtaatacccactttagtacgtgaaatatggcgaggaaaactgaaaaaggtggaaaatttagaaatgtccactgtaggacgtggaatatggcaagaaaactgaaaatcatggaaaatgagaaacatccacttgacgacttgaaaaatgacgaaatcactgaaaaacgtgaaaaatgagaaatgcacactgtaggacctggaatatggcgagaaaactgaaaatcacggaaaatgagaaatacacactttaggacgtgaaatatggcgaggaaaactgaaaaaggtggaaaatttagaaatgtccactgtaggacgtggaatatggcaagaaaactgaaaatcatggaaaatgagaaacatccacttgacgacttgaaaaatgacgaaatcactgaaaaacgtgaaaaatgagaaatgcacactgtaggacctggaatatggcgagaaaactgaaaatcacggaaaatgagaaatacacactttaggacgtgaaatgatggngaggaaaactgaaaaaggtggaaaatttagaaatgtccactgtaggacnnggaatatggcnagnaaactgaaaatcanggaaaatgaggtcgacgcggccgcgaatttagtagtagtaggcggccgc

SEQ ID NO: 671323 - DNA, 1300 bp, Homo sapiens
  misc_feature (415)..(415): n is a, c, g, or t
cagcacttccgggggccaaggcaggaggattgtttgagcccaagagtttgagaccagcctgggcaacatggcaaaaccccatctctacaaaaagtacaaaaaattagccaggtgtggtgccatgtccctatagtctcagctactagggaggctgaggtaggaggattgcttgagcctgggagcggggggttgcagtgagctaaaatcatgccactgcattccaacctggggaacagagtgagaccctgtctcaaaaaaaaaaaaaaaaaaaaaaaaaatccaaattcggggtgcgggaaagatgggaaaaaaaaaaaccttttttggggtgtgatgggaccccatttgtgttgaaaattttttttctcccgtgcaggtgctggtggttcccacccattcttatttaccccctccnctattctttctctcatttctcatctcattatttttctttataaaacacccttataccttatgtggtgctataggcgcaccaggttctcttaaaagagaccttggagagaatccccgcggggagagaactaagaagccccctgtgtctgtgtctccgtgtgggagccccttttgtttgttctcttagccgggggggggcacacccacgtgggagacccgattttacaccttttgtgttcacccttctgtgtgctccgcctctgtgtctctcacacgggcgcgttctccgcagggtggccctttctcgccccaccgcctgttttagcccacacgcgggcggggcacccgcacgcggggcgcaactcgtggcgtctctctgcgcggggcgccccgcgtgttgtctcccccccgagatgcttgggccatctgcggcattcacacctctgcgcctctatttgtagcaccccccagggagatctttctccgagacaaaatttcttttggtggaccgccccccatcttgtgcccttttccagcacgcgccttttttggaggtgtcttccacaccaacacactgttcacacccccacttctcctgtgggggaaagcgacacctctctctttgagcaacgccctattttggcactccttgttgaacctcctaagacaacaaagcgccctcttgcaacattgtgcggctcacaaccacggcgcgcacacacaactacatcaacgagcggcccctccccacaaaggggcccgtgggagagggacataaaaaccccctctgcgttcctacaacctgttccttcatacacatgtggcggcgccccaacattatacgtaccagccggcagcgagcgaagcaaactgccgcagacctacc

SEQ ID NO: 671324 - DNA, 364 bp, Homo sapiens
gtgcaaatacggcattcaatgtcttcagaattgccgtccctcagaactctgtcaccacgaggtggcagcactcccagtgtctgggtgtcttctgagacactgtcgaccatgttgcattatgtatatgttgtaacttacttgaccacttctactgttgtgcattaatctttttctttccttatgtcctgtaaaatgctgtgacatccttttaacctttgcctcctcatctcctattaatttcttaggctatgtttctctgtgtgggcttaaaagctggtcactagatactatcgtactttcaggctcgactatacactgctgttaaactgttttccagactttctgttttcatttgccagctgtc

SEQ ID NO: 671325 - DNA, 207 bp, Homo sapiens
ttagcctactatatggaaactttttattggcactaactttgaaccattttgagacattggtagggtctgagctatgacctcaattgtcttcctagggcctatcgtgtgagcacaccatatattgacagcacaaagagctgtaaacacaggtgcgagcaccgcgtccggtagccacgactttgatggcgcctctcgtgtatagatata

SEQ ID NO: 671326 - DNA, 896 bp, Homo sapiens
  misc_feature (619)..(619): n is a, c, g, or t
gtcggccgcctactactactaaattcgcggccgcgtcgacgcgagaaaactgaaaatcacagaaaattagaaatacacactttaggacgtgaaatatggcgaggaaaactgaaaaaggtggaaaatttagaaatgtccactgtaggacgtggaatatggcaagaaaactgaaaatcacggaaaatgagtaatacccactttagtacgtgaaatatggcgaggaaaactgaaaaaggtggaaaatttagaaatgtccactgtaggacgtggaatatggcaagaaaactgaaaatcatggaaaatgagaaacatccacttgacgacttgaaaaatgacgaaatcactgaaaaacgtgaaaaatgagaaatgcacactgtaggacctggaatatggcgagaaaactgaaaatcacggaaaatgagaaatacacactttaggacgtgaaatatggcgaggaaaactgaaaaaggtggaaaatttagaaatgtccactgtaggacgtggaatatggcaagaaaactgaaaatcatggaaaatgagaaacatccacttgacgacttgaaaaatgacgaaatcactgaaaaacgtgaaaaatgagaaatgcacactgtaggaaagnacctggaatatggcgagaaaactgaaaatcacggaaaatgagaaatacacacttaggacgaaatatggcgaggaaaactgaaaaaggtggaaaatttagaaatgtccactgtaggacgtggaatatggcaagaaaactgaaaatcatggaaaatgagaaacatccacttgacgacttgaaaatttacaaatcactaaaaatttaaaaaatgagaaatgcacactgaagggcctggaatatggcgagaaaactgaaaatcacggaaaatgaggtcgac

SEQ ID NO: 671327 - DNA, 696 bp, Homo sapiens
gtcggccgcctactactactaaattcgcggccgcgtcgacgcgagaaaactgaaaatcacagaaaattagaaatacacactgtaggacgtggaatatggcaagaaaactgaaaatcatggaaaatgagaaacatccacttgacgacttgaaaaatgacgaaatcactgaaaaacgtgaaaaatgagaaatgcacactggaaaactgaaaatcacggaaaatgagaaatacacactttaggacgtgaaatatggcgaggaaaactgaaaaaggtggaaaatttagaaatgtccactgtaggacgtggaatatggcaagaaaactgaaaatcatggaaaatgagaaacatccacttgacgacttgaaaaatgacgaaatcactgaaaaacgtgaaaaatgagaaatgcacactgtaggacctggaatatggcgagaaaactgaaaatcacggaaaatgagaaatacacactttaggacgtgaaatatggcgaggaaaactgaaaaaggtggaaaatttagaaatgtccactgtaggacgtggaatatggcaagaaaactgaaaatcatggaaaatgagaaacatccacttgacgacttgaaaatttacaaatcactaaaaatttaaaaaatgagaaatgcacactgaagggcctggaatatggcgagaaaactgaaaatcacggaaaatgaggtcgac

SEQ ID NO: 671328 - DNA, 130 bp, Homo sapiens
  misc_feature (51)..(51): n is a, c, g, or t
aaatttaatagcaacggcctccagctctctctgaactggactgagtccccnaggggactggtgggcaatggcttctgatgacccgagggaagggtaggtttataggaagggtattcgagattccatgatc

SEQ ID NO: 671329 - DNA, 612 bp, Homo sapiens
  misc_feature (224)..(224): n is a, c, g, or t
  misc_feature (226)..(226): n is a, c, g, or t
  misc_feature (230)..(233): n is a, c, g, or t
  misc_feature (265)..(265): n is a, c, g, or t
gtcggccgcctactactactaaattcgcggccgcgtcgacgcgagaaaactgaaaatcacagaaaattagaaatacacactgtaggacgtggaatatggcaagaaaactgaaaatcatggaaaatgagaaacatccacttgacgacttgaaaaatgacgaaatcactgaaaaacgtgaaaaatgagaaatgcacactgtaggacctggaatatggcgagaaaangnaaannnnggaaatttagaaatgtccactgtaggacgtgnaatatggcaggaaaactgaaaatcacggaaaatgagaaatacacactttaggacgtgaaatatggcgaggaaaactgaaaaaggtggaaaatttagaaatgtccactgtaggacgtggaatatggcaagaaaactgaaaatcatggaaaatgagaaacatccacttgacgacttgaaaaatgacgaaatcactgaaaaacgtgaaaaatgagaaatgcacactgtaggacctggaatatggcgagaaaactgaaaatcacggaaaatgagaaatacacactttaggacgtgaaatggcgaggaaaactggaaaaggtggaatatttgtcgacgcggccgcgaattta

SEQ ID NO: 671330 - DNA, 437 bp, Homo sapiens
aactgagggtagtaaactacatcagttctcccaagcactcgagtcccagcttcacccactgtgtgtgcttatgtttgaactgttcaagccttttatagccttaccataagtatttagatatggtgtcctttactgtttaaggggggggagtaatgtcgtgtttttgcaaagtaagtgcttacgtattaacttagggtatgtcccctctgtatgtatcgaaggggttatggctcttttatgcttctagttttctataaacatgttttccactcccacttggccattttggaagctggtcagctagcaggttttctgagatgtcgggagcactagatgaccttatcgggtgcaatcactagctaaggtaaagctagaaacctacactgtcactttactggagatatctgagtatactttacatattggcttcatgtagc

SEQ ID NO: 671331 - DNA, 521 bp, Homo sapiens
  misc_feature (394)..(394): n is a, c, g, or t
  misc_feature (443)..(444): n is a, c, g, or t
  misc_feature (455)..(455): n is a, c, g, or t
  misc_feature (458)..(458): n is a, c, g, or t
  misc_feature (472)..(472): n is a, c, g, or t
gtcggccgcctactactactaaattcgcggccgcgtcgacgacgaaatcactaaaaaacgtgaaaaatgagaaatgcacactgaaggacctggaatatggcgagaaaactgaaaatcacggaaaatgagaaatacacactttaggacgtgaaatatggcgaggaaaactgaaaaaggtggaaaatttagaaatgtccactgtaggacgtggaatatggcaagaaaactgaaaatcatggaaaatgagaaacatccacttgacgacttgaaaaatgacgaaatcactgaaaaacgtgaaaaatgagaaatgcacactgtaggacctggaatatggcgagaaaactgaaaatcacggaaaatgagaaatacacactttaggacgtgaaatgatggngaggaaaactgaaaaaggtggaaaatttagaaatgtccactgtaggacnnggaatatggcnagnaaactgaaaatcanggaaaatgaggtcgacgcggccgcgaatttagtagtagtaggcggccgc

SEQ ID NO: 671332 - DNA, 130 bp, Homo sapiens
gtctgactctagatggatcccctagttttaattgggaacatacgatgatggagcaaccaaactacaatgatgatgtgcactggtgtgctcatatggtggtacctgatgctctgaattctgtaaatccatt

SEQ ID NO: 671333 - DNA, 503 bp, Homo sapiens
  misc_feature (333)..(333): n is a, c, g, or t
  misc_feature (335)..(335): n is a, c, g, or t
  misc_feature (339)..(339): n is a, c, g, or t
gtcggccgcctactactactaaattcgcggccgcgtcgacgcgagaaaactgaaaatcacagaaaattagaaatacacactttaggacgtgaaatatggcgaggaaaactgaaaaaggtggaaaatttagaaatgtccactgtaggacgtggaatatggcaagaaaactgaaaatcacggaaaatgagaatcatggaaaatgagaaacatccacttgacgacttgaaaaatgacgaaatcactgaaaaacgtgaaaaatgagaaatgcacactgtaggacctggaatatggcgagaaaactgaaaatcacggaaaatgagaaatacacacttnangacntgaaaaatgacgaaatcactgaaaaacgtgaaaaatgagaaatgcacactgtaggacctggaatatggcgagaaaactgaaaatcacggaaaatgagaaatacacactttaggacgtgaaatgaggtcgacgcggccgcgaatttagtagtagtaggcggccgc

SEQ ID NO: 671334 - DNA, 634 bp, Homo sapiens
gtcggccgcctactactactaaattcgcggccgcgtcgacgcgagaaaactgaaaatcacagaaaattagaaatacacactgtaggacgtggaatatggcaagaaaactgaaaatcatggaaaatgagaaacatccacttgacgacttgaaaaatgacgaaatcactgaaaaacgtgaaaaatgagaaatgcacactggaaaactgaaaatcacggaaaatgagaaatacacactttaggacgtgaaatatggcgaggaaaactgaaaaaggtggaaaatttagaaatgtccactgtaggacgtggaatatggcaagaaaactgaaaatcatggaaaatgagaaacatccacttgacgacttgaaaaatgacgaaatcactgaaaaacgtgaaaaatgagaaatgcacactgtaggaaaatatggcgaggaaaactgaaaaaggtggaaaatttagaaatgtccactgtaggacgtggaatatggcaagaaaactgaaaatcatggaaaatgagaaacatccacttgacgacttgaaaatttacaaatcactaaaaatttaaaaaatgagaaatgcacactgaagggcctggaatatggcgagaaaactgaaaatcacggaaaatgaggtcgac

SEQ ID NO: 671335 - DNA, 435 bp, Homo sapiens
  misc_feature (201)..(201): n is a, c, g, or t
  misc_feature (203)..(203): n is a, c, g, or t
  misc_feature (207)..(207): n is a, c, g, or t
  misc_feature (267)..(267): n is a, c, g, or t
gtcggccgcctactactactaaattcgcggccgcgtcgacgcgagaaaactaaaaatcacggaaaatgagaaatacacactttaggacgtgaaatatggcgaggaaaactgaaaaaggtggaaaatttagaaatgtccactgtaggacgtggaatatggcaagaaaactgaaaatcacggaaaatgagaaatacacacttnangacntgaaaaatgacgaaatcactgaaaaacgtgaaaaatgagaaatgcacactgtaggaaagnacctggaatatggcgagaaaactgaaaatcacggaaaatgagaaatacacacttaggacgcctggaatatggcgagaaaactgaaaatcacggaaaatgagaaatacacactttaggacgtgaaatgaggtcgacgcggccgcgaatttagtagtagtaggcggccgc

SEQ ID NO: 671336 - DNA, 598 bp, Homo sapiens
taatccaatccgaaggttcccaaatcgccccgcacatccggtttaggcttttagggatactttctcgtccattgtctcttgtcttcgcggggcccctataaggggggacgcggttgttcccggtctacgaggaaaaagggtaaaaccttcgagagttgcgaagccgagtgccgaatgataaggccgagcgacgaatccttggcttctctccgataagctccctactttacctgctctctgacggctagcttaaaaggatttttgggtaatagagatatatctctaaaaacggccgttaggggaggagctctagtgtattaaggcggatggaaagtttaggtagggtgcgctgttgtgtcttgtgtattgacttaggccgagggggattagcgtttttatgaatcgggggcggttagacgtcggtttcgtgtaattcggcctcgtgtgtagtgctgtacttttcttctgtcgataggggtatcgtcgtcggttccgttatcggcgttgatgaccttggggcggtggcgtggtggtggtagtagtggtagtgcttgtgactgtcgtctgttgggtacctgtatttcgaacgtagtgctga

SEQ ID NO: 671337 - DNA, 601 bp, Homo sapiens
aagtgcctgtgtggtctgtttacagtgcagaaggcggctcagcagtgcaatggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtgtggcagagagaggcaggaagctggcagtggcagcttctggcaggcaagggcttccaactgaggcagtgcatgtgtggctccctccttccctgtcagggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaaa

SEQ ID NO: 671338 - DNA, 255 bp, Homo sapiens
cgactctgcctccttggttcaagtgattgtccgtgcctcagccttgtgagtagctgggactacaggcatgtgccaccaggtcgggctgatttcgtatttttatgaatagtaggatggggttttaacatgttggtcaggctggtctcgaactcctgacctcaagtgatccgtccacctcgccctcccaaagagttgggattacaggcatgagccaccgccctggccctcaaaaaaacgctttcatctgaccttgat

SEQ ID NO: 671339 - DNA, 173 bp, Homo sapiens
ataaagtcagttagaaggacttccttaacaatgactatcataatgtcttacttaaaatacagtttcgtattctgtcaatgcacatataagacaggttgagccttcatcacgtaacaacatattttgtagatcacatattgatttttcacacatcaacaatgtatttcaaactc

SEQ ID NO: 671340 - DNA, 367 bp, Homo sapiens
  misc_feature (335)..(335): n is a, c, g, or t
  misc_feature (341)..(341): n is a, c, g, or t
gatttcggcacaggaattcctgacctcaggtgatccacctgcttcggcctcccaaagtgctaggattacaggtgtgagccaccacgcctggctaattttgtatttttagtagagatggggtttctccaaaggctggtcttgaactcccgacctcaggtgatccgcccaccttggcctcccgaagtgctgggattacagggcgtgacacacgtgcccggcctggatgtttttgaatgattatggaaaatggggtattacagcatttaaaacttagacttgatttttaaatatattaatttcctttttaaactcaatataatggttaataatacctntaggcnattaccaggcactttcctgaaaggtt

SEQ ID NO: 671341 - DNA, 237 bp, Homo sapiens
caatgttggactcagatctccaatgtgatattagttccattttgcactacaaaaagaaccaaaatggtaaagggtgtgtgaggaccaaccctcatttctgccagctcatggatgtccaacattttggcttgcctgggtcacatttaacgaacagaaattgtcttgagccacgtatatgtaaactgctccaaaagtaatgttttccgcggaaaagtaatttatttccttggtcgacgc

SEQ ID NO: 671342 - DNA, 1107 bp, Homo sapiens
gacaagcaccaaaagcaccacaagtaccacaagcatggcaagcattcctcattttcttctgcatcttcttgtatactatcactgctggtccaagcattgggagccgcaaaacaagtcacaacagaagcaaatgcaacgacacagagtcaaaaacaccaagatgccacgatagacaacagaagcgaaaagaaagacaaaagaaagacacaaacaaaccacaataaaacaccaaacaagcaggcacaacaacaccagaacagaaagacagcacacagaagaagacatcaaagcaaacactgacgaccagaaagaataggacaacagaccacaagaaaccaacaaagaaagacagccaacgagaaacagaaaacacaacatagacataaaacgacaaaccaagaaaagagaaacaaacacaaaaaaaccagaaaagaagaacaccaaacaaccaagagacagaaaaaaaacaaaaaaaagaaaaaaacaagaaagaaacaaggaagaacaaacaacacaacaaaaacaaaaacaaatagaaagatacgacaagcaaagcacagcacaaggcacgaagaaaacagaacatagcgagacgagagaaagaagccaaacaaacccaaacacacaccaaacaaacccaaacgcaaacgacaaacaccaagacaaaaacggatccacaaaacaggaggcaagcggaacacgacgaaaacagcaagccaacagtgcaacagaacgacgaaacacacacaggcaaaagacaaaagaaagacagaaaagaaacaagcagacaaagacacagaacaagaggagacagaagaagagaaatggaactagaagagcaaaagaaaaaaaaaaaaaaacacccaaacaaagacaaaacaaacagaaaaggaaaaaacggaaaaagaaaaagaagcagaagaaagagcgaagacaaaacaacaaaaaaagaacagaaaaaaaacacagaaaaacataacaagagaaagaaaagaaaggaacagaatagaagacaaagaagacaaaacaaacgaagaaacaacaaaaacgaaaacaaagcaagatgacagagacagcatacagaccaaaacaacgaaaccgacaaga

SEQ ID NO: 671343 - DNA, 91 bp, Homo sapiens
tgacacggctgctactgtgagaagtaaaattctctctaaaaatcataaatcagatcacgccactgcactcgtctgggtgagaccctgtctc

SEQ ID NO: 671344 - DNA, 327 bp, Homo sapiens
  misc_feature (15)..(15): n is a, c, g, or t
tctcacgtcaccagntgcacatatgagccccatagggaaacatggcccctcaggtaggtggctggggattctgaaataggcttaagcaacattggtttggaggttgattagtccttggccagtctgtgctgactagtgactggtattctccgctcctgcttcactcttccctccgcccccgaccgcgcccaccgcaggtcaccacctatttgcagcaggactacaacaaccgtgtggatcatcaagaaccgtaacataaactcaggtaatgtggtcagagactgatgctgcttgtgctgttactccctcggagaccccgtctccaca

SEQ ID NO: 671345 - DNA, 391 bp, Homo sapiens
cttctcttcttcctctccttcctcctcctcctcctcgtcctcgtcatcacggagggacgccagcacctgggccaggtggaagccctccagcacctccggaagcggttcacagccttcttctcccaggtggtggccattcaggtccagcttctccagctcagcttggtcggccagggcctcagcaacagccagggcagcatccctctggatttcacagaaggacaagttcagctcctttagctggggcaggccgccgcggatggcatctgcaagggcaacggcaccctgggagcgcaccaggcagtccccaaaattaatcacctccaccggccgcaaggtcttcaaggtctcggccagggccacggcgcccttctcagggaaggtgtggtca

SEQ ID NO: 671346 - DNA, 262 bp, Homo sapiens
ggtgactctacccgatcctaacggtctgttacctctcgccccttcaagtatgtcatccgtcaaattactagcctccattgtcgcatcagtgtggataggtgcgtggcggcgattgtgataacatccggcggtttccaggcctgccccgaggtggttgcctaataacgtgcagatccgtgtcataactcgttgatttgtcgtaatgtcgtttgtcatgtgcacctgttgcctgtgcagcatgctgagacttacgttctgtccc

SEQ ID NO: 671347 - DNA, 215 bp, Homo sapiens
tctcaggatcccccgtgtcatctgttgcggtatactgtttgcggttgctggcaccatatgaccaatccctggccttagtctagcttcatctcccttgcgtttattgctatggttcttcaccgcttttcccgttcggctgtggcttggctacccgttgtgagctgcattgcttcctgcttaatgcttgtccctttcgatcgtcgtgatttccaggg

SEQ ID NO: 671348 - DNA, 107 bp, Homo sapiens
gctagattttaatatccttgaagccctgggcaagtgcacacgtctttttaaaagaaacatggtttacttgcacacaaactgatcagttttgatgagatctgttaatt

SEQ ID NO: 671349 - DNA, 344 bp, Homo sapiens
  misc_feature (9)..(9): n is a, c, g, or t
  misc_feature (182)..(182): n is a, c, g, or t
gagacagantcctcactctgttgcaaaggctggaagtgcaatggcgtgaatcttggttcactgcaacctccacctccctggattcaagcaattgtcgtgcctcagcctcctgagtagctgggattataggcacgcaccaccgtgcccagctaatttttgtatttttagtaaagatggtgttncactacgttggccaggctggtctcgaactcctgacctcacgtgattggctgccttggcctcccaaagtgctgggattacaggcgtgagccactgtgcccagaccagaactattttcaatttaaacttcctgaagtcttggtactcatggatttaaaaaaaaa

SEQ ID NO: 671350 - DNA, 398 bp, Homo sapiens
cgctgtgaaatttggggtctcaaggaaaataataattgccagtacttgccaatatcagaaaaacggcgaaagacagaattatttatttatttagagaaagagtcttgctatagacgcccaggctagcagtgcagtggcgtgatctcagctcacagcaacctccgcctcctgagttcaagcgattctcctgcctcagcctcctcgagtagctgggattacaggtagccgacaccacgcccggctaatttttatatttttagtagagacagggtttcacccatgttggccaagctggtcttgaatgcctgacctcaagtgaacatgccgcctcgggctcccaaagtgttgggattacaggcgtgagccaccgtgcccggcctagaaagccagaatttaaa

SEQ ID NO: 671351 - DNA, 361 bp, Homo sapiens
cggtaggcggaggcctagtgcgtcacccacgtagaagttggtcagtaagagattctcttgtgcacagctgacatctatatatatgtggtgcaaagagatctctcagaagctgtccagatggaccttctctatatggcaacagcgcggctgtatctttggccacagcccatccatcgggcacagccattgaagggtagtatggccggcctgggccactccgaaatctctgtcagttctctctcagcctccatgttttaccgcagggtctggtgggaatgacccctcctcttccccacctcccaaggttctctacacccgccggcatgggtccgcgttaagagagcctcccgtatcagggtct

SEQ ID NO: 671352 - DNA, 158 bp, Homo sapiens
ttttttttttgggggcggggggaaaaaaggccctcccaacctaaatggggccccggccttttttgccccattaaaaacttttttggaagaaaaagggggccccccctggggggttttttttttcccccccccccccccttttttggaaaaaattttta

SEQ ID NO: 671353 - DNA, 287 bp, Homo sapiens
  misc_feature (48)..(48): n is a, c, g, or t
  misc_feature (89)..(89): n is a, c, g, or t
  misc_feature (130)..(130): n is a, c, g, or t
  misc_feature (183)..(183): n is a, c, g, or t
  misc_feature (210)..(210): n is a, c, g, or t
  misc_feature (252)..(252): n is a, c, g, or t
  misc_feature (260)..(260): n is a, c, g, or t
ttttttattttttgagacagagtcttatccagcctgggaaacagagtnagaccctgtctcagtaaataaatatataaatacgataaatntagatatgaaagcagactacagtataaaacactgctcaganacattttgcgaccgggcgcagtggctcaggcctgtatcccagcactttgggangccgaggcagcgaatcacctgaggtcnggagttcgaggggctgaccaacatggtgaaaccctgtctgtnacttaagnatggcaaaattgggctggggcatgggt

SEQ ID NO: 671354 - DNA, 1497 bp, Homo sapiens
  misc_feature (220)..(220): n is a, c, g, or t
  misc_feature (398)..(398): n is a, c, g, or t
gatcgtctgtagagctctcgtctttctgcggatctcggtgccctctccttttcgttacctggaaacatggcctccgcgtgtgcctgtctctgagtggtgtcatcaaggggtgcttcaagcgactagtgaagcgatgccggtaaagtacatatcatagcgtccatgtagtgaggctagataggaaggccgtcataggaacaggcaggtggctctttcttgnctactgtacgttgacgggacagaggaacacgaaatcactcccattcacgtggtggatgtgtattgggccacaaggaaggagttccttggaggtaagagcgtccagagtttgttgcgaggcactaagtaaccgtagtttgctggaagcaagtaagcgcacactattgaccaggcgctanacgcaatttttttggttccacatggaagtttgggctttggaacccaaggaattcactacgggggaaccattgtggtcaaccagggcaatatatttggttctggccaccttttccgtttaaccttgttaacattgggtggccaaaacgcccccttaaccttgcaacggtaaagccccacaagggtggacaatggcaccgcgccaaaatggataagatgtaacagcgtgacattctcgtgtgagatgaatttcttacttaactttcgcatgtggtaggcacacccctgcgggaaatgaggttccttttgtcggcagccacccagttattatacggaaaggccaaaaaacacaagtggtaggttattatactttaggacgagcaaagaggcggttctccaaaaaggggctgaaaattctgggccccttagggttccaaccaccgagaacaacacggagaatagagcgccgttatagaatccaaaggttggggccaattgtccgaaaatattggccgacggtttggaattaagttttcgggaccaaatgagagggactttacgcattaattccttagggggcattaaagtcccgggaaatgtgcgagaaccgagccggttcccacacacaatgtgtgtgagagccaccgggtgctgtataaggccaatacaacagcccttgggatggacccaaagagtaaaggaaaaaaatagcgccatttgggtggagtgtggcggcacggccctaactggggtttaagagccccactggcatttcccgagaagattcatgtttaccaccatcctgttggaggagaaaaggggagggtccaactttaaggggccccattattaatctcggctttgggacagggtactcacgccgcactttattcctctttgggggtcggccagcagcctccttttcagaacttctgtgtgcgggagaactatggccttaattcttgccatctttttgggtgtaccgaacatagggggggcaacacgccacccagaagaagagaaggacgaaccttctttgggcacgcacgccctctttatttaggtgtgagaagctggagaaagagttttatttttgagacc

SEQ ID NO: 671355 - DNA, 535 bp, Homo sapiens
  misc_feature (385)..(385): n is a, c, g, or t
  misc_feature (391)..(391): n is a, c, g, or t
  misc_feature (424)..(424): n is a, c, g, or t
  misc_feature (429)..(429): n is a, c, g, or t
  misc_feature (443)..(443): n is a, c, g, or t
  misc_feature (453)..(453): n is a, c, g, or t
  misc_feature (490)..(490): n is a, c, g, or t
  misc_feature (525)..(525): n is a, c, g, or t
  misc_feature (532)..(532): n is a, c, g, or t
agggtcttactcccactgtgaaaccttccccagttattctcaccccttcttctcactcctcatgagctttatcttggcagtcttacggctcttatgcctagcaaatctccagcctaattttatatatttttttgagaaagggtcttgctctgtcacccaggctagagtgcggtggtgtgatcttggctcactgcaacctccccctcctgggttcaagcgattctcctccttcagactctcgaatagctgggattacaggcacgcctcaccacgcccagctaatttctgtatttttagaagagatggggtttcgccatcttggccagggctggtcttcaaacacctgacctcaagtgatccgcctgccttgggccccccaaagtgntggggnttacagggagtgagccactgtggcccaggcttncaacntaatttggagtttnatttgtattnttttttcatcacctttacagtgttaacagctgttttnaacattaaattccattataaattataatacatttnaaggacntgt

SEQ ID NO: 671356 - DNA, 248 bp, Homo sapiens
tctaaggatccagtgttcttcagacacagcaaaattttaagggtcgcctggtaactcaactcgtttgaagactggaaggcaagagagagatgaacaaggaagcagaagaagaagcagaaggagatagaggaagaaaagaaggcgtatgctgaagcacggagaaatatggtagtagattgatgactcccccgaagatgtataagacaatctctccagaatatcttacaccgggaaaacagggaaataat

SEQ ID NO: 671357 - DNA, 186 bp, Homo sapiens
aatggtgtacctaaatggctgtgatcgtacactgcactctagcctggacaacagagcaagatcctctctcttaaaaccaccaacaatgacaacaacaaaacaacatttttatttctcaatgtaagctccatcaaggtcaagatacttttgtaagctgtgacaccagccattagtccacctcaactg

SEQ ID NO: 671358 - DNA, 312 bp, Homo sapiens
cgcaatgtcaaaacctggagggagaatcgtttacctgtgtacagaacaaggcagaagaaccatggtagctggactcttatagttctcctgtataaacaagaatgaaaaacagtataatcaatcggatcaacatgcaaagagtgatgattgaaatgtaataacaatgtggtctttaattataatgtgaggagttgaatggaatagaggaccaattatctattcaatagagtagtataaaatgtcaagcttcgaagaggaagagaatttaagtctcataaaaagaagaaagtgatgaggagtgagacatacact

SEQ ID NO: 671359 - DNA, 1234 bp, Homo sapiens
cgcagcccttgaccctgtgccccggactggagctgcctggcctgcacggcacctggcctctgtgcctgtatgcctcacctgtgctctggcaagatgtctggtgaatggacgggctgcacagcgcaatgtgggcagcgctgaaggagaagctggtgtgccacaggattcggaccccacggaggccaagcctggagatgcgctggaccctgagctgtgcatcctggctgctccagatgccctctgtggtcaactactccgtgcctgctgcaagctgccttggagggcagcagacgtgcggctggatggttgcagttcctggagcagagacggcagttgcacagtatctaccgacgccgctgcttgcagggtcaccctgccgtcagacttgctgtagcgcgccggtcaatgaactcagctggcaagggacaatcggagtaccatcctacagcaaccagtggctactgtgcgcacagactcatcccaagggcccttgggaaaacattccgaacgtgactggtgacaagaacagcagggatgtaagaagcctacttggcgtgcaccttgtgacatcgtaactctcaccgagtggccaacagattgcatgaacccactgggaacagaccccattggaccaaacttacaacaggaccgggtgatgcaggcacaagacaagtacccggcacatacaagaacttaggatacaatggcaaacagaaagctcctcccggcggccaaggcgaacaacacagtgaccccaatagcgttggggtaccagacccacttggaataaaagccggtgaattccaaaaggcaccggaacgatcacattagggaggcccacccagggaaggaaaccactgaaagacaggatggacagaaaaaccacagagaatggcagggaagaccgtcaagataaaactacagggggaaatgcgaggataggatagggaacaggggacccatacgggagagccaaaccaattgacgaagggaaagacagagtccaccccaccaaagagtgaaacaagggagatacccgatgtcaccaagggacaatcgcacacacaacaacagtggaaacacaaagaggggcacaaggggccccaagacatatgaaccaaaagggggcaaaccccacgagcaacacgacacacaaaaagaacaagaaacccaacacaagaagtagaacgaggaagtgaggggaagacccaaggaaagaaaaaccacacaaggg

SEQ ID NO: 671360 - DNA, 343 bp, Homo sapiens
tgagacagagtcctgctctgattcccagggtggagtgcagtggcttgatcttgactcactgcaacctccgcctcccaggttcaagcaattatcctgcctcagcctcctgagtagctgggattacaggcatgcaccaccatgttcggctaatttttgtatttttagtagagacaagggttcaccatgttggccaggctggtctcgaactcctgacctcaggtgatccgcccgcctcggcctcccaaagtgctgggattacaggcgtgtgccaccatgcccagcctctcagtgaatttttcttggttaagcacctatgtcgacgcggccgcgaatttagttagta

SEQ ID NO: 671361 - DNA, 518 bp, Homo sapiens
gaagcgaggtgactgacaaggccctgtggagcgtccctggcagaggactccggccagcctgagtgacgcaatccaaagaggcgctcccgggtaggaaatggccccggtggaatgccttgccagagcagcgcatagcaggctcccgagaaggattaacactggctgaacaccgggaaggaactggcacttgaagtccagacatctgaagcttgtcaagactagtcttgggaacttgccccactccatgtgagtggaagcatggcctgatcacccacggtgtgcctgtatggacatctttgttctggtttggactgggcttgacttggtaagactagtcttgggaacttgccccactccacgtgagtggaagcgtggcctgatcacccacggtgtgcctgtatgggcactttggttctggtttggactgggcttgactaggtacgactagtctttggaacttgtcccagtccatctgagtggaaacgtggcctgatcacccacagcaatgcctgcatggg

SEQ ID NO: 671362 - DNA, 716 bp, Homo sapiens
atgaatggcactagttatccagcttatacgaagctacttaaagtcgagaatgcgtcccaaggctctgggctccaaagaaataccaaagggagctgaaaattgcttggaaggccttatatttgtacatcacaggcgtgcgtggagtctattgaacgagatgaggccaagtctctaattgaacgttcaatgggggaaaagtaacaggcaaatgtcagcgagaaaacaaattatcttgtcatgggtcgtgactagtggcacagtccaagagtgataaggccgctagccttggggacaaaaattacttgatgaagatggcctgcttgaatctgattcggacgtatgccaggcaacaaagtccaagtagtgaaactagcagttgaaactgagactgaagaaagagtccaaactggagagaacagcccataaaaaatgtccaaggaaacaagaaagaaattagtccatctaaacaaggaatcagaatctaaaaagagcaggccgacttccaaacatgggacagttttggcaaagacaataaacgaaggacagcagatgtgttctggaaaagcctggtacttccaggagcaggtgggctgagggagacaagtggtgacagcaggctaggaatctggctgactgacagcggtgaaaacaagtggacattgcccgggtggtaaaaatagcaactcgttcaagacctatggaagcacgtgccgagg

SEQ ID NO: 671363 - DNA, 409 bp, Homo sapiens
gaaatcactcttcgtcacggctgagagcagttgcccaggcacatcatcacgcaaggtgcaccctgactttctgactggcacagaggcacatgttggctgtgaatgtgaccaatagaaagaagcccgtatttctcagtcagtcctagcaccccggtaagtaattaacagagaataaaaatgtgtttgttacatgacaaagcagcagtttatcaattgtaaggtctgcttgagagcctttgatgtgcgttacttttcctgacttatcctttctttaaaattgtagatggtctcacctggtgagtgcggcttacagggtatgcccacaatgtacatttctcggcatctgtgcctcagtatcctcatttataaaatccctatgatctctgtctcacctactttacagggttgc

SEQ ID NO: 671364 - DNA, 244 bp, Homo sapiens
  misc_feature (148)..(148): n is a, c, g, or t
  misc_feature (243)..(243): n is a, c, g, or t
gctgagtcggtcaatagtccaatttgtctattttttgttgtgcccctatgaaaatatcttgaggtctatctaaaatatatttgcctattcttctgaagtgttcccctatgttttcctgcagtagttttataagtttggggtcttatangttaagtatttacattcattttgagtttatttttgtatatggtgagagatacagtctagtttcattcttcactatatggataaccagtttttccnc

SEQ ID NO: 671365 - DNA, 859 bp, Homo sapiens
  misc_feature (296)..(296): n is a, c, g, or t
  misc_feature (322)..(322): n is a, c, g, or t
  misc_feature (430)..(430): n is a, c, g, or t
tatcttgcactggcctcaggggccgactggctgttcataccccggaggctccacccgaggactggctggtgagaacttcatgtgtgagaggctgggtgagactcggagcctgtgggtccctgactgaacatcatcatcatcgctgagggtgccatttgacctgcaacgggaagcccatctcgtccagctacgtgaagtgacctggtggttcagaggctgggcttcgacacccgtgtaactgtgctgggccacgtgcagctggggagggacgccctctgccttcgaccgtgatcctngagcagcaatgatgggcatggaggcnggtgatgtgctgctgctggaagccacgcctgacactgccggcctgcgttggtcacccctctcgtgggaaccagtcagtgcggctgcacccatcatggagtgcgtgcangatgaccaaggaagtgcaagaaagccatggatgacaagaggtttgacgaggccacccagctccgtggctgggagcttcgagaacaactggaacatttacaagctcctcgcccaccagaagccccccaatggagaagtctaacttctccctggccatcctgaatgtgggggccccggcggctggcatgaatgcaggccagtgcagctcggcggtgcggaccggcatctcacatggacacacagtactacgatggtgcacgactggcttcagaaggcctagcccaagggtcaggtgcaagaagtagctggcacgacgtggccggctggttagggacgtgctggctcatgatggagaccaagaggacctgccaggccagctgatccatgtggagaaatccgcttatggatcacgccctgctgcggcgagcac

SEQ ID NO: 671366 - DNA, 439 bp, Homo sapiens
ctcagatcactcagaaaaactctggtattggccgggtgcggtggctcacgcctgtaatcccagcacttagggaggccgaggcgggcggatcacaagttcaggagattgaggccatcctggctaacatggtgaaaccccgtctctaccaaaaatacaaaaattagctgggcatggtggcacatgcctgtaatcccagctactcaggaggctgaggcaggagaatcgcttgaacccaggaggtggaggttgcagtgagtcaagatcgcggcactgcactccagcctggtagacagacccagacactgtcaaaaaaaaaaaaaaggaaaaaaaattcccatttccccttccccctctttcttttttattccaaaatgatcgtgtactttattgggccccataatattatccggaagggtcctgtggcccaaaacacacaaaa

SEQ ID NO: 671367 - DNA, 413 bp, Homo sapiens
  misc_feature (27)..(27): n is a, c, g, or t
  misc_feature (61)..(61): n is a, c, g, or t
  misc_feature (116)..(116): n is a, c, g, or t
  misc_feature (121)..(121): n is a, c, g, or t
  misc_feature (142)..(142): n is a, c, g, or t
  misc_feature (171)..(171): n is a, c, g, or t
  misc_feature (226)..(226): n is a, c, g, or t
ttgtggagggccttgaaagccaaggantgcctaacattgcctggcctttggaaaggaaggnaggaaggggcccaccaagcccaaggaattccaaggtctggaaaaggttaggaccngcccntcctctttaggtaaaggaatngaattaatatatttgcacagttcggttgncccaaggtttaaattccctttcccaaatggcctccgaaatgaacctgtcctgctncatttgcattaagaagatgtgtttctgtttctcacagaagctattgacctaatctacgctgctccactaaattgacttggatcttgacgttcataatgttgagtgactgcagaacttaatttagccacaagatggagacttcatcctagtcctggaaaacatctcagcacctggggtttctgtgtaa

SEQ ID NO: 671368 - DNA, 175 bp, Homo sapiens
ttcccgtctctgaggaacacctgccatcaatggctatacatatccaaaccaatctaaacgctattaacctataaaggtagtagagtaaaggtaaaagtaacataattgaaagtacacttaaagaacactagagataccgtaacactactagatctactggcaagtgtactcagta

SEQ ID NO: 671369 - DNA, 258 bp, Homo sapiens
  misc_feature (2)..(2): n is a, c, g, or t
  misc_feature (142)..(142): n is a, c, g, or t
  misc_feature (201)..(201): n is a, c, g, or t
gngggttgagggcggtggctcaggttcctggaaaggacggtccacccttccgcgctgggggtgtggacgcggaattcagcggagaaacgcgattgagaaatggaaaagaaaatgaaataaataagcagttatgagggagagntaagagaattatgggaaaatcaggtgattgttccagaagtgaattgcagggagaagagnttgctgagtggagtgagggcggtctcctgaaggagggagtaaagcaagaggagtttg

SEQ ID NO: 671370 - DNA, 816 bp, Homo sapiens
ggtggactggaacggggcggaggtaaccagaagcggctagtggcggctgcctgcgtccccaaccccctccgcgcagcgctcgcgactacgcgtgtccatggagtggtgagcgagcggtcggggccagctgactgttctgatgcctgggcgcagctgccatctgctctgggaaggcaccagggtgtccccgctcgacccatcagctcgaagtcagacaccatggaggcgcatgcacaaggttcgttggagactgaaccgtctgcgaaggaacagactgaagatgcagtagccagtgctgacttctctagcgatgctctctggaggaggaaaaggacatgagttagaagcagagttagttcaagcgtagaaggactgaaattgcacgagacgacgtagtgacaagtggtggtcaggggaaaggaccgggcatctagtgggagataaatagcgagtagagtcgaggttgaacctgatgagtgagacttaaataccagaaccttcagacgactcagcgtgggcgatggagcatttgcagaaatctaccaacttgctcgtaccaaggaaaaatccaccattgaaagccgcttgtagtcagcgcaagggcaggacagggaccaccgtgtcagtctttttgcacgacaatagatttgggcatagaccgggtactcattccaaggccactagcaaagggtacggggaagaaatcgattgcacgaaacgaaaacatggtaaaggccgggtttaccgagaagccgcgtaaaagttgggagcggcgaggtctgttgaagtggcacggatccccttcaagcttcctca

SEQ ID NO: 671371 - DNA, 1435 bp, Homo sapiens
gacgaaaggtgagagtggtagagggcgtgtatgtcgtactgcagcgagccgtctagtcccgcatcccacctagatcgatgaaagataggcactactacgagtatgtctgtgataatgggccacaaagtgtagagctgtgtagaagagagtgtgatgactggtgagtgaatgctcaagattgtatgtgatcgatctgcctaccacaattatttgtctcatgcaatcgtcgtctgtgcgtgagtcacaccaggttgggttcatcattctcgtattattggtccaacaaagaagtttgagatgagttggtcgacaagtgttgaaggtgagtgacaattgtctagattcataggtcagatgtaagggtctgactgtatactactgcggttatcgagcaagttgtccgtacatttgggggagtggcctgatctacacaatagtgtgggtgatattaattattgggtgttatttagtctcacctaatttctaagggtgttgtgttcacctcggggggcacaaatatgattttgttgccagtatataggagagtgttgtctcagaagtttagctcgggtcgccagaaaatgggctttgtggtggggtgggctatattctagttgcaaatgaagtgtgctgcaaaagctcttgtgcgcgtctgtgaccaactgggagaggtggtgtgtctgtgagatactctttgtgtaagtgatatgatttgtgtagagtttccacgtatagtgggtgcgtaccactgggttgggcacatactggtaggggaagtctccactgcgcaggtctcaacaagggggttgtggccacaactgtgttgatagtttactgcggtattgcgttgcctgttcatcactcatagagctgtgctgcgattggagggtgttgccaagtgggctatatctcctgtatgggtaaaatgtgtactctttggggtgtcttggcttgtaaggtggccaccagtgagggtagaccctgtgtgtccacgctgtgttgcagagctcgcgatgcccgtcctgtgtgccgctcacacgtgctatgctagtccaatcatggctagatggatggacagaggaccacttggggaaatccttaagggggcatccagtgacaacacgttaccctgccaagaccccagacgttgggccccgttgcgtcgtgacaatggacacaagctcaggacaaactgctctagacctacttccattgggagggggtgacggaaaccagcacatgtgtggagaccagcttcaaggagcggaagagctggcttgaggcacacacagctgggtcaggggacattctgtctgcacatgtgcatccatggggggacggctcctcacccagcctgcgccactgtgttctttttttaagaggcttccagagaaaacggcaccaccaatccaataaagcaactgagccagaaata

SEQ ID NO: 671372 - DNA, 966 bp, Homo sapiens
  misc_feature (1)..(1): n is a, c, g, or t
  misc_feature (255)..(255): n is a, c, g, or t
  misc_feature (315)..(315): n is a, c, g, or t
  misc_feature (345)..(345): n is a, c, g, or t
  misc_feature (510)..(510): n is a, c, g, or t
  misc_feature (516)..(516): n is a, c, g, or t
  misc_feature (526)..(526): n is a, c, g, or t
  misc_feature (530)..(530): n is a, c, g, or t
  misc_feature (558)..(558): n is a, c, g, or t
  misc_feature (721)..(721): n is a, c, g, or t
  misc_feature (729)..(729): n is a, c, g, or t
  misc_feature (747)..(747): n is a, c, g, or t
  misc_feature (751)..(751): n is a, c, g, or t
  misc_feature (766)..(766): n is a, c, g, or t
  misc_feature (768)..(768): n is a, c, g, or t
  misc_feature (795)..(795): n is a, c, g, or t
  misc_feature (807)..(807): n is a, c, g, or t
  misc_feature (831)..(831): n is a, c, g, or t
  misc_feature (860)..(860): n is a, c, g, or t
  misc_feature (869)..(869): n is a, c, g, or t
  misc_feature (895)..(895): n is a, c, g, or t
  misc_feature (946)..(946): n is a, c, g, or t
nagcaggaaacaagcttggctgagatgcctcaggcctggtaacctgaggtgtagagcacccggatggaagggtaaaagccgggggcaaagcggtggccctccctttctgggggtcacttctgggctggggccagcggacacctgtgtccaagtggctttcagggctggccacaccctaagccttgcgaaggggcctcctgcaagggctggcccatggggtcccccccttcccagccagtgaggttagcctggttnggggtccccatgtgtgcgagtgcttgtgtgggggctcctgtctgcctgtgtgtttttgcnaagctgctcatgtcaatgtgcttgccagtnccgagttagatgttcctttgccgttgccctccagcgaagggtcatttttgggaacaagggtggctcttaacttgttagcgtgcctgtgggcctgtctgtttctggggcctgaggtggtggggggtgggtgttggggtggggctggccttcggggcatttgccggnggcggngtgggtgggngggngaggctgggcagaacaggggaaggagtnaaaaccaggcaggaaagtggaagaacaggagaagctcatgtaatggattaccctccacaggattatgttccttgattcctgagagttttttctcttgattttaccccctcagtctatcactgcgagagaaagaggtagaaaagacaaacagaccacaaaaganagaacccngacatatagacagacgcncctnttgcatgtacataancnagaacctgggagagaagagagaacgtncaaaaaagaacncagagcaggcaggcagcccacccnctgcagcagttctgggcttcactggagcncctacaggnatgtccagcagccctgtatgccactnctctggtttgtccaggtaacaggggtgcccgcccccttcatgatcagcacncggtggttggggcgctgctt

SEQ ID NO: 671373 - DNA, 499 bp, Homo sapiens
tctggggcaaggtcctcggggtggtaactgggatgcaaacaacacaaaagtagtatttttctttaccatataccaagtatgagcctgcttgatatgactttaaaaggcacagtaatgaggacacattaagagcaattctgtcatacaatctaaatcatattctcaacatggaagagggagcagaaaactggtgaaatggtttctagggccatcattactggtaatgaagacgtcagaagatccaactgtgcctgtgtaattattacatgaaatagtcactttcagactgcaatgaattccaggccattcaggtttcccaatcagtatcatatttctatcccattacaagtagattcacgtacatccatccatacatacatatacacacacacacagaaacatacccacacactcgcccctgctgtgaacaatctgtgcacaaggggtgaagagagctaacacctggagacactacagtttcctttcaactcagaggtgt

SEQ ID NO: 671374 - DNA, 693 bp, Homo sapiens
tctcaggctacaccggatgcatacaccacatgaaacatcctatcatctgtaggctcattcattctctctaacagcagtaatattaataattttcatgatttgagaagccttcgcttcgaacgcgaaaagttcctaattatctagaaccaaatccctccatataacctggcatctgactatatggatgccccctcaccctaccatctacatttcgaagcaatcccgtatacataaaatctagcatcaaataaaatggaatggaatctaaccccccaaagctggttttcaactcccatccccaatgtggccgtccactggcacttctttttcaacgagaatagaaaagatagacataaaatgatgatcatgacaaatagagatagataacctagaaaagagaacgatacatgatgaaccgtgtggcccttttttgtgtggcgcgcggtggtgcaacaacctggctttgtcaaagaggcctagtcgtcggtctctagaatggttgtgcctcctgtccactgcccctttctgttgtcaagtactccggtggcgcgctatctcatctggtcggcgcctcccacctatttcttgggaggcggtgtaccttccctctgtccatcccatggcttgagttgacctcctgcccattttatccggggcccggttccttagttttccctggcctttctgtacccc

SEQ ID NO: 671375 - DNA, 108 bp, Homo sapiens
tggtctcatacatttccaactaaaaacactgcatggctttcaggttgcgtagaatctctgccccagtgtttctttcttccctccggcatctagcctctgcaattgtct

SEQ ID NO: 671376 - DNA, 168 bp, Homo sapiens
agagtccctgtggtagcagactttgtgagttcacttgtaattttccatctgaaagcctgttcttgtttttcgtgatgcagtcttgctctgtcgcccaggctggaggttgcagtgagctgagattgtgacactgcactccagtctggtgacagagcgagaccctctcaa

SEQ ID NO: 671377 - DNA, 119 bp, Homo sapiens
ccacctcagcctcccgagtagctaggactacaggcgtgagccactgcgcccggccgagtttagatgattctaatttctagatgcactgcaagtccttgtccgtgttcagtactactacc

SEQ ID NO: 671378 - DNA, 141 bp, Homo sapiens
gttcaagggcagacggagtttttgaggaagactcacaaattgacatcgctacagtacaggatatgctgagcagccaccattataagtcattcaaagtcagcatgatccacagacttcggttcacaactgatgtgcagttag

SEQ ID NO: 671379 - DNA, 907 bp, Homo sapiens
  misc_feature (424)..(424): n is a, c, g, or t
  misc_feature (466)..(466): n is a, c, g, or t
  misc_feature (474)..(474): n is a, c, g, or t
  misc_feature (479)..(479): n is a, c, g, or t
  misc_feature (482)..(482): n is a, c, g, or t
gacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaacggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtnctctggcgctgcttcagcaccgtggtcatctttctgttcctnctggacgngcagncgngcctgctggtgctggtcccggcgggtgttggagccgccattgagctgtggaacacgtgaagcaaggcattgcacgatgacctatttttcggacgacggcctgactgcccgaacttcagtatggcacttacagcgaatctgacaggaaaaccgaggagtacgatactcaggcccatgaacgtacttgtcatacctgctgtaccctctctgtgttcggggtagctgtctatccacctcctgaaatatcccattataagaagctggtactcctggttaatcaacagcttcgtcaaccggggtctatgccttggggtatcctcttcatgctgacccaagtcttagtgaactaacaggtggacgtccgtgtggacattctgacctggaaggcttcacctaacagggcttttcaaccaccttcttggctgc

SEQ ID NO: 671380 - DNA, 563 bp, Homo sapiens
  misc_feature (424)..(424): n is a, c, g, or t
  misc_feature (466)..(466): n is a, c, g, or t
  misc_feature (474)..(474): n is a, c, g, or t
  misc_feature (479)..(479): n is a, c, g, or t
  misc_feature (482)..(482): n is a, c, g, or t
gacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaacggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtnctctggcgctgcttcagcaccgtggtcatctttctgttcctnctggacgngcagncgngcctttcttggtcttggggcccgcggggggtttggggcccccaatttagctttggaaagagtaaggaggcactttagggtg

SEQ ID NO: 671381 - DNA, 392 bp, Homo sapiens
ctgcatcaagaagcatacttttccacgctggtccttgcaatgcgcagcagtctgccatcacgccatagcatcaacgaacaggctctgccgcacatgatccgttcccttaagcgtatacagtgatttgtcacaatctccagtggctgcctccatcaggcatgagcagctggttcagtgcacagtgtcacatattccctaccctcctaagatgtacgattaggcatctccttagcaggtatgatcagcaccagacctagatctgtgtctgcttgcccatcatgtaagcatattcctatcctcattcttgtgtgactctctcctagtgacgtgcgtaaaataagctgagcttgagataaatagaatggtaactcacgtttggtactacattgcac

SEQ ID NO: 671382 - DNA, 191 bp, Homo sapiens
  misc_feature (38)..(38): n is a, c, g, or t
  misc_feature (41)..(41): n is a, c, g, or t
ttttattggaaaatgtgctgattttttgaatgttttanccnccagatttatgaatttttttcttcagcaattggtaaagtatacttttgtaaacaaaaattgaaacatttgcttttgctctctgagtgccccagaattgggaatctattcatgaatattcatatgtttatggtaataaagttatttgcaca

SEQ ID NO: 671383 - DNA, 155 bp, Homo sapiens
cagccgatggcagatgccagtgacagaccatggggaggagatgactactacacacctaatacagtgagacgggcgatggcaagacgtgccacgggctatgtttgtagactaggaccacgtcatgatgagttacgactgacctacgcgctctacac

SEQ ID NO: 671384 - DNA, 166 bp, Homo sapiens
aagcagttcaaacttgcacttcgtgttccatttccagtaagtaacacctggaacaggtcttgtatgtaacttgtgaagcatgtgctggtggtcattggtaacagtcatgtatgtcaacaattgtggcaggcatgccattgtgggtaccgaagctctgaaattacgt

SEQ ID NO: 671385 - DNA, 409 bp, Homo sapiens
tgcctttcggagggcgacttgacactagtacactgtggacgtctgggacccttcccgactagacttaggaccgtcgtttgagttggagaagaaaacgaaccccccgaacacaaattatgtccagtaacgctaccttcttcagagtctcagagagagtgtagttctcctgtctacccctgtccctaggacctcgaaaagaagaggacacaagaccaacgtatgaacttagggtcctttgtcacactgtgccacggttaaatgacggtttgtacgggccaaacagttgtctcggtctgttcctcctctcctctctaagtacggggtttgtgtccggtcgactcctcccgaagcaggaggaaggaaaccgggtctactccctcgcggaagggtcttcagtgtactccttttt

SEQ ID NO: 671386 - DNA, 1890 bp, Homo sapiens
  misc_feature (1536)..(1536): n is a, c, g, or t
  misc_feature (1542)..(1542): n is a, c, g, or t
  misc_feature (1595)..(1595): n is a, c, g, or t
  misc_feature (1598)..(1598): n is a, c, g, or t
cctggcttcggggaagtgccgccgaggcgcctgcgcactgcgcccccgcgccccctccccgactgtcgggccggaccttggagcgcgcgggccggcggcggcgcgagtggctcgggagcgcggctgacccccaggctgtggtgagggtctgagagctggtaccacggagcctgggcaacctcctccgcccacccatgcccaccccgcatgaggctgagaagcagatcacagggccagaggaggcggaccggcccccttcaatgtccagtcatgatacagcctctccagcggcccccagccgcaacccctgctgcctgtgctggtgctgctgctgtagctgctcctggaaccaagagcggcggcgcgcgtggcaggcctcccgggagagcaagctgcagcccctccccagctgtgaagtatgtgccacgccaagtcctgaggaggtgcagagctgggcgcagtcttttgacaagctgatgcacagcccagcgggacgcagcgtgttccgggcgttcctgcggacagagtacagcgaggagaacatgctcttctggttggcctgcgaggagctgaaggccgaggccaaccagcatgtggtagacgagaaggcgaggctcatctacgaggactacgtatccatcctgtcccccaaggaggtgagcctggactcccgtgtgcgggagggcatcaacaagaagatgcaggagccgtccgcacacacgttcgacgacgcgcagctgcagatctacacgctcatgcaccgggactcctacccccgcttcctcagctctcccacctaccgtgccctgctgctgcaggggccatcacagtcctcctccgaggcctaggccgcccccagcagcacagaccccgccgcctcctacggccgactctgggttcccttcaggtgttggtgtcggcagggctgtcagggcacatgcctggccggctggggtccccacccgcggagacggtcctagacccagtggggagtgctgtgtctcctgggtctgcccacccgtggccaagcaggaactccaggtgcagggcgggcctccaggtgcagggcgggccagaagccccctcatcggcccgcagctggctggcccagtgctcctggctgggggctcttgcgtggtgagagtaggggtccccccaggagccatgctggacccatgagcctcgctggggcctcctccccaggcagccaatgggccccagacaagcctttggtggggaacagaacctccgcatcgtgtagttttgtgacataaggagacctcctacttgagctgtctgtaccccagaatcaaacacagaacctcagaaccagatttaggacctcagaatcctgcactcaaggtggcaggacccaatttctgttttatatgttcatgaactttaaacctggaaacatgtccttactaggtgttttatcaaaaaaaagttttcatatttatctctatccctaaccccccaaaaataggatgtcttattattgaagatatttttaaagcaaaaaaaaaaaaaaaaaanaaaaanaaaaaaaaaaaaaaaaaaaaaaaaaaaaaaaaaaaaaaaaaaaaaaaaaaaanaanaaaaaaaaaaaaaaaaaaaaaaaaaaaagcagggaggaggcgcgaccacagacgcacccggacggggcacacactcaagacaacaacagcaaaagagacagaggggcgaccaacagcagagagcgcgcgcaccagcaccccgcgcgcgaggcgccgaccccgccaacacacacagagcggaagggaggagcgcaaccccaacagccacagaaccggacccgccgagaggcacccacaaacgccagccgcggcggaaggaaacaccaaagccgagaacacacacacggaaaga

SEQ ID NO: 671387 - DNA, 2275 bp, Homo sapiens
  misc_feature (1921)..(1921): n is a, c, g, or t
  misc_feature (1927)..(1927): n is a, c, g, or t
  misc_feature (1980)..(1980): n is a, c, g, or t
  misc_feature (1983)..(1983): n is a, c, g, or t
cagcggccctgcccctcccggcccgggcccggggaccgtgctgggcgggagcttcgggagccggcgcacgggactcgaaccccaagggctcccgccgccaggtccacgtggaccctgggccgcagtggaagtggagcccgccccccgctcgtgggggagggggcgccgcagccgggttcccctttttctggagctcaaagcctggggaagtgattgctcaaaggtgggggccggaagaacccaggtttccgcgtctccctccccctctcagcccggtgaggaggggccggggcgggacaccctgtccgcccccgcccccaccccgctggatctggcagccactcagcccttcgagctgtaggggaggcgctgcgcccccggccccagccgatcgggggctcctggcgctagcctccctccagagcgccgcaggagtccctcctgccgtctgacttgagtccctgctgctgcagtgcacgccccttcggcagccagggtggggcccagacccaacctggcccctcctgcccccaccccgcctttgggtcgctgacccccaggctgtggtgagggtctgagagctggtaccacggagcctgggcaacctcctccgcccacccatgcccaccccgcatgaggctgagaagcagatcacagggccagaggaggcggaccggcccccttcaatgtccagtcatgatacagcctctccagcggcccccagccgcaacccctgctgcctgtgctggtgctgctgctgtagctgctcctggaaccaagagcggcggcgcgcgtggcaggcctcccgggagagcaagctgcagcccctccccagctgtgaagtatgtgccacgccaagtcctgaggaggtgcagagctgggcgcagtcttttgacaagctgatgcacagcccagcgggacgcagcgtgttccgggcgttcctgcggacagagtacagcgaggagaacatgctcttctggttggcctgcgaggagctgaaggccgaggccaaccagcatgtggtagacgagaaggcgaggctcatctacgaggactacgtatccatcctgtcccccaaggaggtgagcctggactcccgtgtgcgggagggcatcaacaagaagatgcaggagccgtccgcacacacgttcgacgacgcgcagctgcagatctacacgctcatgcaccgggactcctacccccgcttcctcagctctcccacctaccgtgccctgctgctgcaggggccatcacagtcctcctccgaggcctaggccgcccccagcagcacagaccccgccgcctcctacggccgactctgggttcccttcaggtgttggtgtcggcagggctgtcagggcacatgcctggccggctggggtccccacccgcggagacggtcctagacccagtggggagtgctgtgtctcctgggtctgcccacccgtggccaagcaggaactccaggtgcagggcgggcctccaggtgcagggcgggccagaagccccctcatcggcccgcagctggctggcccagtgctcctggctgggggctcttgcgtggtgagagtaggggtccccccaggagccatgctggacccatgagcctcgctggggcctcctccccaggcagccaatgggccccagacaagcctttggtggggaacagaacctccgcatcgtgtagttttgtgacataaggagacctcctacttgagctgtctgtaccccagaatcaaacacagaacctcagaaccagatttaggacctcagaatcctgcactcaaggtggcaggacccaatttctgttttatatgttcatgaactttaaacctggaaacatgtccttactaggtgttttatcaaaaaaaagttttttattattgaagatatttttaaagcaaaaaaaaaaaaaaaaaanaaaaanaaaaaaaaaaaaaaaaaaaaaaaaaaaaaaaaaaaaaaaaaaaaaaaaaaaanaanaaaaaaaaaaaaaaaaaaaaaaaaaaaagcagggaggaggcgcgaccacagacgcacccggacggggcacacactcaagacaacaacagcaaaagagacagaggggcgaccaacagcagagagcgcgcgcaccagcaccccgcgcgcgaggcgccgaccccgccaacacacacagagcggaagggaggagcgcaaccccaacagccacagaaccggacccgccgagaggcacccacaaacgccagccgcggcggaaggaaacaccaaagccgagaacacacacacggaaaga

SEQ ID NO: 671388 - DNA, 84 bp, Homo sapiens
aaggtaaggcagcaggcgcgcaaattgacagcctatataactcttatatatcttactgagagagcgagtgtctagttcggagac

SEQ ID NO: 671389 - DNA, 534 bp, Homo sapiens
  misc_feature (180)..(180): n is a, c, g, or t
  misc_feature (186)..(186): n is a, c, g, or t
  misc_feature (239)..(239): n is a, c, g, or t
  misc_feature (242)..(242): n is a, c, g, or t
tagcggccgcctactactactactgctcgaattcaagcttctaacgatgtacgggggacatgtccttactaggtgttttatcaaaaaaaagttttcatatttatctctatccctaaccccccaaaaataggatgtcttattattgaagatatttttaaagcaaaaaaaaaaaaaaaaaanaaaaanaaaaaaaaaaaaaaaaaaaaaaaaaaaaaaaaaaaaaaaaaaaaaaaaaaaanaanaaaaaaaaaaaaaaaaaaaaaaaaaaaagcagggaggaggcgcgaccacagacgcacccggacggggcacacactcaagacaacaacagcaaaagagacagaggggcgaccaacagcagagagcgcgcgcaccagcaccccgcgcgcgaggcgccgaccccgccaacacacacagagcggaagggaggagcgcaaccccaacagccacagaaccggacccgccgagaggcacccacaaacgccagccgcggcggaaggaaacaccaaagccgagaacacacacacggaaaga

SEQ ID NO: 671390 - DNA, 2316 bp, Homo sapiens
  misc_feature (1962)..(1962): n is a, c, g, or t
  misc_feature (1968)..(1968): n is a, c, g, or t
  misc_feature (2021)..(2021): n is a, c, g, or t
  misc_feature (2024)..(2024): n is a, c, g, or t
cagcggccctgcccctcccggcccgggcccggggaccgtgctgggcgggagcttcgggagccggcgcacgggactcgaaccccaagggctcccgccgccaggtccacgtggaccctgggccgcagtggaagtggagcccgccccccgctcgtgggggagggggcgccgcagccgggttcccctttttctggagctcaaagcctggggaagtgattgctcaaaggtgggggccggaagaacccaggtttccgcgtctccctccccctctcagcccggtgaggaggggccggggcgggacaccctgtccgcccccgcccccaccccgctggatctggcagccactcagcccttcgagctgtaggggaggcgctgcgcccccggccccagccgatcgggggctcctggcgctagcctccctccagagcgccgcaggagtccctcctgccgtctgacttgagtccctgctgctgcagtgcacgccccttcggcagccagggtggggcccagacccaacctggcccctcctgcccccaccccgcctttgggtcgctgacccccaggctgtggtgagggtctgagagctggtaccacggagcctgggcaacctcctccgcccacccatgcccaccccgcatgaggctgagaagcagatcacagggccagaggaggcggaccggcccccttcaatgtccagtcatgatacagcctctccagcggcccccagccgcaacccctgctgcctgtgctggtgctgctgctgtagctgctcctggaaccaagagcggcggcgcgcgtggcaggcctcccgggagagcaagctgcagcccctccccagctgtgaagtatgtgccacgccaagtcctgaggaggtgcagagctgggcgcagtcttttgacaagctgatgcacagcccagcgggacgcagcgtgttccgggcgttcctgcggacagagtacagcgaggagaacatgctcttctggttggcctgcgaggagctgaaggccgaggccaaccagcatgtggtagacgagaaggcgaggctcatctacgaggactacgtatccatcctgtcccccaaggaggtgagcctggactcccgtgtgcgggagggcatcaacaagaagatgcaggagccgtccgcacacacgttcgacgacgcgcagctgcagatctacacgctcatgcaccgggactcctacccccgcttcctcagctctcccacctaccgtgccctgctgctgcaggggccatcacagtcctcctccgaggcctaggccgcccccagcagcacagaccccgccgcctcctacggccgactctgggttcccttcaggtgttggtgtcggcagggctgtcagggcacatgcctggccggctggggtccccacccgcggagacggtcctagacccagtggggagtgctgtgtctcctgggtctgcccacccgtggccaagcaggaactccaggtgcagggcgggcctccaggtgcagggcgggccagaagccccctcatcggcccgcagctggctggcccagtgctcctggctgggggctcttgcgtggtgagagtaggggtccccccaggagccatgctggacccatgagcctcgctggggcctcctccccaggcagccaatgggccccagacaagcctttggtggggaacagaacctccgcatcgtgtagttttgtgacataaggagacctcctacttgagctgtctgtaccccagaatcaaacacagaacctcagaaccagatttaggacctcagaatcctgcactcaaggtggcaggacccaatttctgttttatatgttcatgaactttaaacctggaaacatgtccttactaggtgttttatcaaaaaaaagttttcatatttatctctatccctaaccccccaaaaataggatgtcttattattgaagatatttttaaagcaaaaaaaaaaaaaaaaaanaaaaanaaaaaaaaaaaaaaaaaaaaaaaaaaaaaaaaaaaaaaaaaaaaaaaaaaaanaanaaaaaaaaaaaaaaaaaaaaaaaaaaaagcagggaggaggcgcgaccacagacgcacccggacggggcacacactcaagacaacaacagcaaaagagacagaggggcgaccaacagcagagagcgcgcgcaccagcaccccgcgcgcgaggcgccgaccccgccaacacacacagagcggaagggaggagcgcaaccccaacagccacagaaccggacccgccgagaggcacccacaaacgccagccgcggcggaaggaaacaccaaagccgagaacacacacacggaaaga

SEQ ID NO: 671391 - DNA, 2215 bp, Homo sapiens
  misc_feature (1861)..(1861): n is a, c, g, or t
  misc_feature (1867)..(1867): n is a, c, g, or t
  misc_feature (1920)..(1920): n is a, c, g, or t
  misc_feature (1923)..(1923): n is a, c, g, or t
cagcggccctgcccctcccggcccgggcccggggaccgtgctgggcgggagcttcgggagccggcgcacgggactcgaaccccaagggctcccgccgccaggtccacgtggaccctgggccgcagtggaagtggagcccgccccccgctcgtgggggagggggcgccgcagccgggttcccctttttctggagctcaaagcctggggaagtgattgctcaaaggtgggggccggaagaacccaggtttccgcgtctccctccccctctcagcccggtgaggaggggccggggcgggacaccctgtccgcccccgcccccaccccgctggatctggcagccactcagcccttcgagctgtaggggaggcgctgcgcccccggccccagccgatcgggggctcctggcgctagcctccctccagagcgccgcaggagtccctcctgccgtctgacttgagtccctgctgctgcagtgcacgccccttcggcagccagggtggggcccagacccaacctggcccctcctgcccccaccccgcctttgggtcgatcacagggccagaggaggcggaccggcccccttcaatgtccagtcatgatacagcctctccagcggcccccagccgcaacccctgctgcctgtgctggtgctgctgctgtagctgctcctggaaccaagagcggcggcgcgcgtggcaggcctcccgggagagcaagctgcagcccctccccagctgtgaagtatgtgccacgccaagtcctgaggaggtgcagagctgggcgcagtcttttgacaagctgatgcacagcccagcgggacgcagcgtgttccgggcgttcctgcggacagagtacagcgaggagaacatgctcttctggttggcctgcgaggagctgaaggccgaggccaaccagcatgtggtagacgagaaggcgaggctcatctacgaggactacgtatccatcctgtcccccaaggaggtgagcctggactcccgtgtgcgggagggcatcaacaagaagatgcaggagccgtccgcacacacgttcgacgacgcgcagctgcagatctacacgctcatgcaccgggactcctacccccgcttcctcagctctcccacctaccgtgccctgctgctgcaggggccatcacagtcctcctccgaggcctaggccgcccccagcagcacagaccccgccgcctcctacggccgactctgggttcccttcaggtgttggtgtcggcagggctgtcagggcacatgcctggccggctggggtccccacccgcggagacggtcctagacccagtggggagtgctgtgtctcctgggtctgcccacccgtggccaagcaggaactccaggtgcagggcgggcctccaggtgcagggcgggccagaagccccctcatcggcccgcagctggctggcccagtgctcctggctgggggctcttgcgtggtgagagtaggggtccccccaggagccatgctggacccatgagcctcgctggggcctcctccccaggcagccaatgggccccagacaagcctttggtggggaacagaacctccgcatcgtgtagttttgtgacataaggagacctcctacttgagctgtctgtaccccagaatcaaacacagaacctcagaaccagatttaggacctcagaatcctgcactcaaggtggcaggacccaatttctgttttatatgttcatgaactttaaacctggaaacatgtccttactaggtgttttatcaaaaaaaagttttcatatttatctctatccctaaccccccaaaaataggatgtcttattattgaagatatttttaaagcaaaaaaaaaaaaaaaaaanaaaaanaaaaaaaaaaaaaaaaaaaaaaaaaaaaaaaaaaaaaaaaaaaaaaaaaaaanaanaaaaaaaaaaaaaaaaaaaaaaaaaaaagcagggaggaggcgcgaccacagacgcacccggacggggcacacactcaagacaacaacagcaaaagagacagaggggcgaccaacagcagagagcgcgcgcaccagcaccccgcgcgcgaggcgccgaccccgccaacacacacagagcggaagggaggagcgcaaccccaacagccacagaaccggacccgccgagaggcacccacaaacgccagccgcggcggaaggaaacaccaaagccgagaacacacacacggaaaga

SEQ ID NO: 671392 - DNA, 128 bp, Homo sapiens
gctccaggtggtcaccagcagctgtgtcttctgagcttactttccttgtgttaacatcattcttaaggacgtgagaactccagatgattacctttccatttagcaacattggcacctgggaggcatca

SEQ ID NO: 671393 - DNA, 2230 bp, Homo sapiens
  misc_feature (1876)..(1876): n is a, c, g, or t
  misc_feature (1882)..(1882): n is a, c, g, or t
  misc_feature (1935)..(1935): n is a, c, g, or t
  misc_feature (1938)..(1938): n is a, c, g, or t
cagcggccctgcccctcccggcccgggcccggggaccgtgctgggcgggagcttcgggagccggcgcacgggactcgaaccccaagggctcccgccgccaggtccacgtggaccctgggccgcagtggaagtggagcccgccccccgctcgtgggggagggggcgccgcagccgggttcccctttttctggagctcaaagcctggggaagtgattgctcaaaggtgggggccggaagaacccaggtttccgcgtctccctccccctctcagcccggtgaggaggggccggggcgggacaccctgtccgcccccgcccccaccccgctggatctggcagccactcagcccttcgagctgtaggggaggcgctgcgcccccggccccagccgatcgggggctcctggcgctagcctccctccagagcgccgcaggagtccctcctgccgtctgacttgagtccctgctgctgcagtgcacgccccttcggcagccagggtggggcccagacccaacctggcccctcctgcccccaccccgcctttgggtcgctgacccccaggctgtggtgagggtctgagagctggtaccacggagcctgggcaacctcctccgcccacccatgcccaccccgcatgaggctgagaagcagatcacagggccagaggaggcggaccggcccccttcaatgtccagtcatgatacagcctctccagcggcccccagccgcaacccctgctgcctgtgctggtgctgctgctgtagctgctcctggaaccaagagcggcggcgcgcgtggcaggcctcccgggagagcaagctgcagcccctccccagctgtgaagtatgtgccacgccaagtcctgaggaggtgcagagctgggcgcagtcttttgacaagctgatgcacagcccagcgggacgcagcgtgttccgggcgttcctgcggacagagtacagcgaggagaacatgctcttctggttggcctgcgaggagctgaaggccgaggccaaccagcatgtggtagacgagaaggcgaggctcatctacgaggactacgtatccatcctgtcccccaaggaggtgagcctggactcccgtgtgcgggagggcatcaacaagaagatgcaggagccgtccgcacacacgttcgacgacgcgcagctgcagatctacacgctcatgcaccgggactcctacccccgcttcctcagctctcccctacggccgactctgggttcccttcaggtgttggtgtcggcagggctgtcagggcacatgcctggccggctggggtccccacccgcggagacggtcctagacccagtggggagtgctgtgtctcctgggtctgcccacccgtggccaagcaggaactccaggtgcagggcgggcctccaggtgcagggcgggccagaagccccctcatcggcccgcagctggctggcccagtgctcctggctgggggctcttgcgtggtgagagtaggggtccccccaggagccatgctggacccatgagcctcgctggggcctcctccccaggcagccaatgggccccagacaagcctttggtggggaacagaacctccgcatcgtgtagttttgtgacataaggagacctcctacttgagctgtctgtaccccagaatcaaacacagaacctcagaaccagatttaggacctcagaatcctgcactcaaggtggcaggacccaatttctgttttatatgttcatgaactttaaacctggaaacatgtccttactaggtgttttatcaaaaaaaagttttcatatttatctctatccctaaccccccaaaaataggatgtcttattattgaagatatttttaaagcaaaaaaaaaaaaaaaaaanaaaaanaaaaaaaaaaaaaaaaaaaaaaaaaaaaaaaaaaaaaaaaaaaaaaaaaaaanaanaaaaaaaaaaaaaaaaaaaaaaaaaaaagcagggaggaggcgcgaccacagacgcacccggacggggcacacactcaagacaacaacagcaaaagagacagaggggcgaccaacagcagagagcgcgcgcaccagcaccccgcgcgcgaggcgccgaccccgccaacacacacagagcggaagggaggagcgcaaccccaacagccacagaaccggacccgccgagaggcacccacaaacgccagccgcggcggaaggaaacaccaaagccgagaacacacacacggaaaga

SEQ ID NO: 671394 - DNA, 1051 bp, Homo sapiens
cagcggccctgcccctcccggcccgggcccggggaccgtgctgggcgggagcttcgggagccggcgcacgggactcgaaccccaagggctcccgccgccaggtccacgtggaccctgggccgcagtggaagtggagcccgccccccgctcgtgggggagggggcgccgcagccgggttcccctttttctggagctcaaagcctggggaagtgattgctcaaaggtgggggccggaagaacccaggtttccgcgtctccctccccctctcagcccggtgaggaggggccggggcgggacaccctgtccgcccccgcccccaccccgctggatctggcagccactcagcccttcgagctgtaggggaggcgctgcgcccccggccccagccgatcgggggctcctggcgctagcctccctccagagcgccgcaggagtccctcctgccgtctgacttgagtccctgctgctgcagtgcacgccccttcggcagccagggtggggcccagacccaacctggcccctcctgcccccaccccgcctttgggtcgctgacccccaggctgtggtgagggtctgagagctggtaccacggagcctgggcaacctcctccgcccacccatgcccaccccgcatgaggctgagaagcagatcacagggccagaggaggcggaccggcccccttcaatgtccagtcatgatacagcctctccagcggcccccagccgcaacccctgctgcctgtgctggtgctgctgctgtagctgctcctggaaccaagagcggcggcgcgcgtggcaggcctcccgggagagcaagctgcagcccctccccagctgtgaagtatgtgccacgccaagtcctgaggaggtgcagagctgggcgcagtcttttgacaagctgatgcacagcccagcgggacgcagcgtgttccgggcgttcctgcggacagagtacacacgagacacatcttttcgttggcgtcgagagttcagacgccgcgacacattatgtgagacgagagacgttattacgacgattacgattcatca

SEQ ID NO: 671395 - DNA, 480 bp, Homo sapiens
  misc_feature (7)..(7): n is a, c, g, or t
  misc_feature (31)..(31): n is a, c, g, or t
  misc_feature (62)..(62): n is a, c, g, or t
  misc_feature (74)..(74): n is a, c, g, or t
  misc_feature (436)..(436): n is a, c, g, or t
  misc_feature (439)..(439): n is a, c, g, or t
ctggctnaacatggagacaaaaggcccatgnctgattccctcccctctgaccctattggttncacctaaagccnaaactaagggtagaaagtggcgggcctactcctagggccacccccacatgtagattgtgtttttgggtgaaaggctggctgatcagagactcaaaagaatgcaaacatttgtctccttacttaccctatgaccccagaagtcctttaccccactttgagttgtcccacctttctggaccgaaccaatgtataccttacacatattgatgatgtctcatgtctccctaaaatgtataaaaccaagctgtgccccagccaccttggacacgtgtcgtgaggatcttctgaagctgtgtcatgggtgtgtccttaatcttgggaaaataatctttctaaattgattgagatctgtctcagagacnttnttggttcacacccatatcctgaaaactacaaaacactgctt

SEQ ID NO: 671396 - DNA, 150 bp, Homo sapiens
ggcctcatttttatcttcaggaagcgttgagacgttcagcaagtgagagagagacagaagccgagagcgaagaagatctcgcaacgtagagacaggagacgctcaacggagtagaatgcctggggccggcgatcccgatcctccagtcct

SEQ ID NO: 671397 - DNA, 468 bp, Homo sapiens
atgaagggtggacgctggaatgaatttatctccatcatggcttttactgctaaaatagaggccatgaaaactgatccaaatggctagatacgaagatgcaacagatgaaaacaaactggcccacgatggaatggaactaaaaaacgtagaataataatccataccttcaagcaccgatagccagaaagtgtgccagataagttttaaggtaaaaggatcatacataattaaaatattgggactatttttgtttagcagatcttttcccatatttatacactgcccaggtaaatataagccttgcctctgccaagtctgaaataatatgtaccagatattcaggacaaaatgtcctccttagcataaacaagttaatttttttaaatccaaaatgaatttatttctgaaggtacaaactactttgttcagcatacctcctgtcctgactaaataaaacaaattttatgg

SEQ ID NO: 671398 - DNA, 271 bp, Homo sapiens
agtgctgtatcacacccggtccatattgggagtcccatagggcagcgcacatttgtggccagcgtcattcgggtttggccatgcagaggccgtccttgtacataacaatttgttgcttaacagacttgccaggttaaatcatggtcatatcaatatacattagtgacaccagtcgaagatgcatctaaatatctacaccatggcttgagtagaggcctagcaaatagtggcaaaaccatcagcattgtctagagctatgagtaggggccta

SEQ ID NO: 671399 - DNA, 346 bp, Homo sapiens
gctaacgatggtgggtgggaacatgtgacaggaactcctattaacaatacagtagagggcccagatgcaaagaatcaggttaaccccgattacagtaaacagcttacactaacgtatacaggtatttcatacccatctaaacacacaagggtaagttgtgaactgctacacatagggtctaacgtggtgtaatcgtgatttacctgtgatactcccctgacaactataaataagtgaaccccatgcaagtacagggaagcactagtcttttatcacaggttgaacctgaggaggtataactcttgacattcgtatctgtaaagagcgtacggatctaaaagctatg

SEQ ID NO: 671400 - DNA, 531 bp, Homo sapiens
tgagattctctatatagactcacaaatgacattggaacaccgtaccttattattcgagcgcatgagactgtgagttcctagtgcacagcactatgcttccttattcgagccgagctgggccagaccaggcaaccttctgggtaacggaccacatctacaacgttatcgtcatagctcttgcctttgttataaccttcttcatagttaatacccatcataatcggagtgctatggcaatgtgactagttcccctaataatcggtgcccccgatatggcgtttccccgcataaacaacataagcttctgactcttacctccctctctcctactcctgctcgcttctgctatagtgtaggccggagcaagaacagtgttgaacagtctaccctcccttagcagggaactactcccaccctggcagcctccgtagacctaaccatcttctccttacacctagcaggtgtctcctctatcttatgggccatcaatttcatcacaacaattatcaatataaaaccccctgccataac

SEQ ID NO: 671401 - DNA, 336 bp, Homo sapiens
gaacctcattttggagcctaaaatcatgcttgttgccattgacaaccgctatatccgcgcggtgggggtcccagttttagggttctcacccataacccgacaacttgtgttgttgcacgaccacaataacagggtggcataaggctgtgttcctccgtggggtggacatatatacacgcctgttgcctgcccttgccagtgtgcctgccctgcccagtgacagttaagccctggaattcttaaacctttgcccctggggtttccatcccaaccagtgccaaggacctctttttcccccttccaaataataaagtctatggacagggctgtttttga

SEQ ID NO: 671402 - DNA, 165 bp, Homo sapiens
gggaagcacggtacgcttatctgtcttcccggatgtcaaccttagtgaatggaacgaggaacccaccctatcgacattcttcacagaactgaatgattgcagttgtctggctagccaacgccatcctgactgggtatactgctcaaaagagaaggccccaacttc

SEQ ID NO: 671403 - DNA, 435 bp, Homo sapiens
  misc_feature (429)..(429): n is a, c, g, or t
gttaaaattttttattgtatttccttaacagacattaaaatgcaaaaatcttaaaaataaaaattaaagtcagtattcatactacagtttcataacagaactccccccccccataatatttaggtattcaatttagaaatggttaactgaaggcaacccaaaattttaatactgctggatattgggtaaaaagactgcaaaaatgaaagtgatatatacttacacttggtccttgggtttcctgcagccatttaagaatgtgggtcaaagagaaagttttaaaataattaaataattttgtttgtctgagagtacattaaatagttaaattttacacaatttaatactgaaataactccattctaattatcttaagtaggctgtttagaagttcttaagttttcaacttaattattttccttttttttnaaaaaa

SEQ ID NO: 671404 - DNA, 128 bp, Homo sapiens
tctattgttccagattaaaatactggttgaatcacagcctcactcagtctttttctttctttttttggtttttctgttcttttttgttttttgtgttttttggagacgaattcccactctgtcgccag

SEQ ID NO: 671405 - DNA, 315 bp, Homo sapiens
  misc_feature (45)..(45): n is a, c, g, or t
  misc_feature (95)..(95): n is a, c, g, or t
  misc_feature (99)..(99): n is a, c, g, or t
  misc_feature (141)..(141): n is a, c, g, or t
  misc_feature (187)..(187): n is a, c, g, or t
  misc_feature (191)..(191): n is a, c, g, or t
  misc_feature (233)..(233): n is a, c, g, or t
  misc_feature (283)..(283): n is a, c, g, or t
gtgacatggagggctctggaatcctgcagtgtgtggtcctttgtnagtaacacgtttccaaggctctggagtcctgcagtgtgtagtcctttgtnagtnacatggagggctgtggagtcctgcagtgtgtggtcctttgtnagtaacatggacggctgtggagttgtgcagtgtgtagtcctttgtnagtnacatggagggctgtggagttgtgcagtgtgtagttctttgtnagtaacatggagggctctggaatcctgcagtttgtggtcctttgtaagtnacacgtttccaaggcttctggagtcctgcagt

SEQ ID NO: 671406 - DNA, 184 bp, Homo sapiens
taccgggtatcattgaccggacatgcttctctcgccaccttgccactcttgtgactcctgtcatcatgccccgtcgtgcgtgccctgccatgtacggtcagcgtgctcttcggcatggtccccccagtcaggtctgcccctggggggaggaggcagcccccggactgtcaatgggtcccggcct

SEQ ID NO: 671407 - DNA, 971 bp, Homo sapiens
tgggcaaaggggaaccggggggggggcccgaaaaaacccggggggtttccgggtttggccccccgaggggcggggggggaaaaccccccgcggggggggccccccaaaacccgggttctcgccgagaagaaacgagggagagggtgtactaaccccgagcgcgcccaccaaactcacgcgcccgagcgcgccaccgagtggcggcctcctacaacccgttacagacccggggagacacagcactagagaagcagctccgacggtctcccccctcagcgtggtggtaaaaccccgcggtccgggggcccctcgcggggtgctccgataaggcccccttcaccaccccgagaaaaaccccgggggggcgcggagcggaaattaccacgcagaggaggctctcacccaatctctttcccagcaataaattaattctctaacgccgcgaggaggacgcggcgagtagtatgttccccaggagaggaaaccaatcggcgctctccagcgagaaagaagcagcagaggtatttcccacagcggccccacacgctcacgggggccctccgagacgaagccccacaaaagcgccattatatcaacggggggagcaacacgagggccgaggagggggggggaacgcctctcataatattgagaaacccccgggcggaggacgccgacgcccccgaggggagccacacggagaccacgtctgcgagcagccccccccgggagaggctgccaggagaggagaacagcgttgggaacccaccccacggctctctttggtgtcccccaaagaaaccgggaggaggaagaagcccgtgcttcgtgccacagaaccttacaccgttgtggggctgcacacaaatcggggacaaccgggcgggaccccccgtgggccccaagaaaacccgaggttctgcttagaggggccaactgcacaagaaaaagtctcctggaaacaagacagc

SEQ ID NO: 671408 - DNA, 737 bp, Homo sapiens
gtgttttgttttttggttttttttttggtgtttggggggtggtcgtgtttttttttttcgtcgtgttggtttttgtcgctcgtgcgggcgcgatgttctttcgttttttttgtggtcgtcgtcgttgtttagtttttggtgctgttgtgtgtgtgctttgttgggttgtttgtttgtcctcgcccgtctgtgtctcttcgtggggtggctgattcgagctgattggcctcgctcgtttgctgtgctctgctttgctggggggggtgtggtcgccgcattatatttattgtctgtggtggctgctttgttctttgcttggttgctattttttctgctggctgcggtctgtgccgtctcgctgggttttttttgttgtttctggtggggttggtccctgcgtgttttttttgtgttctggtgggcgccgctccgccccgtgtctgtttttttggtggtgcggagcatttcttgtgctgcgttgtttggctgctggtgggtggtgtccgcggaatggtttttgttgtcctgcgcaggctttttttgtctttcgacgcccgctgtcttttttcttgctggctggtgcgccgggtgtgccgggggtgttggttggtcggtgggggggctcctccggccggtccgttgtgctggggtgatttgtttcccccccccccccctttttttttttttttttttttcccccccccccgtccttttcccccttctccccccccccacta

SEQ ID NO: 671409 - DNA, 253 bp, Homo sapiens
  misc_feature (13)..(13): n is a, c, g, or t
tcagacgctgaanctatgtgcactcatcctgcaagtacaacctgcttcgagaagctgccacaatgaacatgtcttgtacacctgtccccctgcttcagtggactgtccagatctggtgacatctgtcacatgtgggctgagtgcctggcctctgagcaagacagtgctgcttcaacgtgctcaattgtcaccaatgcttgcctgtgcaccaagaatgcatgttccacatatgttcatgctgtcttgactgtgt

SEQ ID NO: 671410 - DNA, 912 bp, Homo sapiens
cctgtgtgttcccgggcggtgtactttttgccgcggtgtgtgagtttgccgggaggtcggggatggtttgtccgccgtctgtgaagtttctggctgctctgggtttttgtgccggagcccgtgtttgcaggtgccccgttggcccctctaagcggaaacagccggggggctactcgaggagaacgtggtgagcgcacccgggagcccgaattggtgtgcggcccatacggcagataatagttcttccccgcgtttgtttggccaaataaattaggggctgtgtgccctgcccccgcccccagggtttgtgtgcccttttgaataagcgcgacgcatattgcatgtattgtccaacttggcctcaaaaaatcgcccgcgataggccctcgctttccaattggggacggctttataatgggcccccaaattattcagaaattctttggagatccaacacgggtttctcccgaccgcttttggaaaaccccttttccgctgttccgccccctattaacaaacttctggcaccccgttaaagtgttattcaggcacccaccgcgagattccattttgttctcttttacacgcccccgtttaatcatgagcaaaagaccagctattctgtcttcacatcatcaaagtgataaaagtacgttcttgcccttgcctccccctccagcggctcctttttgtcttttgtttcgccccccagagacaactttttctcatctagatctctcccacaagctcatcttcagttgtctcctccaatatactcacacatgttgtgggatgaataaaataacaccaaaaccacagtggaatcaaaagaaaaacacaccgttgtcgaatccacaaaaatcctggcggccacaaaattcggaaataaatcccatcaacccacataacaaa

SEQ ID NO: 671411 - DNA, 128 bp, Homo sapiens
tcgccgtagcagccagctatcatgagcagcgccggtacaatgaagttatggtcgagtgtttgggacggggtgagcggatacgggagtgccggcacggtgggccacgctaccatctatcttccattgat

SEQ ID NO: 671412 - DNA, 279 bp, Homo sapiens
tggatttttagtatagacgtggtttcactgtgttagccaggacggtctcgatctcatgacgtcgtgatctgcccgccttggcctcccaaagtactggctgggattacaggcgtgacgactgcgcccggccttccttccccaattctttgatagatgctcaattcacaggtacaattggtgcctgccgaccttgcagggtggatattagttttcatctgaggcttcagaatacccaagtggcacaacaccaggtcaaatgattttagtggtttgcaagtc

SEQ ID NO: 671413 - DNA, 258 bp, Homo sapiens
  misc_feature (249)..(249): n is a, c, g, or t
gcactatttctatttggagcagattattctctgatgtggcggctggcctgtactttgtaggatgtttatcagcatccctggcctctactcactaggtgccaagtggcagaactcttcccacccaccccaatggtctgattacccacgtattctctccacgatatgactaaacggatctacgttacctgggacactactactacaagaatgctctcaaatagctcaaacagctaaattaagaaacagagnccaactttt

SEQ ID NO: 671414 - DNA, 154 bp, Homo sapiens
ggggttggatagattcagcaacgcttcatgttcaactctcaacaagctaggtattgaaggaacatacctcaaaataataagacccatctatgacaaacccacagccaacatgtgggtgggctgaatgggaaaatgctggatcagcggatcgagt

SEQ ID NO: 671415 - DNA, 650 bp, Homo sapiens
atatgtctctcagtgtgtgaaggattgttacaccatcctctgtgtgccgcctgatgtatgaagcttgtgtaaatcaatgggttctggtttttagctgcgagtagtggttcgagggatatctgctgatggacttacactgtgttgtgtttgatttatttattgcatgtccgttcttttgactgatggttgtctataaaacaagctctcctgtatgatttcttcttcatctcctcttcttcctcttcgttggtcttctcctccagagtcgcgtcgccatcattcttatactactctgcgactctcataagaatacaacatagttgtggttctttctagtttattattatatatatcagagcgcttatacagctaggcatcacatacttattctagtattactctttattgtactgatctactgtctttaatacacctatatctttctctcacctcgtataaccaacacacacacacacacacacacacacacacacactctctctctctctctctctctttccttataggggaacggctttagcctcaggttataaatataaggattccatttccttctataggttttgtactattcatctcttttcattcatgtattaatatgtaaacctccagcgtaagagaactttaac

SEQ ID NO: 671416 - DNA, 411 bp, Homo sapiens
  misc_feature (232)..(232): n is a, c, g, or t
gttatgtctggggatggtcgcacaactttgtgaatatactaaaattcactcacccatacacttttttttttctttttctttggagacggggtctcgctctgttgcccaggctggggtgcagtggctcaatctcggctcactgcaccctctgcctgccggattcaggcggttctcctgcttcagcctccacctccctagtagctgggattataggcacctgtctaatttttgnatttttagtagagatggggtttcaccgtgttggccaggctggtctcgacctcctgacctcaggtgatcactggcctcggcctcccagagtgttgggattgcgggcgtgagccactgtgcctggcctgaaccatatatttttaatagagtgaatggtatactatgtaaatgacatctcaa

SEQ ID NO: 671417 - DNA, 787 bp, Homo sapiens
atttgtataccttggcctttcacaaattcctctctgggtgggtgtcaaagcccaactctgttggtgtaacttcaagaatttccccctcttagcacagattgagtgccatattggcccgtgatcccacaaaggaatcctgcacccctcgtcctattgaactgtggcatagtgttccagaagcttccaagagcaacaccaagctgggcaactttaagattttttttaaaccacaaaaaccccggttagccatctcatggtcacgcttatccctttcctccccttagaaactctctccctgctgtaattaaagggagcaggtggagagtccttttccttcgtcctgcatgtctctaaccttaattgaagggatgggtccttctgcaacccctgttaatgcttcttaaaacccccctctatggggatggctattttatttttgagaaggaaaaaaaaagtcctgtttatattcccattaaggcatatagctatatataaagagataagggtgtttattaaattagaaaattattgggccattcaggctttactaaagcacagttaaaccccaggcctatgcttaggtctaaacctctgaaaaaagtatagtatcgagttcccgttcccccccaaaggtgggagtaactgctggtagtgccctctttgggtgtgttgctcagtgtgtaaatgtttgtttccaggaaaatttccttttaaaagtccctcttatatgggtttttaaagaaagttataaaaggctgttgcgaaaatgggaaatacatatgtaaga

SEQ ID NO: 671418 - DNA, 175 bp, Homo sapiens
taactgcaaaatctttttaatcttcgccttaatacttatttatgacgttgcagggcggacatgatgcgccttcgtgcccacccttccccctttttagtcccccaacttgagatgtatgaaggcttttggtctccctgggagtgggtggaggcagccagggcttcactgtaacact

SEQ ID NO: 671419 - DNA, 759 bp, Homo sapiens
  misc_feature (441)..(441): n is a, c, g, or t
  misc_feature (449)..(449): n is a, c, g, or t
attcggcactgagggggagtaattaattgaatcaaaccttgctgttaggtcaagtaaaacattcaacagacatcactggtgacttgcaaaagctatttcagaggaatgaatggtcggaggaaaggatcactgcagtgaatttaagagagaatgggaggagaagagttaaagaaaagagacacagacaattcttccagcaattctatttataaagggaagcagagaaatcagggtgtatgtgctagaatgggatggggggagtcgagagagggttttttctgaacttggaagaaataacagtataaatgttttacactgatgggaatgactaggtagacaggcagaaactgataatccaggaaagggcaagaggacaactatagaagcaataactgaaaagctgttcatctaatacacccaagtctgtgaaactaacagtancagcttancttctttgaaatgtcttctagtttataaaataattttataatatgttcacatctttttatcataatcctctaatataggtattacccccacttatttagagaaaagcaaaatgcagttcagaagtcaggtaacttggccaaagtcacactgatactgaacaaaggcagaatacaaaacctaagtcttcctactctaaattcctctttagccctactttagtggatggtttagaatgaaaatatactgaggaaacccaccttatctattaatttagcatcttatttttaaaagtagtatcaaaattacatt

SEQ ID NO: 671420 - DNA, 155 bp, Homo sapiens
  misc_feature (130)..(130): n is a, c, g, or t
cttgaggatcttgcacaccgctacggctgatccattcaccgactcggaagaccgggccgcgcgcgtggcgtactgactcacacgtcacggctggctcgatcagaggcttgcgccccccgtagctggtgtngcggtacgagctcgaatcgtatcat

SEQ ID NO: 671421 - DNA, 339 bp, Homo sapiens
cgtcgactctaaaactgaataatgtggttcaattagtttactttgcaaccatgcaaagtaggggtgctttattatctttagtgttaatgattgggttttatagtttctttattaacaggggcaagttagctaagcgatttctaatctttattgtttctgctttacttgtttctgctactaacatcggattgagttatgtaacttctatttacatatcttcggggaaagcgactgtattagacttaaataaaggacaatcttatgcagaaacagattcttcagttataaaaaaaacaggcgaacttcatctaatagaaacaacacctagtgggtcgacgc

SEQ ID NO: 671422 - DNA, 424 bp, Homo sapiens
  misc_feature (71)..(71): n is a, c, g, or t
acagagtctcgctctgtctcccaggctggagtgcagtggcgtgatctttgctcactgcaagctccgcctcncaggttcacgccattctcctgctcagcctcctgagtagctgggactacaggcacccaccgccatgcccagctaatttttttgtacttttagtagagatggggtttcaccatgttggctaggatggtctcgatctcctgacctcgtgatctggcagcctcggcctcccatagtgctaggattacaggcgtgagccaccacgcctggccagagtgatatttatattaatgggaaggatgcctctgatgggcagtcaagggtctgggtgaggaaagattttcttttcactgtatactgttttgtattgttgggaaaatgtctaacgatttgcataaatattaaattttttaattaa

SEQ ID NO: 671423 - DNA, 505 bp, Homo sapiens
aaatatggtacataaacacaatggagtactattcagccataaaaaagaatgagatcctgtcatttgcaacattatagatggaactagagatcattaagtgaaataagccaggcacagcaagacagacatcacatgttctgacgtatttgttggagctaaagatgaaaacaactgaacttatagagggtagaaggatgtttaccagaggcgggaaaggcagtgagggcatggtgagggggaagtggggaatgttaacgggcacaaaatgtagaatgactaagacctagtatttgatatcacaaggttactacagtcaataataattgtgcattttaaaggtataattgaattgtaacacaaaggataaatgcttgaggttatggataccccatttaccctgatgtgattattagacattgcatgcctatatcaaaatatttcatgtcccccatagatttatccacctaagttgttccccccaaaaatttaaaatctaggaaaattt

SEQ ID NO: 671424 - DNA, 339 bp, Homo sapiens
tgaattaacctggcccaaaaccaaaaagaaaaaaaaaacctgccctttgtcctgtaaaacttttttttatccctatggggcttgagggacagaatcaggacttcagtttttgtaaatagtgaggtaaacccccaatttttatccccccgttgcccctttcatgaactaaacaattatttgggtgattgggatgtttcccccgggccctggtcatgtataacaggactctttttttggagaacccctttttggatatatttattattgtaaatcatgggctgccccccccagtttgtaagtttaaactattaaatgacccctttatatttgggattttta

SEQ ID NO: 671425 - DNA, 243 bp, Homo sapiens
  misc_feature (188)..(188): n is a, c, g, or t
tacttctcgagctgtacatttcgcggtcgcgacgtcgcgtctcgattgtgcctgctgttggcgtgcgccatatgcatcctaggcctattaatattcctggagtatacgtatccggctatcgttaacaatccgtttacctctatgaactatagtctagcattgcgcaaactttcaatagtcgctgagtnatctattcgctgcggcacgatctagtccattgattgactcatctgccaagttagg

SEQ ID NO: 671426 - DNA, 217 bp, Homo sapiens
ggcagcccggagtaaggctgttgaggacgctggtggcagcggatgtatgacggtgtcggctggccatgccgcgctcttgttggcccaggggcgtggtcgtctcatccgtcgtgctgacgatcgcggggtggtcgccgttctcgacccacggctggtgactgccaggtacggcaattttctgcgggcgtcgatgccgcccttctggactacgaccgat

SEQ ID NO: 671427 - DNA, 157 bp, Homo sapiens
gctcggacctccttttattccaaggcagtcgcacaatcatagctcgcctgagctcgaactcctgggctcaagcaatcctcctgcctcagtctctcgagtagctgggactatacatgtgtgccaccatgcccagtttattttattttttttttttgga

SEQ ID NO: 671428 - DNA, 87 bp, Homo sapiens
ttatgtgttcttcattttacaatgaaggggtagtaattggcccactctcttcttactggaggctatttaaataaaatgtaagacttc

SEQ ID NO: 671429 - DNA, 1197 bp, Homo sapiens
agcctgcagcagtgcaggatgggcaggagagcagagccgctggagtctgcggatgcagggtgaagagctggcgctgtaattccctgccagcaagatttgttcctgctgccctgcagaccctggactagcagtgatcctgaacccctggctgtgctgcgtgcttatagtgcgcagactgtcagagagccctgcggcttaaagcgcgtctgcctgtgctagcgccagccccatagccttcttcaatgtgcctccagggctgggcccaatgcgcccgtcagacaggcacacctggtgcccatgaggacatcgctgggcctcatctccaatgattcagaactcacgtccgtcgctgctgcaaccccaagatgtcggagacacggtggaaacgcttatgttacatccggtgatcaaggcttacctgtgtggctccatcagttgggacctgctctaccctccttttccaacctctggatctccttaaaacacgcctgcaaaccctccagccctcagatcatgggtctagacgtgtcgggatgttggctgtcactcttgcaaggtggttcgcacaggagagtcttttgggcctttggccagtggatgtccccttccatggtgagatgtgtccctggagttggaatctactttggcactctctactctttgaagcagcattactttgaactggacagtcccccaaactggccctggatgtcagagtcacatgcttgggaggtggggcctcagcaccaggagcagagagacatggcattgtaccatatcagttggacaacacaaagaccatctcagaccttggcaaatctgcaccagaacgtatctagaacgcacgtgagggaaccatagaaacgacacagcgtgcccccgcggccacaccaacgggaacggcacacgcactcccaagcggaaagggcacgaagcacggagaaccatccgcggcgttgatcaccggagccgagggagcaggggcgcgtgcaacgggtgcgcacgactggcagacggaacgaagtgagtcgagacacgcggagcagcgacgcggaggaaagagcgggggaggaggaggagcggacgataggaggagttcgacgacgaggccaccttcgagatggggtggcgccagtgttggggatgaggagacacagcgaggcggggagggtcgcgccggatgaaggaggatgagac

SEQ ID NO: 671430 - DNA, 438 bp, Homo sapiens
  misc_feature (36)..(37): n is a, c, g, or t
gatccccccgctctgcacccaccccggggaggcggnntctcacattgagagagggagggaggtgctggggggtaaacacggagctcttacctaaactcagagggagaactcattactacggggaagaagccaagccactcacgcaaggtctgcccccgtgacccagacgcctcccactgagctccacctctagtgctggaacactgggaatcacgttttttattttttgagacagtctcactctgtcgccctggctgaagtgcaatggcatgatctcagctcactgcaacctccacctcccaggttcaagcgattcttgtgcctcagcttcccaagtagctgggattgcgggtgtgtgccaccgagcctagctaattttttgtgtgtgtgtgtgtatatttagtaggggtgggtggagagcgggggtaccgagcttga

SEQ ID NO: 671431 - DNA, 320 bp, Homo sapiens
cgcgtgtcgcctccacagagcgacattgaccatgctgcagggaatgttccaccttgttacgtgctccctgtcctgcagctgtagagctagccggtagttcttgagcagtgcgttatgattgtgcgagtttgtgtcacacttgctgtaggtcttgcttgaggatctgcccagtccggcggatgccgtcttccagcctccccatcagcgttgggatgccttcctctaggtactttaggaagtgatagtcatcgctgtcccagggtgtcaatacacccagggttgttagcgaaaaatctcctaaagggaaacccggacgggct

SEQ ID NO: 671432 - DNA, 144 bp, Homo sapiens
gctcgcacccaccaattaggactgaggtctctggaggaggagggacagaagctgccgcacactgcagacgagcagaggtgggaagatacggtggagaaggaccaagaactgactcaggaaagccctcctgccatgactagagag

SEQ ID NO: 671433 - DNA, 122 bp, Homo sapiens
ggtcgtctctagcacggatccccccctcgaaacccagtcaccaacttcactatttgggttgacttacgccattctgatctttgcgtgttttgtgagcaatttgcagtgtgacagggaactcg

SEQ ID NO: 671434 - DNA, 410 bp, Homo sapiens
acgtgtagccttcatcacagtttgctgaagatggcggatataggctgagacaagaggtggtgagcgttgatcggggtttatcgattacacaacaggctcctctacgagggatatgaagcaccgccaggtcctttgagttatatgctgtggctcgtagtgttctggcgagcagcctagtacgatacaactgttgcacgagtatagggctaaccatagctggggtatctaatcccagtttgggtcttagctatagtgtgtacaagatatgtaacagccacttacgcactctatcccgtgtcaactggagtcctctacaactcaggtgagtatcagctttattggggagggggtgatctaaaacactcattacgccggctactattgactagggttaatcgtgtgaccgcgaa

SEQ ID NO: 671435 - DNA, 345 bp, Homo sapiens
gccatggacatttgctcgaatgtgctgatgacagggcggaccttgccaagtctatctgtgaaaatcaagattcgatctaccagtaaactgaaggaatgctgtgaacctctgttgcatcccactgcattgccgaaccgggtacggatgttcgcaacaactatgctgaggcacaggatgacgacctgggcatgactctgtatgaatatgcaagagcgcatcttgattactctgtctggctgctgatgacacttgcctggacatatgacgccactctagacaagtgctgagccgctgcacatcctcatgagtgctatgccacagagtgctatgaattctccttcgcgg

SEQ ID NO: 671436 - DNA, 369 bp, Homo sapiens
ccgactatctgttctgtgtcactgtcatccacactttatgtcttcaagccaggatggctcagagctgtccttccacggagttcactgagtcactgtcgggagaaggcgtctcagaaaattctgtactctgcagtggtctatacagcgcatactcatctctgaaaagctggtcgtgatgactaacacaatccagccaacgtccatcaaccattgcttgtccaattgctatagcttgtgcccttgtggcaatatgcccatttcggattagccagtcgactaattcctttcctacaatgcagttgggatgcgttctcaaccagtagcggtgatcctgaaactccattccactgctgtgatggcagatttttt

SEQ ID NO: 671437 - DNA, 553 bp, Homo sapiens
aatccacagtgtggtgaatctctacccgccgcagctcaatcaatgcgcgtgaccgctaaccataacgacggaggtacctttacgcgcacgcacagtacctgtgcgcagcgggaagctgacgtatcggtcagcgcgggatgctcaggcgtgtgacacgctgctgtaagagacctgccgtgactgcattagctgccgagctggtgctcagacggatggcaggtcgaattaggcgctagtccaggcagcccagatgacgagaatgatgacggactgcgaccacgatggggctggcttaagagcgatatcagacagtcagaaggtagcacacagcccttacacaggcaccagagtcagagagagtgctgactgactagaacgctgatgggggtagcttacgcaagatgaacgtgtgtattagctgcccagtgctagcgacgagactctagtgtgatgacggagccagctcatgtatctagatacctagttagctatagcgcgctgtctggcctgagctaagaagcatgctctgatgtcgcctgtgtcctgtgtcggc

SEQ ID NO: 671438 - DNA, 482 bp, Homo sapiens
  misc_feature (262)..(262): n is a, c, g, or t
  misc_feature (346)..(346): n is a, c, g, or t
  misc_feature (398)..(398): n is a, c, g, or t
  misc_feature (413)..(413): n is a, c, g, or t
  misc_feature (429)..(429): n is a, c, g, or t
atttaactatgtaatagcttaccattgaccggaagcttatctggtctgtagattaacacatattttgtatatgtattatatacggtattcttacaatatagtaagctagaggaaagaaaatgttaagaatcatgaggaagagaaaatatatttactattcattaagtggaagtggatcatcataaaggtgttcatcttcatgttgagttaggctgagaaaagagggattggtcttgctgtcttaggggtggcagaagaggangaaaatcttcatataagtggatctgtgaagttcaaacctgtgttgttcaagggtcaattgtctattttgataatatgtataccntttgttgttttcctattgctaatgcaacaaattagcacaattttgtgggctnaaagcatgcacatanttgtctggatagttcngggaggtcagaagtacaaaatgagttttcactgctaaagtccaggtgtagggc

SEQ ID NO: 671439 - DNA, 387 bp, Homo sapiens
tatcagatcacagcttataatcataccattacctatgcagaaagacggaggaagcagtataatgatgctcagaggtgttataggattgttgaaaaaaaattgccattcagaattgcatttagtgtaataggaactgaggagtggaaaacggagttccacctttgcataggagtctgctttcatttctttctcaagtctttgaagccatcaaatcatgctaccatccagagtatagtgagagctgtgggggtcgttcctgggattcctgagccttgctgtgtaccagaaaagatgtcctcactcagtattttattcctggatgagaatcggaatgtggttctgaaggtataccccaacatgacagtagacacctgtgcctgcagataa

SEQ ID NO: 671440 - DNA, 412 bp, Homo sapiens
  misc_feature (3)..(3): n is a, c, g, or t
  misc_feature (96)..(96): n is a, c, g, or t
  misc_feature (107)..(107): n is a, c, g, or t
  misc_feature (148)..(148): n is a, c, g, or t
  misc_feature (151)..(151): n is a, c, g, or t
  misc_feature (248)..(248): n is a, c, g, or t
  misc_feature (411)..(411): n is a, c, g, or t
ganaactttgggggaactgttggggaaaggccatgaactggttttgaaaatgtgaaagatatgaaaactgggaggggccccaggggtggaatgaanatggtttggcnctgtgtcccctaccccaaaactcatccttgtagctccccanaantctcacatgtgggagggaccctggtaggaaatgactgaatcatggggatgggtctttcctatgctgttctcatgatagtgaatgggtctcatgaganctgatgattttaaaaaacgggagtttctctgtaaaagctcttttgttttgcctgccaccattcacgtaagatgtgacttgctcctcctgccttccaccatgattgtgaaccctctccagccatgtggaactgtaagtccaattaaacctttcttttgtaaatna

SEQ ID NO: 671441 - DNA, 573 bp, Homo sapiens
  misc_feature (267)..(267): n is a, c, g, or t
  misc_feature (306)..(306): n is a, c, g, or t
  misc_feature (404)..(404): n is a, c, g, or t
  misc_feature (463)..(463): n is a, c, g, or t
  misc_feature (514)..(514): n is a, c, g, or t
  misc_feature (572)..(572): n is a, c, g, or t
gctcggtaccctccccgtacgcccaaatggaatattatttagtcatagtaaagaacaaaatcctgttgtttgtggcaacaagaatgcaagtggagggcattatgttaggtgaaataagcctggcatagaaatataaacaccacataactacgtgttctcacttatgtatggaagctaaaatttttaatctcgtagaagtagatagtagagttttggttaccatatcctggaaagagtaggagaaagaagagtataagaaaaatgtgnttaatacatacaaaattacagctggagagaaggaagaanttctagttctctacagcactgttgggtgactgtagttaacgggaatttattgtgtgttttcaaataactaaaataaaagattttgaatattctcactncaaagaaataatacatgatttagggtaatgggatatggataatgactctgacttgatcnttacgcattgcataaatatatccaaaatatcactctgtacccccttaaccngtaccattattatatggtccatttaaaggtaaattttaaagggggaaaattgagggtna

SEQ ID NO: 671442 - DNA, 206 bp, Homo sapiens
cattttccagctagccttggtaacctcccatctagttctgtctctgtgaatttgactgtgtaccccgtgtaagtggtatcatacagtatttgtatttttgtgactggcatatttcacatagcataatctccttgtggtttatccatcttgtagcatgtgtcagaatttccttcccttttaagactaaataatattccattgtgtgt

SEQ ID NO: 671443 - DNA, 126 bp, Homo sapiens
ggcggagtagagcagtcatacgggagcagatatgctgaaaggacacgtgacaagttgaaggagtcgcttaaagaagttcagctggagagagatcaatatgctgaacaaataaaacggagagcaggg

SEQ ID NO: 671444 - DNA, 116 bp, Homo sapiens
  misc_feature (80)..(80): n is a, c, g, or t
gaggtgagctggatgtccagtggagggagaatgcagaggatggggagactgaggccgtggctgtgtgtccctcagagagnttgagcggggctgggcccgaattcgaccgcagcagg

SEQ ID NO: 671445 - DNA, 316 bp, Homo sapiens
  misc_feature (290)..(290): n is a, c, g, or t
ttttgagacggagtttcactcctgttgcccaggctggtttcgggctcccggcctcgggtggtccgcccgcctcggccttccggggtgctgggattgcaggcatgggccactgcgtctggccttctataattttctggtagtcacgatggaaacaaacaaaacaccttagaaccagagatcgaccccctcaagcaatacatcaattcccttcacaagaaacgtcggggctacatgagtatcctgtgttgaatcaggtctgaaatgatcctatgattttcccgtgttgccanctactgtacacattcggcaacatcgc

SEQ ID NO: 671446 - DNA, 425 bp, Homo sapiens
ggagcatgcatggacacactggccagtgtctatgaagtggtgctgctcttatcttcgtgtacgcactccatggaaacgacagactgtgacacaggcggaagcctaggagagccgtatcatcgttggggctgagccagaactggccaaagtgactgacatactgtcagacagtaggctcatcgagaaggcacgtcaggtgtgaggtgagatggtgctgtttcaactcttggacacaactgatgtaactattgagtcctgctccaagggctctgctgaggatgagatactgggagtcagggcacctgtatatctgactacagttgtactcgcattactcgtgctagatattgctctacttagactgcatgaggcctggcaccagctttgagagagtgcttactgacctgaatgatgataccatgctt

SEQ ID NO: 671447 - DNA, 184 bp, Homo sapiens
  misc_feature (68)..(68): n is a, c, g, or t
  misc_feature (79)..(80): n is a, c, g, or t
  misc_feature (104)..(104): n is a, c, g, or t
  misc_feature (135)..(135): n is a, c, g, or t
ccttccaaccttttaaaaggcaattagatttaatgcagattatggagtttttaaagtagctaatgatnctccacaattnntggaaaaacaactgaaaaaaattntacaaaaccagcaacctcgaaatcccatttntaatgttgtaaggaaaggaaagattgaggttaaacctgttcaaatgatt

SEQ ID NO: 671448 - DNA, 1144 bp, Homo sapiens
  misc_feature (593)..(593): n is a, c, g, or t
  misc_feature (1144)..(1144): n is a, c, g, or t
agcggggaacgtactcgtccccttggtgcttctctccaatggtacgctgacgagtcccgggccccacaaagtgcgtcctttgacggaaagattactggcgtaccttctgcgggggccggcaagggccactccgcgacgtgcgtgaccagactggcctgggagagtggcttcacgggtatgagaccgcgtgccagtgcactgctgacctgtggctgcgctactgtgggtactctagcagatgaggcgcgccaaggttgctatcttcagtactactgagaggggcatacccagagggcacctcggttgaggacagcgagggcttctaacacagtccagacagcgagggcgccgatcctggtagagcgatgctcgatctccacaggcgagtctcgtgcgaaaggtcgaggcgcgagagaacggagctctagattgcgccaaagtgctgctgagtcgctcccatgcccatctcgccgcaccggcagaggagacggctcggacgtagagagagagcggtagggtctcgacagacctcatagccctagcgaggaccgcagtgtctaactccagcgccaaagccctaggtgtttggcgantccgttgcagggggaacagcgccgacgtccctcgagcccgtggcgccagatcttcgtctacccggggcacaaccggagggtggggacgcttgggcgggctggccatggggcaatttgtacgcccttgggcggcgaggtgcacagcctgcggcgccacgcactacagaacttaggggcgattgtgccaccggttgggcggaatcaccacgataacccgccacctatcgccgtgctagatcgggtagcgattgaggggccagttgcgccttgtgtcgccttcacctaggttcttgaacgaggatttggaactgtgttcttgaactggccggaatcccggtaacatacttgtatcccaattgcggcggcaaactgtgggagcttgccgcgggaaccccccttgaccaacaaagggtaagtgcccatttccggaagagtcttgggctgcttgaaacgccccggaattcggagtggaaacccaaacggtgggggccgcatagtaagtggggcaacaccaagcgaggaagtaaacgcctgttccggatatccttgtn

SEQ ID NO: 671449 - DNA, 429 bp, Homo sapiens
  misc_feature (408)..(408): n is a, c, g, or t
  misc_feature (425)..(425): n is a, c, g, or t
cagagtctcactctgtcacctaggttggagtgcagtggtgtgatgtcggctcactgcaacctctgcctcccgggttcaaacgattctcctgccccagccactctagtagctggaactgcaggtgtgcaccaccacgccgggctagtttttgtattttaagtagagacggcatttcaccatattggtcaggctggtctcgaactcctgaccccaagtgttccgcccgcctctgcctcccatagtgctagaattacaggcctgagctactgcgcttggccccttgcggtacttttggcccaacctcctccaatggctggggacgcggaggccgagagaagaagtcacttgccctggctctaccttgaaagtggttctcaagggttgggggcgagaatcggggtggggacngagatgcagctctatcntgtt

SEQ ID NO: 671450 - DNA, 167 bp, Homo sapiens
ttagaggctgttgtaggttattaattttcctaatctcaatattgttgtgtctcggggaacagaaaagcctgaggagaaggagagatagtgggaatgtctagttgttggagcagtcagaacacacatatttattgatgaaattcaccatcttatataggggcagcttg

SEQ ID NO: 671451 - DNA, 358 bp, Homo sapiens
tctactattgtagcgccaaccccggctggtcaagtcaccgggcagtgctgcgaggagtggctctgcgacgaggacggtgccaaggaccccatggacgacagggacggcctcccgggcaaggcgctggccttcgatgcctccgaggtggagttaacgagaaacaacgaattaattgcctttggaaaaggcggctccctgaagcggctcccgggtaagtgaagacggaggttctgaaaaatctagtcctagtcggaagcctcagagagatgagcacttccttgcacgtgtgtcccgtgcctctgagaaatctcttctgtgtctctagttttccgagcggagcctcgcgttctctacaccc

SEQ ID NO: 671452 - DNA, 990 bp, Homo sapiens
  misc_feature (162)..(162): n is a, c, g, or t
aggaaagacaagagcagagacagacagaaagagagcagagaaagaaaaacagacacagaaagcacaacagaacagaacagaacagaacagcaacagacaacgacaagcagacacacacacagacaaagaaagaaagaaagagaacagaaagaaatgcgactngaactttgcccagtggaaaacgaccagtgccttgtggctgttgggcccagtttttgcgtcagtttgtcaacgcatttccagtttccccgtttgccttgcgcacacagttctttggaactccttttgaatggtttttaaccaatcgctgtttcccctgttaaacaaactgagttaataaaacctttcacatgttgttcaccgtaatgcaacaacaacaggccggctgccagttggcatcgcggcctggtaatcccagcacttgggggggcccgaaggagggtgggatcatgagggtcaggagtttccaagaaccagacttggttaccatggctgaaaaccccgtctctgctaaaaattgcagcacgggtcgggtcccaaggttgtcgttggcatgttggttgcctggttgggttccttaagctggcttcaagggaggcttgatggccaggcaaccttggctttgaaccccgggaagggcgcggaggttgcagttggagcccgaaatccgtgccatttgtaccttcctgaccggggtcggtacacaagtgcacactccgcgtctcaaagaaaacaacagcaaccaaacaagaaagagcgcaaaaaagggggaatacgccctttctccagagaccctgttaatttagacattagcctattacgaatcttgtgacacggaattgggccacttaggcccaggaagctgaactggtagaatatggcagccagtcgagcaacgagtgacacacggcggcgagtctaacaacaagaaaatcgagcaacatcatgtgtagatgggagtgcaggaagacacacagacaagagatgagg

SEQ ID NO: 671453 - DNA, 911 bp, Homo sapiens
ggttccgccgggagcgggcgctggcgccagagcagggttcagtttctggcgcgaacttccgccgtatccgaagtagcacggtgaatggcgctagtgtcgggggacagcagcggtcgcgggccgagagggccggggccggggccggggacgccgcatcgggatcggcaacccggatcagggatcaccgcatcgcaggtcaacccttgtcgccccagggtcccgcccgggctctgcgcggggaggcgaaaagagggccccaagagcgccggagctgggaggaacacagaagccggtagggattccggggggacgaagatggctggacccccgggcaagcttggaagggcggagggcgcgaaccaaggggccttgtgcccggcaaaagaatccagacaatcagtaccaggggcgcacatcaaactcccgtccaacaaaaacgcggggaggaaaataactggaatggcccggttgaccacattaaacaggagcgcccctggacggaggataaccactctggtcaactgcgagggggtcccgagacaagaagaagcaggcctggatgcccacttcgtggtcggggctacagattgtggggcaaagagaaaggcaaaggaaggtgggataaagagctggaggtccttgtgacagttgtacggcattggtggcaactcctactccaccacatagtggggggtcaaaccgcgagcaggcgtgaaaaccaccgggagaagaaagtctgattcggatcagtcggcagactctgagaaaacggccgacgcggaaaccttaagagaaccaaaactcactttcggggtccaactggaagtccggccaccaggtgacgccaaagtcgtggcaggggggaccctccgtagaaggactcacagcgagaagacgtgggacaggaacgc

SEQ ID NO: 671454 - DNA, 672 bp, Homo sapiens
cacgatggtgaggaggtaagtgacagggtgctctttgatacctcagatgatgaggagctgagagaagagcgggatatgcactcaatcatcgttgctcgtgggtaatgatgaaccccgttcttcactggaagagcaggtcatgaatgatatcggggacttgctgcaggaagtcaccggaccatgaagatgatgataacccctagacaggcagatcggctttcaatgctttcccaggaaattcaaactctcaagaggtctagtaccggcagttatgaagagagagtgaaaaggctctcaggtctgagttaaatgaaatcctggaagaaattgagactgccattaaggagtactctgaggagctggtgcagcagttggctttacgagatgaactggagttgaaaaggaagtgaaaaacagctttatttctgttcttatgtgaagtgcaaaacaaacagaaagagcacaaagaaacaggaaaaaaagaaaaagaaactaaaaaatggcagtctcagaatgggacgaatgagagaagtcatatggccggacatatttgactacagtcattccttatgagaaaaaaaaggaacacgtctgtggaagatcttcaaatattacaaaaattcttgtgcatgaggggccagcggaaaagttcgagctgtaatgatatttcgg

SEQ ID NO: 671455 - DNA, 143 bp, Homo sapiens
cagaacacgatcactggcagattttgaaagaggctctgacagattaccggtgcagagctccgggatgacccaatcatcagcacacacttggtccagttgtatgattacttcactagaacagaatctgatccaagttgcatgcc

SEQ ID NO: 671456 - DNA, 273 bp, Homo sapiens
  misc_feature (46)..(46): n is a, c, g, or t
  misc_feature (83)..(83): n is a, c, g, or t
tatatatatgtgtgtgtgtgtgtgtgtatatatatatatatatgtntgtgtgtgtgtatatatatatatacacatatacatanatatgtatgggtagggaagggcattaaagagggccagaatgaggaacaccagaagatggcagagctgcatatgcagtagagagatgtgagttaagctgggttacaaccaaagaaggaaagagaatacaaagagtaagtagataaataagaactggtgtcatgaggaagtgccatctgggaatctttgctt

SEQ ID NO: 671457 - DNA, 212 bp, Homo sapiens
  misc_feature (14)..(14): n is a, c, g, or t
  misc_feature (17)..(17): n is a, c, g, or t
  misc_feature (39)..(39): n is a, c, g, or t
  misc_feature (84)..(84): n is a, c, g, or t
  misc_feature (207)..(207): n is a, c, g, or t
cgcaggcctgcgangcnctatggcgcccatgttgaatgnattggtcttgaagccccacttccacaaggactggcagcggcggtnggccacgtggttcaaccagccggcccgtaagatccgcagacgtaaggcccggcaagccaaggcgcgccgcattcgccccgcgccccggtcggttcccatccggcccatcgtgcgctgccccanggttc

SEQ ID NO: 671458 - DNA, 185 bp, Homo sapiens
atgctgggaagacgtgtatgagccctcacctggctggcctggtgctcaggaagctgcagtatggacagcagtctacctggacgggaacatatgtggccgtggacgaagtgtccggccggatgggacccaccatcacatcgtcctttggatgcagcactggcccgcccccactcctttttttattt

SEQ ID NO: 671459 - DNA, 160 bp, Homo sapiens
gtgatgtatcccacacttgacttgttagctcacgtctgaccactgcagtctgttccttctctgagctcactttctcatctggtactcagagctccttgttagaaactccagagcacgagccagaagggtggtgtggagggtgttgggcgataacatcacg

SEQ ID NO: 671460 - DNA, 370 bp, Homo sapiens
aagtgtacatctagtatcacatcggaaacatcgattccgctaagtagcaagggatgaaagcggtcgcgaatgtatgtggtcactgtgtgcatgcatgcagtgtgcattttgccgatcctgcataataagtgcggacatgtaagcactaaaaatatcattactgaaacaccataatgttaaagctgattgagagtgaaggatgagtcagtgattatcttggcgattaggactctggttgtatgtgccaatgaaacaaccattgtatgattaactctgcgatttgggttgatctatagacttcccctatgataatatctgactgcttgatagtcttatgcctcatttatgtagctaattccagtttagctac

SEQ ID NO: 671461 - DNA, 464 bp, Homo sapiens
aacagtagtggcagaactaggataacagtgactacgatgtattaagaggtctaagaacttaccatatttaagatctcataatggcggtgaagtaggtgggattattagttaccatattacagatgaggcggttttctagctgtcatgctacttcctcggtctatgctgttcttctcccttgtatctttcgcctgcttggaggctttactacaagactacttctcctgagtcttcttaagtacgcttgtaagtttgaccgtatttcagaacgtgggtcttgggtatatctggaattaattttatatactagtataagatacggacatctagttctatttggccccatatatggaaagacatttactttcaacagcttaaatttattgtcactgtctattcttctgcaacttctgcaggtatgagattggtgtcagattcgctgtttgctttgagttctgcttccc

SEQ ID NO: 671462 - DNA, 1014 bp, Homo sapiens
ggtgcataaagaaatagcaattgaacaataaatttatggaggggaggccatttttacttcctgcagaaagggtacactcagccagcagttttggcacgagagtacacaactaaggagatagggtcatttataacctgacgcgtccaccctactgctatgtccggtttccactggctgggatggggggggaattctgtattctgtcccgattggcgagcaacttagaattttttttttttttttgagatggagtctcactctgtcgcccaggctggcagtgcagtggccaggttctcagcttactgacaaggctccacctcccgggttcacgccatatcttctgcttcagcctcccaagtagctgggactacaggctccgccactatgcctggctaatcttggtatttttcctagagacggggctttacatgtgttagccacatggtctgtgatatcctgacctcgttacccgccccgcttgtggcgctcccaaagtgcgcggcattaccggcgtgagccaccagcccccgcaacgggccagccaatttacaaaccttttaaaccgacgcacaggtagcatcgagaacacaaggcgcggagcaagtacctcgtggaatgctgacaaaggtgaacaacttgtaacctcaggaacgcggcaaccagcgatatgaccctactgcatggctcggccccagtactaagcatgaccacgccaaataatatacggcaaaaggggggacgctaacacataaacgcacgtagacagctacatgcaggcacgcacaattttccgcatgctcaccacacgctgcgaccaacatcgcgcatagacaagtcaggtacatcccaagtcagcgccgagcttgaaggcgcccagtacgagaacaaggagcccaccatacagcgctcaacccagcacggccacggtagtcatgtgacacgacacctgacgcgcggcgcggacatagccaatcccactgagccctgcccagcgaccaacgcacacaacagagc

SEQ ID NO: 671463 - DNA, 1319 bp, Homo sapiens
gcgcccacctcaggactgcagctgccggtccagctgctcccgctgggcccacagccgcgctgtggaaatggagcggacagtgccagatggctctctctgtggcctacaatgtctatgtgctagtgcatgtgtttcctgagtcccagtgtgccttccagagtgcctgagctcacagctgctggcccacccatgcatcctgtggtggctgctgtgagtgggcagctctgcccaagcagcggtgaacaggccattctgctgtggcgcgtgtgatgcgctgtggccctggcctgccttgtggctgttgtcccttttctgctgtgaacttgacgctcacttggcttcctctcttccagactggcagcggcactgtgtggcctggctcagcaaagccatcatagccaactgctggtcccattcggatgcgctgtggcaggtgctccatcttatggcctagcacgccatatacttttcattgccctatcatttcacaagatcatccatggtgacgacttaccgatagagttgactcatagcacggacgtgaagcatgtttgcactgcacatatccagctcctagtgcgtattccacatgtgccccaaccattgcttttggctaggtgcaacgggacacgggacaactcgcgataccagcacactcaccattggttgtgcacggcaggatcaacacaatcacacggtgttcattcgacacactaccttcttgcgcacttcacataacccaccagcctgcggtctttccgtgaaccgtttaccccatctgcaaactgcacagaaaatgcccgcaccacaaccaacaccctatttccacgcctacaccgataactttctaacagttgacctttacccacaattgcctaaccgaatgacggagagccacttgccagatccaggccaaccaggcaaagtgggggtccatgaaatgtagaatcccacgataactccccatcttcctgtggtcacttacgctggggggcagaggaacattccctgccaccctcattcgagaaccgcaagtaccaccattcccgttgtatcaacttacaacatgtactaacttgtcgatcactcagccagcaccgacaaagagcgcgccagcagatgaaattccattcggggcccgcgaatcctgagcaccgcctttatgaaggtgcccccaacgagcgcagcaacgtcaggagtgagtcgagctcatctcagagcagccatcgcggctgcctgcccgcacactcctcgtgacatcgtctccccgagtcgcctgcagctctcatctcctgcttttattagtcttcagagtacgg

SEQ ID NO: 671464 - DNA, 137 bp, Homo sapiens
ctacctttacgggttggaaaagacgacagaagggtcaaaaagctccaccccaaaaggcccctgttccaaaggcttttggcagaaaaccttaagtggcattcttaaaaggtattaagggtctttttggccctgctgcc

SEQ ID NO: 671465 - DNA, 560 bp, Homo sapiens
acgtgtacctcgccctcacggggcacaccgctgaagagtccagcaaccaggaagaggtgccggcatgagcgcggccacgggtgccattgccatcgaccgcgcggtccccaagccccagggcgcgagccggctgcggcagatcaccacgctcgttcggcgcaacctgacccacatcaaacgccagcccgagatgctcaccgacgtgacggtccaaccgatcatgttcgtgctgctcttcgcctatgtcttcgggcggctccatcaccatccccggagtcgactacaagccgtggctgctgcccgggatcatggcgcagaccatcgccttcagcgcgttcatcgttgcgatcggcctcaacaccgacatcggcaaagggatggtggaccggttgcgctccctgccgatctcgcgctcctcgatcctcatctcccgctccgtcgctgcgctcttccactccagcatcggggttccggtgatgttggtgaccgggctcttcatcggttggcgcatccacgaggggctgctcaagggtctgcctcggaaatgggctgctctcctg

SEQ ID NO: 671466 - DNA, 547 bp, Homo sapiens
tctggatgcaaagtgtctggagaaaggaatagcaggaccctatcaatgtgaaatacgggaccgatatggtgggatccgtcagatgacccagtcaccctgaatgtcctctatggtcgagacctccccagaatttggccttcattcatctattaccgtgcaggagaagtcctctacttgtccttgttctgcggactctaacccaccggtacagtattcttggacaattgaatgaacagtatcagctcacaggacaacagcgtctttatccgccatatcactacaaagcatagcgggctctatgttcgctctgttcgtaactcagccactggcaaggacagctccaagtccatgacagtgcgaagtctctgactggacagttccctgaattctactagtatctccaattccattttctcccatggaatcactatgagcgagatccactctgtaccagaagccctatcagctggaggtggacaactcaatgtaaatttcatgggaaaagccgtgtacgtgacgcatgagccactcagaagtcagcaatgta

SEQ ID NO: 671467 - DNA, 466 bp, Homo sapiens
  misc_feature (29)..(29): n is a, c, g, or t
  misc_feature (125)..(125): n is a, c, g, or t
  misc_feature (128)..(129): n is a, c, g, or t
  misc_feature (133)..(134): n is a, c, g, or t
  misc_feature (142)..(142): n is a, c, g, or t
  misc_feature (150)..(150): n is a, c, g, or t
  misc_feature (189)..(190): n is a, c, g, or t
  misc_feature (194)..(194): n is a, c, g, or t
  misc_feature (201)..(201): n is a, c, g, or t
  misc_feature (203)..(204): n is a, c, g, or t
  misc_feature (208)..(208): n is a, c, g, or t
  misc_feature (211)..(211): n is a, c, g, or t
  misc_feature (219)..(219): n is a, c, g, or t
  misc_feature (223)..(223): n is a, c, g, or t
  misc_feature (225)..(226): n is a, c, g, or t
  misc_feature (262)..(262): n is a, c, g, or t
  misc_feature (268)..(268): n is a, c, g, or t
  misc_feature (274)..(275): n is a, c, g, or t
  misc_feature (277)..(278): n is a, c, g, or t
  misc_feature (288)..(288): n is a, c, g, or t
  misc_feature (294)..(295): n is a, c, g, or t
  misc_feature (335)..(336): n is a, c, g, or t
  misc_feature (338)..(338): n is a, c, g, or t
  misc_feature (340)..(340): n is a, c, g, or t
  misc_feature (345)..(345): n is a, c, g, or t
  misc_feature (366)..(366): n is a, c, g, or t
  misc_feature (405)..(405): n is a, c, g, or t
  misc_feature (441)..(441): n is a, c, g, or t
gaacactctacaagaatgtaaacccctgntttaattccatgattttatcatgccagaagcatggttggttttagttttttaaaacagatattggtatcataacacattggcttattaataattanggnntttnncatacacngtatctcngtgtgaacaaaaaatgtttaatattgatttttttcaggnnttanactttcngnntttncancataaganaatngnngcgcacatttaagtgttttttttttttaataaaacncaatcntaaaanngnnaaggggggtnggggcnngggggggccggggggggggggggggggtattttttcccanngnanaaatnatatttttatgcggggttgcnttaaaatccagtagttcttaatgttaccaaataaccatntaactcccaaatgcagcaaaggtgaacaatcttcanagtgcactttcacctcaatgaaatt

SEQ ID NO: 671468 - DNA, 813 bp, Homo sapiens
acccacgtcgtacggtttaggaaacaagtttgcctgccattggtactgtaattaagagtcatccggaatatggagaagtaattcacactacacgggtgaccacacgcgaagaacatatgccagttcctcgtagagtattggactggctaagggaccgatcagctggagagggttcaatggtggtcttctaaagtgctgtgtggcctcactgatacgcttaaggtgaggattctcccttgcaaatgacgtacgaactttccccttctctcccttgctacacagggtttaacaaaactcacagcttgtataatgtaaccagtttggggtccaggcgttctgtaagcttgggactatgtgtgagatcatcgcctcttcaattgcaattaaaacctgaagaggaagcaggccagtaatacagataatacacagaaaacatagatagaacataaaaaaaggacatgatcattgcatgagacatagagaaattagaatagaactgactaacaggcgtgcgaggcccgtgcggacttgactatcttgcccaaccgctgggccacactgttccgccgaagggccccaccccgttttgagttgccccagtttcgtagaggagccctacaaatgcggtacgcgtgactctctctctgtaacctcatggaagaggaggacctgctatttcactcaaaaggttcgtccccgtatgtcgagggaagatttccagctgaaccgagccgtcgttccaagaaccccagcgaccccagtagatcttccggtgcgaggcgggaacatcaagggcgtccaagcctgtgcgct

SEQ ID NO: 671469 - DNA, 450 bp, Homo sapiens
  misc_feature (208)..(208): n is a, c, g, or t
  misc_feature (274)..(274): n is a, c, g, or t
atagatatatttaaaaattatatgtttataaagttattaatttgtaaaggcagtgttacaaaatgttcagtttatattgttttagattgttttgtaatttttaaaggtgtaaaatagcatattttttctttatggaaatctataaaactttctgtgataaaaagttttcattttactggtaagatcatgcttacagttttgtgacctncagaatatttgtggcatattttttgcacacaaactactattgtctgagactaatgaagacatgtanaaaagttgtttaccaatgaaacaacagcggaatccagtatcggaataaacacagtcttattcacagactgtgaggactaaaaaaaccacatagaatggagctgtaacttaaattccaaactatggatgttgacatatccaaaaaaacagttgtattgggctatttcgtatgaagaa

SEQ ID NO: 671470 - DNA, 123 bp, Homo sapiens
ggtcggtacctgcacgtttcgccacatgaccaacgtgcgggtgcactggatgaccagcatgttcgaagggctggacgacgatgcggagacccgcaaaatggtcggcgccaacatcgccatgga

SEQ ID NO: 671471 - DNA, 966 bp, Homo sapiens
  misc_feature (817)..(817): n is a, c, g, or t
gactaacaaaagtaatctagcaaccatgaacgtgggtgagaagtcgaattgtttttaattgttcctactaaagtctgactgaagtccgagagacactgcatagaaatgaatatggaatagcttcctagtatcggattcttaccaatgtactgcagagataagtttagctgacctgagctaccatacttgtattcgcgccacgttgggttcaaggaaggccagcgttagcagatggagatgtagaggcagacagagtggtggacatacgatggctatgatctgcaagttcgaggaaagccacgtggagatgaacagtcttcgagggtggtttaggaagaacgcagctacgctgctctttgctgggaaagcaagctgttcggccattgaggacagaggaaattttctgggaggaacgtagcgtgcactacttcatgactgcatgcaggcgcacacacggtcgaacgagggacacgacataacacctggtctgaatctctggctacctatcagaagagagtctcccacctctcagtcactccgaatgcacgcaacgtgttgtcccaaagccttgctcagtagacgctgttcccacatgaggcgtgatggaaagcgcaataatgcagatgcaagaaccaggggcatgaccagtttcactgcaaaccatactgtttcagtttctaggtgaaggaactacgttccaacgaaagggggcactcccccttacccgtggtattggcgaccttagcaatgtttcgtgtcctctttgggggcgtgcctcggcggtatgaccgagaaatctaaaggtgtccacctcatntgctgtgcgagacagcatggacaacactgccacggtttgacactgcgttcccaagagcacacatggcatggcaaacagtttacgcgcagaacggtaagacgaagagccagcctgggttaaactcaaacgatgcactgtgcacgcaattg

SEQ ID NO: 671472 - DNA, 1059 bp, Homo sapiens
ggaggaactgctgcgggtgtcccagtgacctgctgctgtctgcccactccacgctgcagctggccctgggcccggggccagtgagggccctggagacgtggacagtgacagcccaaggtgggagctgggtgaagggtgtgtggtgcctcagaacgtgtgtgagaagatgtgaagacggaagaagaggatgacagaagagagtgtgcagaagagcatgcctgggggctcagtggctgtgccagtgtgggccccgagggttgtggcagtgcctggctggtggtaccagctcatgcagagctcccagagtctacatcgattgtgctccattgaagggttccagtgttccctcgtggtagcagcaacaagacagcagcagaagaaaaagaaatggggcatggaggtgcggtggaccatcccgcaggactccaacagacccgagagggcacgttaagtgggagcgctcgggctggacgggccttgcagcactgcccctcttgaacgacgtgccacttgggagaccagagagacacggcggcctggagacctctcctgcgtccttggggcgacagccccccccaatgagcatcatgatcgcatgagccgcgacgacttgaagtggccccaccaaccgtgagccagaagggcgacaagggggcccacgcgcaagtgcaccagacgacgcgaagcgaacgacagaggagatggacgcggaagcacggggcacgtaacagaaaggagctacgcgccatggaggggagcagaccaggcatgggcagggacacgacgtactaatggagactctcgcagagcagagggagcacagggaggcgaacggcggccgaggaagcaaacgaagacgtagcggggcaaccacaatcagggcaaaaagggacagcgaagaacactcggggacaagagagtcacaactaggcacccaccagcacggtagaccagggcagacaaagcagagcgacagcacccagagaacaggggagagacgagaacgagcccagaaagggaggcagaccataggacagagaacccaccagaagtgacgcc

SEQ ID NO: 671473 - DNA, 428 bp, Homo sapiens
atctctgctcccagattccagacaactgcctacatttctgtttcatttggatgtcaaatgggctttcacaattaacaagtgtgagaagaaacccttgattttacagctcaagtcctacctgtttctaccctaggatccacatctcagcaaagattcctcccaggtcaaaaattctggggtcattttggctccctcccttttcctttccttcagttggggtcagcaaatacagcccatgggacacatacagttttcttggaacacaaccaacccgttcctttacatatcgcctgctacaagggcagagtagagtagtggggacagagactgtagggcccacaaagcctaacatgtctaccctttgtctctttatagaaaaagtgtgtccccccactttacagtcaacctgtggagtcctgctgactatt

SEQ ID NO: 671474 - DNA, 119 bp, Homo sapiens
atcagacagaacattaatctatacttccctaaacaatgataatgcgagcagtacacagagcctccaatggtgaacttcaaattttacatcacaattctattgtccaaatatatactggt

SEQ ID NO: 671475 - DNA, 536 bp, Homo sapiens
gagagatggaagataagtgggggaggggagcaccggctctgacaagaggattaggtggggaagttgagtggtggatcagtgagtggaagagggagaagctggtggaaagagaacaggcctgtgaagcagaggggttgggggcagaacatcgtggcccagtatgggggtggtgggtgtagctatgtcttctctttcctcttcccaccgactttactctttggtcccctctggcctgggctgttgagttggggctcagtgaacggatggggacgacctcaggtgctgaagcaggtgctgaagcagggtctgccgtggggggaaggtggagtgggcagggcttctccatccctgggggaagaggcaaagcagacgcagaggccagggctggccaacaccctggttcaaagatgctcccaccccaggtctggggagaggaggggagaggctggggctaagatctccctttctgcacctggatcccctccacagcctgggccattctgtctttgtttctgcaggaacactgccctgaaact

SEQ ID NO: 671476 - DNA, 1020 bp, Homo sapiens
ggaagactgaagagtcgaggcgcgggagatctggaacacggtcatgtaccatgcactggcggctggtgcccaatgcacgaggaggaggctcttcacccgcgttcacgccggcgccggaagacagactggactccgtgccgtacccgacctctcctccgggccatgattatcgcagaacgacaggaagaatggagacaacaagctccgaggtagcccatgctgaatgtgcgagaggatacgcatggaatccctgggattacctcatgcaacaacaggaagacaatcaggacagggccgaagggcacactcctcgtctaatgaatgccagaaccagtcgggatgtgccttagtgggcgtgtgaggcagtggtggtaccttgattgatgagaaggaaaacgtctttgccattacacctcgatgtctgcctctcggagcaggagctcaccttccgcgagcgtgttctagagggtcctgcatcttagtccggtgagagggctggtggccaatcagtctacctgttgcctttcctctggcccttggatgcccccatatcccaactccgaaggggccaaccgcctggggaaaagccgggaagcgctcgttcacttatcccccattagtgctctctctgctctggcatccgggcagacagctatgaaaggcacatataagaggaaaccgaacgttcccagaacatcatcaattcgaatgccaccaactcactaaataacaaaccgataatccggcggcgaccgtaaagcttacatcacgaggggccccccaaatcgtctggctaccgcgcctttgtagaaccgggccataaacgagtgccaattctcaacacagcgcggcgatacataacatccctgactggacctgtctaccgcggagcttgagagacactcaatcggggggcatacatgccactatcatacatctttcacagtgtcataacctatgtcgttgatccacgcctcctgcgaatcgctagcataataaaatttcgaggcttatctataa

SEQ ID NO: 671477 - DNA, 702 bp, Homo sapiens
cagtggcctcgaggctgtggagatcctgcaggagcgcgagaacatgctgcttgctcgcatcgcacaccgaattcagcactgtggaaaccttcccgggtccctggccggggatttgcgaaccaaagcgaccattgagctcaaggccctcaggctgctgaacttccagaggcagctgcgccaggaggtggtggtgtgcatgcggagggacacagcgctggacacggccctcaatgctaaggcctacaagcgcagcaagcgccagaccctgcgcgaggcccgcatcactgagaagctggagaggcagcacaagatcgagcaggagcgcaagcgccggcagaagcaccaggactacctcactagcattctcccgcatgcccaggatttcaaggaatatcacagatcccgtccaggcaaaatccagaagctgacccaaggcactggccaactaccatgccacaacggaacgggagcacagaaacaaaacgaccgctcaaaaacgagccgatgcgaaggccatggctagaaatgagaacgagacccccagctcatcgccccagaaaacgccagcgcgtggcctacatccgccaccacacgacgccgacccgggctacccccaccgggccgctcccgcatcaacaacgatccccaggaccggcagaggacaaacgaccccacgaaccccccacgacgccgcaccaggcc

SEQ ID NO: 671478 - DNA, 845 bp, Homo sapiens
  misc_feature (20)..(20): n is a, c, g, or t
  misc_feature (33)..(33): n is a, c, g, or t
  misc_feature (41)..(41): n is a, c, g, or t
  misc_feature (211)..(211): n is a, c, g, or t
  misc_feature (219)..(219): n is a, c, g, or t
  misc_feature (221)..(221): n is a, c, g, or t
  misc_feature (231)..(231): n is a, c, g, or t
  misc_feature (257)..(257): n is a, c, g, or t
  misc_feature (261)..(261): n is a, c, g, or t
  misc_feature (267)..(267): n is a, c, g, or t
  misc_feature (284)..(284): n is a, c, g, or t
  misc_feature (307)..(307): n is a, c, g, or t
  misc_feature (370)..(370): n is a, c, g, or t
  misc_feature (399)..(399): n is a, c, g, or t
  misc_feature (417)..(417): n is a, c, g, or t
  misc_feature (420)..(420): n is a, c, g, or t
  misc_feature (467)..(467): n is a, c, g, or t
  misc_feature (474)..(474): n is a, c, g, or t
  misc_feature (514)..(514): n is a, c, g, or t
  misc_feature (522)..(522): n is a, c, g, or t
  misc_feature (524)..(524): n is a, c, g, or t
  misc_feature (562)..(562): n is a, c, g, or t
  misc_feature (569)..(569): n is a, c, g, or t
  misc_feature (581)..(581): n is a, c, g, or t
  misc_feature (597)..(597): n is a, c, g, or t
  misc_feature (618)..(618): n is a, c, g, or t
  misc_feature (632)..(633): n is a, c, g, or t
  misc_feature (665)..(666): n is a, c, g, or t
  misc_feature (674)..(674): n is a, c, g, or t
  misc_feature (677)..(677): n is a, c, g, or t
  misc_feature (716)..(716): n is a, c, g, or t
  misc_feature (743)..(743): n is a, c, g, or t
  misc_feature (747)..(747): n is a, c, g, or t
  misc_feature (749)..(749): n is a, c, g, or t
  misc_feature (788)..(788): n is a, c, g, or t
  misc_feature (790)..(790): n is a, c, g, or t
  misc_feature (806)..(806): n is a, c, g, or t
cctccataacggaggaatgnagccaagagtgangaaagaanctgtatctactccatcacgaatggcccacagggatcaggaatggtatgatgctgaaattgccagaaaactgcaagaagaagaacttttggctacccaggtggacatgagagccgctcaagtagctcaagatgaagaaatcgctcgacttctaatggctgaagaaaagaangcttacananaagccaaggngcgggagaaatcatctttggacaaangaangcaagnccccgagtggaagccanagacagctaaagcagcaaattcnaagtcaaaagagagtgatgaacctcaccattctaagaatgaaaggccagcacggccaccaccncctatcatgacagatggtgaagatgcggnttacactcattttacaanccngcagggttccacacggcatttctcaaaatcagagtcctctcataaangttttcnttacaaacattaaaaacctaggaatctgccttgaaaatgnactcactntngcaaatattactgggtgatacagaatgaattctacacntactttntttctcctgtgnttgcattcctgggatntatcctcaagtgcatttctgnccataagtaatttnnattcatttcaaatgttttggttattcatgttnncttgggcngtntaagaaaatgtagcttctgaatattggccacctctatgntgcatatatatcttgggatatagtatntaananctttgtaaactgccattttgttaggtatggagtttggtntntagggagtaggccttntttagcaattcataacttcataggggatgaatgatacaa

SEQ ID NO: 671479 - DNA, 301 bp, Homo sapiens
cttcctgaacaagtgcgacacggtggacgacgccgagctgctggagctcgtcgagatggaagtgcgcgaactgctgagcaagtacgacttcccgggcgacgacacgccgatcgtgaagggttcggccaagctggcgctggaaggcgacaagggcgacctgggcgagcaggccatcatgcgcctggctgacgcgctggacacgtacatcccccagccggaccgtgccgttgacggcgcgttcctgctgccggtggaagacgtgttctcgatctcgggccgtggcaccgtggtgaccggtcgc

SEQ ID NO: 671480 - DNA, 316 bp, Homo sapiens
tgctgtcagtttggtgtggaggcctatgttttgccccataccccccccaggccctggttatgggaaggaacccaggcctccagcccaaaggactgtgcccccctgtttttggccgtccacgtttcctctccctttagccccagcaatacatttccctggcatggacagaaaagccagagagggcttgtccaaaggctttgtaaaacccaaggctagcttctatctttgtttactgttatttcagcccagggcgggtaattaacctccttggaactagcttttaggaaaaaaaaaaaacttggttttttttccccca

SEQ ID NO: 671481 - DNA, 549 bp, Homo sapiens
tgggatgaggcaggaatcaaagacagatacggcgacatagggtgccccggctccaggggtctcgcaagtgctatcgggtgtgcattaccccccagaacgaaaataccaaatgtgctgtggagagctcccgttgaggtggttaataggggtgatagaccgtggtgatccatcggtgagtgctcttattataaggggaacgtgtgtgggctattataggcttatagttggccctgaagttaggaaccagatgttcggatacagtttcacttatagctacccccaaggtgttagtgggcccggagcgaggagagttagcactctggtgtgcgggatatggatttcacggaggagtgggtggtcaagggacccctatcgtgagggggggtcatcacatggggggaccgaaagaggggatttggagcgtggtaatgtggtggcatatgtgttagcggtgtaaatgtgggcttttagtgtgtaccatagtgtgtagcgtgggtaaagggggtggggataagcgattgggagtggggatattccataggtggggtg

SEQ ID NO: 671482 - DNA, 127 bp, Homo sapiens
gaagaggtagatatgggggcggagaatgctagaaatactttgagccatggccttgccagtgtccgtgccctccagttgtcaaatgatttggggcactgcccgtcgaaatggaaaggttggtgctcag

SEQ ID NO: 671483 - DNA, 316 bp, Homo sapiens
  misc_feature (93)..(93): n is a, c, g, or t
  misc_feature (104)..(104): n is a, c, g, or t
  misc_feature (110)..(112): n is a, c, g, or t
gggcccagccccacggccacgggcaccctgggccgcatgcactattaatgatgggccccggctcccgctgcaaggcgctcggggtaccggacntgcacattagntaaaannncccccacacctttggaatgcctcggcccccacagctcccaggtggtactgggggtggaccgccaccccctgaaaggctcccttccccagtcctgccaaaagaccccgggggcggggagggggcagcatgcagggtccccactccctttttggggtcgatgaaaaggtgaagtgaccaaatgaaagaaagctgcattttcagtga

SEQ ID NO: 671484 - DNA, 1015 bp, Homo sapiens
agaagatttcataatgtccattctcttgtcattcaggtccagaaccatcaagattattagactgagtgagagtctatagaatccatactgcacatgggtcagtgaaatgtgtacctacacatgctgcttgcaagacaatattgaattgcgctggtattttacccgtgctcatgggtatgtgtggcgtataggatggcgtatgagctagagtatatgcgccaagaatatgagtgtgcgagtacaattcattggtgtcctagctcatttcataagcaataatcaaggaggttatcgaattgtgatacaaagataaatggatgcttcgaagtgcgtatgtatgatccggtttcatggtgccttgagccgtagttcttaggtcatccttgtttttattttgctcggctaggtctttatcgacttggtgggtgacctcctggtgattaaaacactacgagcttgctgttcttgggactattttgtcatttctctttgtttttaactctgcctcggattaccttgttgagcccgtgtaattgggtttattctcttcctctgagagcgggccttgtcagtggtcttggtctttagggtttgtgtgtcagaggggcttgattggatttatgccggcttctgattgttgtgcgttgttgtccatgttctccatggtggttcactttgaggatagccccgtgggaatcctatggtttctacctgcgtgtggttcctcataagcattaacatttcatttccaaggcatacacacttggttgtgacacagcatgttctttaggcgcagaggatcccaaattaggggcatatggcttagcaagaccggttctataaatccaactcactgaaagggatttttcagaaggtctgactaggaaatcgaaccaatgtttgtaccagggcaaagggtcccttacacggtctataacaaggaacgacgttatgaaccacaggttaaacacgataacgtcagaataagctcggcacaacattacccagatgtggc

SEQ ID NO: 671485 - DNA, 479 bp, Homo sapiens
  misc_feature (25)..(25): n is a, c, g, or t
  misc_feature (36)..(36): n is a, c, g, or t
  misc_feature (167)..(167): n is a, c, g, or t
  misc_feature (189)..(189): n is a, c, g, or t
  misc_feature (206)..(206): n is a, c, g, or t
gagccggatgaagtttttacttggnaggtctcatangttttttatagataactcgtgttaatttacacttcctaaaatatcaattttacttccacttaatatttgatttctcatttttggcagagtaaacaactttttgaagctatgctaatgctgtttgtatcatnatattcaactcctatcacctanctaatagatggggatancttacagtattcaagtatacttggctttagggtccatttttatacttacattcaaatatgggtatatgccatactgcatcacatcaaataattaagcaacaccataatgaccagacccaggaaattctgtaaagctccccaactttcttgctctctacaatgcatgcgtaagtactctgcgcttcccaccctatgcaggggataaactcagtaactttcaggctgaaatcctactgttccctcttcatcctccccaaatccttccccccagtc

SEQ ID NO: 671486 - DNA, 392 bp, Homo sapiens
ggggattggtaaaaggtctgaatttggtttaaggtctggattaagaagctttaccaataggaatggatcgatggttgaataaggatttttaatccatagatttataaaatccagccaggaaaacttaaattacttttcttttaaaatatctaacaattaatggggaatttttaaagactgatcttagaccaagtcaaattcccattaatcatttagttattttttgaggttagagaataattggtccatattaatttagaccttggatattaattaaagcaattactcacaatggaagtgaaggaatcaggagaaaagccttttaaaaggtattctccaggtttgtcagggtcactttaaggatacagatggtggtgacacaggttaattct

SEQ ID NO: 671487 - DNA, 387 bp, Homo sapiens
cctggaggccttcggcctgcctgcctgcctgccttaggtcccccctgccagtcccgggccctggaaagcagattctgtcttgttatgtacaggaggaccttttaaaaaaatccagtttttattttttgctggtagtccgcatacccatcccctctgttttttaaggcaaaggccaatcagtccccctttgtagcatggccccagggttttaggcctagtcctttcattcctccccccctccgaaatggtcagtgtgtcatgggaagcccccccccagctttgccagtgctttttgggcctggctcccagtcagtggtggccccgattcgggacagggcatccctccttcccatttacgggtgttttcaataaacaatgttcagttta

SEQ ID NO: 671488 - DNA, 1049 bp, Homo sapiens
  misc_feature (1)..(1): n is a, c, g, or t
nggcctccccccaagggcgcctcccgccggcaatctacggtgaaatcctccctgagtccctgaacgcaatacggcactctctccaactcccggacacgcccatgtcaaagtaagggttagactccgaaaacgcgtaaagcgggcccacccgtcccagttcgggagggcagcagcgacccccatctaggcccagactccaagccggccgccagtatcattcagaggcctcccctgcattccccgccagtcacgtgaccagcccgccgcaggaacgccgggctcacggtgtggtccccgaccagagggagcatcttgccaaggctcaggaggggccagaggacccccggagccctagtacccactagacggtaagactaccagatggccctgtcccaacccctttgcaaccggtcccccctcaacggccaggctcgagagaggcaggggacgatacgggggagcagacccctgagatctgggcataggcaccgcattctgatcttggacaaagtcggcacagcaccatcccagcccacgaagcccaggcgccatgccagcaggccccaccacggaaatcacacacaccgcaccagaccagcacgcatggtacattctgacatgcgccacccgacggacctgaatcttggtgcacgcaccaaccgcgagcctgcatggcgggactggagggcacagtagaggaaggagggtgggttaagaaatacagtcggggccctctcggctgtcccttgcccagcggcatcttgcattccagcctgcgcggcatttgctctatcgattcccctttcctcctcactgcggtcctcaagcccaaccgatactccaaaataatgtggtgcacttgacttgtggaactatctacacagcagtaaatagtaaatgaatcccgacctgtgtgattcaaacactttgctctgaaaccccccttgcccctcactgatctgtgcttttcactggtctcaagtgcagtagtggtcaatatttgtggtaatcgctaattgtactgaatttccaagtgtgcattgtacaga

SEQ ID NO: 671489 - DNA, 480 bp, Homo sapiens
  misc_feature (409)..(409): n is a, c, g, or t
gcgaattcactagtgattgtgagctgagatcgcacccggtccaagcactggctttgagataagcaatattaaaaacattttcagcttcatcagatgctgactaactgacctccaaccactgttccaccagccataactacagctttggttggacaagtgactgatttcagtaactttttcctgacaaggtgactacccatcatggactggttctggctggcttacagagctcctgcacttgcatgtctttgtgtcctgaaaagaccttttgccatatagggcctaattataatacatttaaatgttaagtctccaccccaaagtgaccatgggttgtatgttgcatgcatgtttgttcaatatgcatgtgtcagaaccactttcatgaatattcatagctcctcatgtnacctgttgaatgtgtatgtttagtccatccattgagcatgaagctcctaccctaaaccctccttctttgaa

SEQ ID NO: 671490 - DNA, 347 bp, Homo sapiens
tgcttgctccttctggaatgttctggaaaataggtttcggggctggatgttttccgggatgctgactcacacgcaaatcatagggtgacataatgtgtgcatgtgtgtgtgtgcacagatatgcataggtacgcatttatgtggatgtgtgtgtacttgtgggtagatgtgtattgtatgattgtatgtgcatgtctgtatgtatatgtatatgtatgtgcacgtgcatgaatgcacacgttaatgggtacgtgtgtgtattcatgcatgtgtctggataaatatatgtgcttgcatgtgtgtggaggcgcaaatgtgcgggtatgggcctgcgtgtgttagacatg

SEQ ID NO: 671491 - DNA, 1005 bp, Homo sapiens
gagttattcagaatctaggattcagatccatctagttcttctctagaatatacgtagtgtgtgctagacgagtatgatttgaacacatcttctcattacaccgcccactgggagcagccttggaggaatgcctagacctttggggactcgccaggcaggattagtggcaggaagttgaggagaacagaggccccacagagactcctcggggaccgtcccccagtcacaagagttatctcaaggaatgtagtctttctcccacatgcctcctaaagataactaccagacgggtcacgtctctactgagcccttctcatgtgtaggaaagagacaagtcgtcacaagtcttccgccaactcaacacctgacgtttagcctttctatgagcacatacgatctgttatgggcctcagctgtacgtgctgacgtcagagcgatgctggtacctcccaggcatattattgggtcaccatgaagcaggatgaaaccacaagtacacttagcgtggcagacagctggatgactctagactgagaatcagcctgagtcttaacacagctggggtctgctactcgcgttaggtaggacttttgtgtaactatttgtacccgctaggacagaatgtgacgggcaggatgtaacacacactagaggagcgatgtgtgtcgtgtgcatgtgtgttgcattctgcagggacagaccatgattccatctttgaagctttcttcctatagatcattcagctcatgatcggtgttacttactcaatctcttgatgcttctgatgtccctcgagaacaaccttgctttgcaacctctgcgcaggtgttctcaattttctagagagtgcccagagcggggacgagacgcacgagcccacgcggtgtcgatcacgatttgccgaaacgcggcctgtaggtacacaaagggaggacacagtcgcagggggctccccaattagagactggcgtgcagatgccgctaaccaccggccccctgatgaag

SEQ ID NO: 671492 - DNA, 340 bp, Homo sapiens
  misc_feature (5)..(5): n is a, c, g, or t
aagtngtcatgctatttcttggcctgtgatctaaagacaagcacctagtctccttgttctctgtatatctccattgcccagctagaagggtggaaacagttgtgcctgttcctgggttgaagggtggcaaataggttggctgggagttggtattctgttcccctcattcccgggcagccagtggatgcttcattcctgaactttctcccctgaaacccagtttaagcatcagaaatccttactggacaccagtgcctaagacagctggtaccaaaccagtgtggaaatttgggacatcaaaataaaacctatttgccatcgctgggtagtccggcgttcc

SEQ ID NO: 671493 - DNA, 883 bp, Homo sapiens
ggagacggtatctcctggatgccagtgagcggctgagagctgaagctccctggacactcaaggctcttgtggtgacagtctgacgtaaaggcgtgcagggaggcctagctctgtctcctggacttagagatttcagatcgcagaagtctgtccatggctccttgtctcgtccgctagtataccaggtagtagtcgaccgccagtgggttgtgggcttgctctcccgggggatggccgagcatgccccaggccagccttccggcaattgccggttgaagctgtgctcgtaacccgctcatagctccttacttggggggcccctcgccctactcctggtctctggatcctggcttctacccctcttgtacagcattcagcctcgttccctgtccctggtgggttcctatgtccaaaaaatcctggacggagtatgtggacatgacatgtgcacagacatgtctgacattaccaagatcctacctgaggtgagcgtggctcctgcttctgggtggctggagtctgaagagaaggtggtgggcatggtaggagctctgcctgtggatgatcccactctgtgagggagaggcggttgcgcgctgttctcatgctcgttgtggaccgtgagcacccgtccgtccggggagatagcaaaagcctgggtcgggactgatctcccagtttcgcccgggcacgtggtaccgtgaagttatcctgggagagcggacaaccaacttccctgggtatgggcccttaccagagctgggttccgcaaacgggccagtcctctttctgtgtgggccggcagggcttcgacaggctggcttccgctcccttctaggggggggcgggccctctggtgtggcgaaacactcccggggcgccg

SEQ ID NO: 671494 - DNA, 144 bp, Homo sapiens
tcacgtactccgcatcaacaagatgttgtctgtgctggggctgacaggctccaaacaggcatgcgaggtgcctttggaaagcccaggcactgtggcaggttacacttggcagtatactgtcatcgcacagctgcagacagagca

SEQ ID NO: 671495 - DNA, 361 bp, Homo sapiens
  misc_feature (19)..(19): n is a, c, g, or t
  misc_feature (71)..(72): n is a, c, g, or t
aagagatggggtctcactntgttgcccaggctggagtgcagtcacatgaccctagctcaccgtaacttcgnnctcatgggttcaggcgatctttggcctcatcctcctgagtagctgggactgctggtatgtaccaccatgcccagttaatttttaaaaattttatgtagagatgaggtcttgctatgttttccaagcctgtaaataaagctttattagaacacatccatgcccatacatttacctagttgctatgggtggttcgggggaccgcgagggggcagcgagggggctgggagcagggcgctgttcgtccgtcgggagcctgaaagatgttccaaatggtgtctttccagaaaaa

SEQ ID NO: 671496 - DNA, 108 bp, Homo sapiens
agtgcggatatgagtgtgagcgatatactagttattcctatgaagtgagatggtacaatgctagtataatatttatgtaaatgaggggcaacaacatagtcagcagca

SEQ ID NO: 671497 - DNA, 1918 bp, Homo sapiens
  misc_feature (1)..(2): n is a, c, g, or t
  misc_feature (309)..(309): n is a, c, g, or t
  misc_feature (1295)..(1295): n is a, c, g, or t
  misc_feature (1411)..(1411): n is a, c, g, or t
  misc_feature (1442)..(1442): n is a, c, g, or t
  misc_feature (1475)..(1475): n is a, c, g, or t
nncgtattatactcagttgttgattgggtggcgtctgatcgcgatcaactactgtgtgtgggcgtgtacttcactcaggtgctcgcttgctcgtcggtttttcgcctcttttttactcgtggtggggttgcctacaatgttgttttgtcggcgtcctctcctcgtcgtggggtgcctcatttttgtgggtggctccccccgtggtttgatctcccccgtggggtcactaaattttttccccgccatttcgtgggtggtggcatcttgatgcgtggcccccgcacatatattttgtggtggcactaccgnggttgtttcacgccgctcggcggttataatttcctgccgccccgacacagaaaagtatgtgttttgttaaaagggacctccacatcggggcgtttctttggtagttccctccaatgtagtatgtgtgtttcggatgggtgtcccacgcacccctttgttgagtgtgttattaatgttggtaattgtgtagtggccctgtttcttatttggggacctccatttttgatgtgcccagatacatctgttatttggcgccccccccgcctcacatacgttggttgtgaccgcccctcttttttcggccccataattagtgttgggccctctcttttgtacctccctcggagtttgtggggggaatgttagtatttattgttcgtactccccccgaccaataatttgtggcgggaccacaccaccaacaacagcggtgggagtggggcccccctctccgcacattctccgccggagattttgtttttgtgagggcccgccgcttgtgtgtggagaccctcccgcgcctcctcgtgagaagagtaggcgacaacatcatcgtcgcgtcggtgagtacatttggtgggaggtggacgcttcctcttcttgtggtgaagagaaacacaacatggggggggccgcgcctcataaacacaatcgtgtggtgttgcgtctgtccgtcgtgcaacgtctcttcaacaccgtgttgtcaacaatagggcgttttctccacaacaacgggggggcgtctccgactcgtcgattgtctttacactactatagtagtgtgatatttttttccacaagggggggcacttctggtcggttgggggcgacacactactccacagtgcacgcgcacactagtgtccgctccgcgatgatccctccccgagctgttgtccctctacccccccgagatagtgtatagagagggagacaccgcgagatgttccacgccaccccctcgcccctcgctgtttctcttgtgngcactctcgcggagagagagttttggggagtgttgagatacacgccccccccacgcagagccacagcccctctcgtgatctctttcgcgcgctatagatatatatatagatagtgngttatagagatatacacacactctctcgggngataggctcgcttataactcgcgcgcgaggttntatggctctgtagaattataaggggagatatttgtgggggacgcaccacatcggagaactctataatgtatacctcgcgctataaattttgtgaaaatgttgtctcttgtttataagagagatatagggttggcgccacacatcgagataccacgcgccacatattgtgagagagactatgagagatatatgggtgccaccacacctatattctgtgttttccctcatatggagaaactatatttgagaaatatgttgttttaatatatggagatttttatattcacctctctttacgaccaccgcctaactccaagagagtgccccccagactgctggcaacagacacattgtgagcttggcacccataggccagaaatgggccccaagacttaagatgttgtgacccgttttttaaataaagatattcttgaaataaatta

SEQ ID NO: 671498 - DNA, 208 bp, Homo sapiens
gagggcatgtcttaacacacatggatacatcctagagcttctcagcaaagaatggaatatttattgattcacagaatttaaggaaatgtctgtcgaatcattagctgaccactaagttaacctgagcagagactttattggttgtacagtacagggaataaagactattgagttagtcctggaaagtcactatgccaacaaatagtca

SEQ ID NO: 671499 - DNA, 527 bp, Homo sapiens
  misc_feature (2)..(2): n is a, c, g, or t
  misc_feature (109)..(109): n is a, c, g, or t
  misc_feature (118)..(118): n is a, c, g, or t
  misc_feature (136)..(136): n is a, c, g, or t
  misc_feature (149)..(149): n is a, c, g, or t
  misc_feature (151)..(152): n is a, c, g, or t
  misc_feature (154)..(154): n is a, c, g, or t
  misc_feature (158)..(159): n is a, c, g, or t
  misc_feature (161)..(161): n is a, c, g, or t
  misc_feature (182)..(182): n is a, c, g, or t
  misc_feature (189)..(190): n is a, c, g, or t
  misc_feature (192)..(194): n is a, c, g, or t
  misc_feature (206)..(206): n is a, c, g, or t
  misc_feature (219)..(219): n is a, c, g, or t
  misc_feature (221)..(221): n is a, c, g, or t
  misc_feature (226)..(226): n is a, c, g, or t
  misc_feature (230)..(230): n is a, c, g, or t
  misc_feature (232)..(233): n is a, c, g, or t
  misc_feature (299)..(299): n is a, c, g, or t
  misc_feature (301)..(301): n is a, c, g, or t
  misc_feature (304)..(304): n is a, c, g, or t
  misc_feature (306)..(306): n is a, c, g, or t
  misc_feature (312)..(312): n is a, c, g, or t
  misc_feature (314)..(314): n is a, c, g, or t
  misc_feature (403)..(403): n is a, c, g, or t
  misc_feature (443)..(443): n is a, c, g, or t
  misc_feature (445)..(445): n is a, c, g, or t
  misc_feature (474)..(474): n is a, c, g, or t
  misc_feature (481)..(481): n is a, c, g, or t
tncctcccattttcctgctagcagggcttaaagcgggttcctcctttgtctctgatgcaagatacagtgacaaggccactgcctgccctcatgtatgctgcggcaaganagggaagcncaccctggagggcgggangcttggatgccananncngggnngncttcaagctcccaggcctggnggcagcnngnnncccccacctganctcaccaccttcnangggtnacangnntccccccgcttccttcccagctgtgacctttccctgaaggcataccgaagctggggggacaaactncngangnggcttntntgggtccctcctccccagcaggcagggtggcttcctgtgctctggctggtgatgtcccaatcgccctgctctgagaagttaccatcaanaaaataaatcacagaagccaccgcccggtgtttcccagtnancctctaacccgtgtgacacggcacctcangtggggntccatcccctccagctccaaccctggctggccacctctcaggccct

SEQ ID NO: 671500 - DNA, 399 bp, Homo sapiens
  misc_feature (106)..(106): n is a, c, g, or t
  misc_feature (122)..(122): n is a, c, g, or t
  misc_feature (259)..(259): n is a, c, g, or t
  misc_feature (315)..(315): n is a, c, g, or t
  misc_feature (324)..(324): n is a, c, g, or t
agctctgaagtcccacaattcatgtatgtacagggctcggaggaggaaactgcccagctttcccccgcacagctgcaggggtaggggtatagataagaggagcagncttggccaggcgtggntgcacgcctgtaatcccagcactttgggagggggaggcaggcagatcacgatgtcaggagatcgaaatcagcctggccaagatgatgaagccccgtctgtactaaaaatacaaaaattagccggacgtggtagcgtncacctgtaatcctagctacccggaaggctgaggcaggagaatggcgtgaaaccggngggaagagnttgcagtgagccaagatcgcaccactgcactccagcctgggcgacagagcaagactcggtctcaaaaaaaaaaaa

SEQ ID NO: 671501 - DNA, 250 bp, Homo sapiens
gaccaggaagagggagaaacttctgctcagaccgagcgtgtgccacatggacctcacgtcctcgccctggcaggagaccgctggactatcggcgcaggtggaacgtggagcccagctgaggtggaagacttcgaggctcgtggaagccgcttctccaagtctgctgatgagagacagcgcatgctggtgcagcgtagggacgaactcctccagcaagctcgcaaacgtatcttgaacaaaagttctgaag

SEQ ID NO: 671502 - DNA, 137 bp, Homo sapiens
gagaaaacagaagtgaattctggctttttttacaagagtgcagaagagagagaaaaactcgtgaaagctgaagaaattcattaaggttagggttaaaaaattattagactctgaaaaggaaagtctgtggcgttaca

SEQ ID NO: 671503 - DNA, 708 bp, Homo sapiens
gcagaggcagtgggagctgttggggagccgtggtcccagtcagcggtggcttgtatgagggctgctcccacttcatccgcgaggattccagccgcatgctaccccacacccgagctgtcccgtagtcgcaccagccgcggacgtgacaaagcctccagcagccaaggatgctccgtggggagggtttcttgggtttcttgaagccagtatttccactatagtatcttacgtcccagtcagaggcctccgactgtgccctggaccagtcggtccactcatgctgagtcgagtgtgcatcctggcgacccctcgtttctgggaagatccacgaacaatgggctcccagcagaggactgaggctgagcagggcccactttcccttggaagcttgaaccccaaaagcttgtgttaggtccagggtggccgtgaacacttagggctctctcgggctgtgcgctctcttgttcatctgcaaggagcagggtgtcggctcctgaccaagccctgtcactgctgcccagccacacgtggggccccttcaccacccggaaccagctcatgcaggtgaaagccactgtggaaacagccttggcagtcccttgaacacgttgaaagtcattaaatcccgagcaattgcactcctggtgcctcttgacagagcttggcacgttccccttccaagagcttcgtgttaagcttgtgagcacc

SEQ ID NO: 671504 - DNA, 389 bp, Homo sapiens
tggagacggggttagtccactaaggaacatgtagaaggtaaccaccgggtgacaggaagcggcggtatttactacctagcccccatcttcacgggttattccacttatttaaaatgtccagaataagcaaatctccatatagaggaagtagattaggggtggcttcgggatgggaggaaggggaagatggaggtctttctttggcagtgataaaaatgtcctaaaatggacggtagcgatggtcacacaactctgaatatgcttaagaccatggaattacacactttacgtgggtgaatggtatggtatgtaaattatagttcaataacatagttacaaaagataatcaaaagcatgaaagcactatggaggtggttgggatctgtgtc

SEQ ID NO: 671505 - DNA, 619 bp, Homo sapiens
  misc_feature (22)..(22): n is a, c, g, or t
  misc_feature (27)..(27): n is a, c, g, or t
  misc_feature (203)..(204): n is a, c, g, or t
  misc_feature (619)..(619): n is a, c, g, or t
tgctggttttatctcactaccntagtnatctcctgggcctccccgggggggagacatgaggctttacttttataaaggtacatttgaacgctaagccttacaataaacagcggaaagactgagcacagattacccacatctcagttaaaataaaagatgccctggccaagtcccaaagggttttgtctaagaaatacgttgcnnttaaaggtcccacgcgtgcacccacagtccgtgggaccttgctatggtgcaccgtggcaggacgctttgttctttccctaggggtctacagcaaactgcaagggctacaatatgatatttagagttaaaaaccaatcccaaggccttagaaccatgcccgggagttgggagcctttttcttggaggcagctgctccgggccttggaagtttcttcctactctgacgcaggctgggaattctagaggccttgtaggaaggtcaaacggacgagaagactgaggtcagaggctttcggagcattggccgggctctctaagctcgctcacttgttttggggggtgcgagtcgacggttcaaaagtttcctccttttccctcacgcggcccctcacggcagaattggcaggctcagaan

SEQ ID NO: 671506 - DNA, 181 bp, Homo sapiens
ccccctaatagaatactcccaggtctccagtgtgatgaggctaggacactggtacatggtagctgctggcagacagagtgtgagtgcataccactacacagtttgcccacacactctggctgcaaagggccagggtaccgtgtggtctccagctcgctacctggcattcgtccaacccata

SEQ ID NO: 671507 - DNA, 240 bp, Homo sapiens
cgtagattacagtcgttatgagttccgtggatttgtgttatgccaatgaccagatacataagtctgtctctctggtacgttgccgggcatgtcagcatgtctttattgcatcacccctttcgtggggcagctggactgcttcctgatgaccaatggcccccgaggtgtggtccacttctatgggtactcggtggtcagcaccctggccttactggtgagcattgcctttcccattcccat

SEQ ID NO: 671508 - DNA, 191 bp, Homo sapiens
gcaggtgctatatgcagcatctctacaaagacaggcactataagacttgttgagggtctgcgtgtctttgagagaaggcactggcacagtcatgggtgctgaactccgccatgttctagccaccctgggtgaacagatgaaagaggacgaagtggaagccctgatggcaggtcaagaagactccaatggct

SEQ ID NO: 671509 - DNA, 164 bp, Homo sapiens
attcgcggccgcgtcgactaattagccaggcattgtgacacatacctataggtccaactacttaagaggttaaggcaagtgaattgcttgagcccaggaagttgagggtaaagtgagccacgatcactctactgcactccaacctgggtgacagaaggggccct

SEQ ID NO: 671510 - DNA, 1236 bp, Homo sapiens
tttttagtgggacccgttctcagattcgccccttggggggactcgcgcattcgccacgcgccgcgtgttgggaccgctctcccttttgggatgaatccaccccgggggcccgggattggcaccgggccctcttcgggagttttctttggcccttagggcgcccccgggggcacggggatttaaccccaggtggtccaccaccacgggggtaaccagtcgttatggacgcccaccttatgggcgcctaattcttaaggggtgggaccacccctatataagaaagccacacggtttttggcaacccacatggaatacgcactggcctttggggtaaacccggggttccccggggaaagttgtccccccgggggagtaaatttcgtccgaggcccccaaacgcggttgtcccgcctataattcccgcacggcttgctccccgcgctctagctgagatccccaccggggcaaagccgcgtctatggcgcccacaaccccacgtttgtagacgcccccgacagttataaacgtaatatataagcgccccatatattagaagaaatttggaaaagcccctggggcgcgcgcaaatatggagatatttatggtttcctctcgcaacacagggggagaaaagagtatgtgagacagacgtgtatatatacgcgcgccagggcgacattataataaatatcgacacacagggagctctatatccccccgcttagatacccccttcttggcgaaatatacgtgagagatttataccctatgagagattatacccttgtcgcacaaagggaggagagccccaagaggcgctatatgagcccctccccgagataccctcacgagcgcgaggcgctacacctatagagagacaaacgcggtataaaaagagggcaccaccccggcttctaatgtagccccacaaataagctgggaaagagatttatataaggtaagagaggcgaccacaaactctatcccgagagcctcggtgaataagctcggttgttcccaagaatatagaattcttagtgtcacaactttaaaatttgcgccaccacgaaaccctcttaaatcccccttgtaaaatttaaactgttagtccacaaagaggggacacgcttctttggagacacactaaggagaaaaaaccttgtagagagagtaaaaaatttaacacccatagtaggcctaaaagcagccccccattaagaaagcgttcaagctcca

SEQ ID NO: 671511 - DNA, 783 bp, Homo sapiens
  misc_feature (160)..(160): n is a, c, g, or t
tatccgtgattaggggtgccatcttggtagtggagaatgacaaggggatagacatggtggaccacaatgtatggaaggtcccgaggatcatctaagggtgtggtcatgcacatgggtgatctactaggggatgtgctaggtttgcgtgtgtgactccacntgttctcacttggtggagtcatcgcataacattcacgtagactgcaatgacagtactccgtttttgttcgcgcttattgccattgtcccaaaaatgtaactgggtggatcaacatggggttccgtagtgtggcttaccacgtgggccccaaataagaggtgagacgactctaacacgcaggtgtgtaccacacgtttgttcgaaacaaaataggatcactgtagtaacacacatttgaacttcggggagataccactaatagatcgggctgcgtataaaaaactggacttcgttaagagaaaagctgaccctgtggtcggacttgggccaaaggaacattcgcgctcatgagatttggcgacagagaataacacgccataccagaatctctctccgtggggagcaactttagaagcagaccgcattagggattcgtcgccctgtagcacccgcccttttgggaccggaacacccccacggttgatgaaaacccatacatagggaggcagcgcgcggattactatactgaaaacattttcggccccactttttcaccattacaaaacatttttaccaccgttgggggaattcacattagggcgtcacaagcacgaggatatatc

SEQ ID NO: 671512 - DNA, 299 bp, Homo sapiens
  misc_feature (183)..(183): n is a, c, g, or t
  misc_feature (288)..(288): n is a, c, g, or t
  misc_feature (296)..(296): n is a, c, g, or t
agtcatcatcactgcagctgcctgctgcctgaggctgagctccctaagaagggacagcagccatcactgtggctgctagctgcctaagacactgaactcctggggaggaagggcggcagccatttctacagatccaggctgctgttttcctttgctgatgccaggaagactggacggcttggncccaagaggtattcccacagcgcaacatactggctgtggcagcatggccagactgcctctttaggctgccctgaccatccttctcactgggtggggcctcctgangactcagnctt

SEQ ID NO: 671513 - DNA, 610 bp, Homo sapiens
  misc_feature (317)..(317): n is a, c, g, or t
tgatctttctccaactcggattattgtaaaaaacggagataatgatattcctgtactgattgattctacggtgcctctctgtctgggccccgaagtgagctagcatactccgtagaactctgcatatctctgctataatgaagtagtgattgatccgccgaatactgattgttgataaatgccctttgttgatgaaggtatgaatagctaggatcgtaggcatcctagattcgccgtcgttgtaactccacgtgttctgctgctctaaacatgcgtgtgtagttagactctgagatgcaagagagacagtatccgtnattatagaagggaaaaaacacatgaaccaaagtaattgtgatacacacttcaagagaacactagcctacatgagtacttggcatacacactcgtgggattccagttattatggagtgcttccatccctctccaccccttgccccccaaaaggtttactttgcagagtgcttttggaactaagagctagtatctgtggattaactgatgcctgcatagtgcttcatgagttactcgcattctgttctgtgctttaaaagaagagtcccagacaagagtgttggaccagtattga

SEQ ID NO: 671514 - DNA, 704 bp, Homo sapiens
agcgtgggtctctgctacctgtagctgagggtgctgttgatgggcagcgcggcgcgctgggaaggctcgtctcgcgagagttcagctcccttcttttccgtggctgcctcagcaactcgaggatcgacatggacgctctcgaggactacgtttgtgccgttttttaacctcggagcttatactcctcccagtgacgggtctggagtgcgtgggggacccggcatgttggcgggtgagggtcccgatgtgctgggtgtacagcattggactattggtgggcatctgctggatgataaaggcgaagtgcaagaaggcctgattggccaactatcttatccatggcttaccgggtacggccaggagcctaatgggagaccttgactttgaggaggccatggtggctagtgtagggaaggcaagggacctccgcagtttgtgagacaattaagctggagtgacaggaggccactttcatgagggaagcattgggagagctcatgcgccttgtggatgacatgtcatggactgagattttggggatggcaccgacttggccttggaaggggaccatagtaggcctttggacccctgtggaccaccagagtcaatgggtgctattcttgaaccctggtcgtagaggtgcattcactgacaaagaggttgccctgtcaagagaacaggtgcaaccctctcttagagactgc

SEQ ID NO: 671515 - DNA, 817 bp, Homo sapiens
agcggcgaggttgaggcgcaagaatcgcttgaacccggaaggcagaggttgcagtgagccaagattgccccactgcactccaggccttgggcgagctgagcgagactcttatatctcaaagaaaaaaaaaaaaaaaaggtctcaagaaacctgtgaaattccccatttataagttctcctcaaattcaggtgactcgtgctcaaaattaggcctggttaccctgaaattacctttacaaagccagttctctaacttaatgtgcaatggtggtttttttaacaaattttttaattggaccctttactttggctgaccattaatttggcaaccattgtttttaaggacaaaccaggtattttaatccctttgaaagacctggtctggatattgtctccctcaatttggctcaggacattttaatcatactcggcttttcccacatttttctgcaaaattaagcagctttttcccaggggtccattagggatactccttggctttaacagatttttcaccacgattgagcgtttggaaaagccctcagaagggttttggctcaacaggacctatctgtgcttaatacactgtgcacaccctttgtttcacccagattttcaccactttttacacagttagcgcacagttttaacccacggagatgggcgttgtgaattgctaccaaaacagctcacgcaaagaggaactccatgttggccttgttgacacctctcaagaggtaccccttgagaattcattttccataaagcttagtgcattgtgaactcttttgctctttggaaattgtgggccccaata

SEQ ID NO: 671516 - DNA, 495 bp, Homo sapiens
  misc_feature (132)..(132): n is a, c, g, or t
tttgtgcacccacgggtccgatccccaggacccccgaaatggtttagggtcggcttcctcccctgagcgggaaagtttccccatgaagatgggggggatttttggttggttcgttttgtttggctcgggggntgttgtttgtttttttccccctaattttggtattcctttcgcctgggtaaaaaaaagcggaggttcctttaggtttgttttttaaaggccccatccaaaatccaccttgggagttgagcggggggtttggtttgctttggtttaaatttttcccggggtttgttttggcttgttatattaacccgaattcccccaatgaaggggtctatttttggtagcctttagccaagattttggccataaaagaatttttttgtttttaaaaagaaccaaatgtttttcccctttaacccggttgtaattttttttgaagcccattttgatccataataaaaaatttttgcccaatgtccacaaaaccca

SEQ ID NO: 671517 - DNA, 239 bp, Homo sapiens
agtgagcgagatcgtgcactgtaccccagctgggggacaagagcgagacttcatctcaaaaaaaaaaaaaactcagttgggcgtgttgttgcacttctatagtcccagctatgtgggaggctgaaacaggaagattgtttaaccccaggagtccaaagtaccaggaagttaggatcacacaactgcaccccagcctgggtgacagaatgagacactgtcctcaaacaaaaaaaacaggt

SEQ ID NO: 671518 - DNA, 121 bp, Homo sapiens
aaaagtgagaggtcagactcctagtatggccaaacaggagaacgaagaagaagaagacaggtcgggctaagcggcggatgctgtacaaccggcgctttgtcaacgttgtgcccacctttgg

SEQ ID NO: 671519 - DNA, 582 bp, Homo sapiens
  misc_feature (80)..(80): n is a, c, g, or t
atcttaggaacccacttaggagaggtggccaggcatcctgtccaacgaggagttcaagacatacaactaccccaagtacngagccgaggcccttttgagccacgcaccccgacttgatagggacggggccgacctcctcaccaagctgttgcagtttgagggtcgaaatcggatttccgcagaggatgccatgaaacatccatttttcctcagtttgggggagcggatccacaaacttcctgacactacttccatatttgcactaaaggagattcagctacaaaaggaggccagccttcggtttttgtcaatgcctgattcaggcaggccagctttccgcgtggtggaccccgagttttaagccacagaccgagggcccaagcaggcagcgggtggagggatgccacacccctcacagggcagcccccaaataaattttccctggttactttttgcctacctgcctgagccatgttcacctgcccacttgtcccctggtgcctgcccaaacaccccaccattggcctgtcaacccacccattggcctgtttgttgggggctaacaaagctttcttccctcca

SEQ ID NO: 671520 - DNA, 786 bp, Homo sapiens
  misc_feature (229)..(229): n is a, c, g, or t
tggctagtacgagctgggtttgaatcggagaggcactcgccgccgacgaactgtctcgccgagcgcacgcctgccgcgcccgcagaaatgcttcggttacccacagtctttcgccagatgagaccggtgtccaggtactggctcctcatctcactcgggcttatgccaaagatgtaaaattgggtgcagatgcccgagccttaatgcttcaaggtgtatgaccttttangccgatgctgtggcgcgttacaatggggccaacagggaagaacagtgattattgagcagagttggggacgtcccaaagtaacaagaagatggtgtgactgtcgcgaatgtcaattgacttaaaagatagaataccacgaacattggagctaaacttgttcaagtatgttgccaataacacaaatgaagaagctggggatggcactaccactgctactgtagctggcacgctctatagccaaggaaggcttcgagaagattagcaccaggtgctaattccagtggaaattcaggagaggtgtgatgttagctgttgatgctgtacattgctgaagcttaaaaagcagtctaaagcctgtgaccacccctgaagaaatggtcactaggttgctgacgattgtctgtcacatacggtaggaccacagaacattcggcaatgatcatctctgatgtcaatgaaccaagttcggacgaacgggtgtcatccacagtgaaggatggccacaacactggatgatgaattagaaattattgaaggcatgaagttgatcgaggcta

SEQ ID NO: 671521 - DNA, 784 bp, Homo sapiens
  misc_feature (223)..(223): n is a, c, g, or t
  misc_feature (250)..(251): n is a, c, g, or t
  misc_feature (277)..(277): n is a, c, g, or t
  misc_feature (293)..(293): n is a, c, g, or t
agcgggtcgccgacgccatccacgacccgactcctatcgcgatcctatccccggccccgctcgggccgtttcccattgcgccctggctcggttggctctgactgagcagtaagttcgtagccgggcctccgaaggcgggcgtgcgatgggatggcgagagttggcgtgcgtgcgtgagtcacacagtgtggtgtgggcatgtaaggtgcgcggagggactgcnccttctccatcaggtgcagaaggccanntcatgctgaacaagagccgagaagtngaatcgccagtgtcangccgtcacgttgtgggatgcccagcgtgttctcgccgcgaggatgcactcgagagacccgtgtgaacttgttgtgtgcgactgatggagtggtaccagagtgataggttggactacgctggtgtataaaagcgagagagtccataactgggaggaggacctaggtggccacgagccctttacttgactgaacaagcatagagttggcctcttgagtgaggtgtacaggacacgacgtcttcaagacgccccgagtagtaccaggtgcagagtcgctgttcgagtggcgacggagaaccgggttgaaggaagcatgcgaagcgcgattctgcttgcgcgttctggcgacaagcttggtagctgccgagagatactgccatgccactagcgctctgtctggcattatggttcctggtgtgcgcaaagagtggctcacagctgggggctgaatgtgcccgtctaacgtcatcgtattccacttctggcagggta

SEQ ID NO: 671522 - DNA, 481 bp, Homo sapiens
  misc_feature (10)..(10): n is a, c, g, or t
  misc_feature (21)..(21): n is a, c, g, or t
aacctataancaattcttaangggattttaacctattaaccaattctaaaagggatgtaattccaagtggggggctgtcgtcccaaaggctagtggcatgttccccagggagcaggttaataaatctttaacagtcagtgctcttaaccactgaactaactttccagccccatggtcagttattacttaccatctagtgcctgatgttttataaatcttcaatgtatcaatttaaactattttaattctttctaattaaggctttcttgaccatataccaaaatccacttcagatgacacacgtgtagccatacgaaattttattgttgggaaagtttttatcataatagttttgtaaatgatttagaatgtaaagtgtaggtttccccagggacaaggtcatgttagtggccccttctttagggatggtttcttacccattgttctcacttaagatcttggcctaggctaccaggaacat

SEQ ID NO: 671523 - DNA, 948 bp, Homo sapiens
atgacccaccaatcacatgtcctatcatatagtaaaacccagcccatgaccccataacagggagcccgtctcagccctcctaatgacctccggcctagccatgtgatttcacttccatctccataacgcgtcctcatacgtaggccgtagctaaccaacgacactaaccatataccgaatgatggcggcgatgtagcgactgagaaagccactataccaaggcctaccaactactacctacctgttccataaaaggccgttctgatacggggtataatccgtagttgtattatctctaggaagtggggtttcgtctcgcaggatttgtgcctgagccctgtgttaccagtccagccctagccacataaccccccaattagggaggggcacaggctcccacaagagggcagtctaggcgcgctgataagatccccgttagtaagtccgcaggtcacttaatacaacgattcagaataacaccaggttcgatggagtatctaatcaccgtgtgcggcaccctgttggtcgtacttaggaaagtctagtcgcgaaaatcggaagtaaggtgcagcgcgctggccctagtgacgaaggttagaggtagggtgctcttatctagaccctccctatgagcctcagagtagttcgaggatcgcattgcaccatttacgacggtgtctacagatgcaacattttgtgtagccaaaggcttccacggtactacacgtcagtaatgagggtcaatttttctcactatctggtccagcgcaaatgagttttcagtttgctccaacatcactttgggttgcaagccgccggctgatactgcagttcggggatgggtgcgaatgcgaatatccccctagggtgggttcacacgaaaaagaacaagaattgggcgtcccaagaatttaaattttgggcgccaaaaaagggcccagaaaggag

SEQ ID NO: 671524 - DNA, 436 bp, Homo sapiens
  misc_feature (55)..(56): n is a, c, g, or t
  misc_feature (144)..(144): n is a, c, g, or t
  misc_feature (206)..(206): n is a, c, g, or t
  misc_feature (310)..(310): n is a, c, g, or t
ctagacaccctggccctgagctcaatgggggccggtggggtactgacctctccanntgttggatcggtgccctccagcttaccgcgcgcattgggggccgctgggggggcctttattggcaacagattattccagttctggaangatcagctgcttcttgattcaaaaatcaacatcaggtcggctactgacctggtgcgtccagntcgaatgctggtgggctatacgactgacactggtaaccctgtccatattccagatgaagatctgatgcgacatgggttcatccttggccagtccggggtcggcnagaccgtcttgggcaaattattgatgttccaacagatccagcgcggtggaggattaacgttcatcgacggcaaaatgaacgctgatgatcttcagactatctatcagtactgctgctgggccggcc

SEQ ID NO: 671525 - DNA, 425 bp, Homo sapiens
gtttttggtcaaaatatttatttctaaacatgttagaacgttccaaagtgaaagcatcagtgatgtattgaaatcttagtcttgatatgttaaggaaatgtctttttagattaaaaaaatcggtttgtagcattttaaacttagtgatgatttgggtcatttcatcatccatttaatatgtgcgattatacatgcctccttgtgctggtgtactgtaaaataatgtaactaatgtatttataaatatgtataactatgatgtaaaataccgtgtgtatatgtatgtatgtgtgtttttgtatatgcacacacataaacggctttgctgagcgcaaggatgtggtttatcctgtataaaacttgttgtataaaggttgcctccaataaccgtaatgtttaataaaaccatgtaaagttttgttgta

SEQ ID NO: 671526 - DNA, 165 bp, Homo sapiens
  misc_feature (16)..(18): n is a, c, g, or t
  misc_feature (156)..(156): n is a, c, g, or t
ccagtgagcgcttggnnngatgctgggcagcccgctagctcgccttccctcctgctttgcgtgcccggggagcagcagccctgccccacacctcctctcactccccagactggttggttttgccattttgttgtgtgtatgctgcttttcttttcnaaccaagag

SEQ ID NO: 671527 - DNA, 271 bp, Homo sapiens
agataaatcacttaaccttccatctatcacagtggacgagctaacatagatagaccgtttgtaaaatctggatacctgtatagtaagacacttcctctgcgtgctccgttacccttttcacatgcatgtgccaccatatcctcttattttttttgttttatgttcagaccgcgttttcgccatgttgcctatcgctggtctatatcttctggttctccagcaatctaatcacctcaagcctccctcagtgcttacatgtcaggcatgccat

SEQ ID NO: 671528 - DNA, 143 bp, Homo sapiens
cgggcagtacggattgtgaacatacaaggaaaaacaacggcctgatcggggagggtgacagtactaccttcttctagaaaacaaagatggctcaaccaccaccatgagaacaggtggaaaatatctctatagacccaaccggg

SEQ ID NO: 671529 - DNA, 472 bp, Homo sapiens
tttcctatgtctttatttctcagctggccaacacttatggaaaatagaaagaacctacattgaaatattgggggcaggttaccctgataatcaggtagtgttctttcatttccatgtttagaactcctttaaagacctcttgtaaggctggtctaatggtatcaacttcccatagcattgcttttctggaaaagattttatttttccttcacttatgaaacttagtttggcagcatatgaaactcttggttgaaatttctttcaataaagatgctgaatataggtccccagtctcttctagcttgtagcctttctgctaagtctgctgttagccttatgggtttccctttgtaaatggcctgccccttttctctagcttcctttaataattttttctttctcattgaccttggagaatctgatgactatgtgtctttaaatgaatcattttatgcaatatctcccaggagtt

SEQ ID NO: 671530 - DNA, 1268 bp, Homo sapiens
catcgcctccagacccggacctagacgaggtgaggaaggaagagtggaccgatggatggacgacgtgcactgggagtcaccggctaccatgagcagcttaccatccacggcaaggaccacgagagtgtgttcaccgtgtcccatgtgggactgcgaccgcgaagttcaggggtcacgatcagaggcattgatatccccgtcgctgcctcggaacaccgatcctcacagatattagtagaggcacacataccagcatgggcaacaagtcctttgccaaacggagaaccagccccaaacccttacacagaggaggtgctgtggaatagtgtggcttgagttcagtatcaaaatcacaagacttgcccacaaggggctctactgaacctccagcatctactgcggtaaagctccagcactgtccagcaaggacctctgcagagtacccccagttactgagatccaacgggcacagttcagctatactctatatatgtgaacctgctgctgcactagaccaacgcttccctcctgcgaccagtggagaactacgtacctccacaatgtggcaagataatacatgcgagaacagcggcagacagacccaaggcacgccttcacacgcgtgacaaactcacgacacgcacactaaccaaagaaacggagcaacaacaacagacccactctccacaccaacaggacacacacctgcacaaccgacatagacctagacgtacaggactccagaccaaaacgcaggaacccgcacacggggaccgcgagtacagaggcacgaaactagccacaccacgaatagcgcaacgacaaatcggacagacaccgtcacacacacaggaacaccacacagccaccaaacaaggcaaccgccacaagcatcgcacgcgacaacaaccacacaacagcccacacgcacccaaccagcccacacgcaggaccaaacgcacacgcaccgcgcacagcacacgcacacaggctccccaccaacaaacaacaaactcagcaaccacctacgcacaaaaatagaccaccagcacagaacacacagacactccacgaccgacacccacaccaaccactacgcattctgctacactcgttatctcgcacaaccgcaacatcactaccactcacactcccattcacgacccctcactcccagccgaaacaaccaaagaagtacagtacaatctactacacctagatcacaacaccgaccaacacacccaactaacacaacaaaacccagaacc

SEQ ID NO: 671531 - DNA, 374 bp, Homo sapiens
  misc_feature (17)..(17): n is a, c, g, or t
cgcgccgccgacacggngcgagaagacgacagagggactgatgaacccctctctatcaaaaacacaaatctctggatgtggtggtgggtgcctgtaatatagctactcaggaggcgacgccggagatcgcgaaccgggaggcagaggttgcagtgagcagagattgtgccattgcactccagccctgggcaacaagagcgaaatccgtctcaaaacaaaaaaaacgaaaacaaaaattggcgtggtggcgggggcctgtagtcccagctagtctggaggctgaggcaggagaatcgcttgaacctgggaggcggagattacaagctgaggtcgcgccgctacactccaacctgtgacagagcaagattcgtccc

SEQ ID NO: 671532 - DNA, 305 bp, Homo sapiens
ggataccccacacttcgatcgcggagaataagcagaccttgctcagacatgaatcatgctgcttagtgtactgcacgatccaaatctgctatacccacaacccaccacgctacaccgcacacagaggctgtaacttgatttttacatgattcagttcattgaagggagtgcttaggggcttaagcctaactctctgtggtgctgtgcttgttgtatactggctactcaaactgttgctgctgctgctgcttcctggatgtcgccttcttggcgaggtcctttgtcttctccgcgatcgaattgtg

SEQ ID NO: 671533 - DNA, 291 bp, Homo sapiens
gggaagggggggccctccttcctaaaggcccttggggccaggcttactttgggggcaaactttaccctaggcccccctccatcaaaagtccttaaattcccccccgggggtccccctgggggggtaaggacctattttttaccctaagggggtgggcccctaagaagggtggcccttaaaatcaggccccccccactcccccaagcggggaggagatatttattttggggagagtttggaggggagggagaatttattaataaaagcctctttaactttaaaaaaaaaaaa

SEQ ID NO: 671534 - DNA, 771 bp, Homo sapiens
ctgctctcggacggccgcggctgctacagctcccgagccagtcctgcaacgaggtcatcccgaggatctacgtgggcaactgcgtctgtggctcaggaccatcgcccgaagctgcagaaactagggcatcagccatgtgctggaacgcgggtgagggcaggtccttcatgcacgtcaacagcaaggccaacttctacaaggactccggcgtcacatacctgggcatcaaggccaacgacacacaggagtgcaagcctcagcgctctacgttggaaagggctgccgacttcatgaccaggcttggctcaaaagacttggccgggtgctcgtccactgccgggaaggttatacgccgctccccaacgctagttatcggcctacctcatgatgcggcatgaagatggacgtcaagtctgcctgagcatcgtgaggcagaaccgtgagatcggcccaagatggcttcctgggccagttctgccagctcaatgagcagactaagccaacggaggggaagttgacaaccctaggggaacccccaacggctctgctcgacgaggtccgtgggggaggcgtgggcaaaggtgtcccgagctgccatgtctcaggaaacgacactgtaccctgctacccaagatgcacaaacggcacttgtctacaagtggagtcccaaaacaagcctgggcactttgtcccaccctgggggagcccataaagaagcttgcaacggcgggcgtccttgattcccaagtggccggctcggaaattacgacg

SEQ ID NO: 671535 - DNA, 289 bp, Homo sapiens
  misc_feature (29)..(29): n is a, c, g, or t
  misc_feature (167)..(167): n is a, c, g, or t
  misc_feature (183)..(183): n is a, c, g, or t
ccagaccagtttggcccggtttgtgcatnacatgctgtgcccctgacctcagcagccacaggctccgccgaagccccatttgctgccagagggattactcggaggagatgccgtcggtggcccggcctcggctgtcgggggtacacaggtcccagatccagacctgnacagtggggattgcanagattggagctcagcagtggaaatcccgccaagcagaggagcagtatggggggcaggtggcttcgtacggggagacgagcggggcgaagagaggccgtgcaagact

SEQ ID NO: 671536 - DNA, 695 bp, Homo sapiens
agcgggccggaggaggaagtggtgaggttgttgctccttcagcgcctatcgctggctcttggggcgcagagaggggccgcagtctccgcggctgcgtcgagctcccttgcagtcccctccatgttccccggcgccactactccccttcctaagggcgcgcttaccccggggtctatggaagtatggaaggacccttcaactggtcatcaacagagcagaagagcagaacggttattagctgcacgcaatacgaagaggctatttcttgtcccaaagagctgcggcatatctttctgaagccatgaaagctgacacagtcagagcgaggctccatctttcactgggaattgcgaaggggatatgccattatgaaaacaggtccctccctcattccaaggagagatgggcaaaaggggcccagccgtgaaagaaagggtgtgcaaagcccagccagaacaccagacaagggatgcagctgcccatcttcagacatctcacaaaccctctgcagaggatgcagagggccagagtcccctttctcagaagtacagcccttccacagagaaatgcctggctgagattcaggggatctttgacagggatccagacacactactttatttacttcagcgaaagagtgagccagcagagccatgtattggaagcaaagcccaaaagatgatagaacaattata

SEQ ID NO: 671537 - DNA, 796 bp, Homo sapiens
  misc_feature (36)..(36): n is a, c, g, or t
  misc_feature (97)..(97): n is a, c, g, or t
  misc_feature (120)..(120): n is a, c, g, or t
  misc_feature (125)..(125): n is a, c, g, or t
  misc_feature (133)..(133): n is a, c, g, or t
  misc_feature (140)..(140): n is a, c, g, or t
  misc_feature (214)..(214): n is a, c, g, or t
  misc_feature (256)..(256): n is a, c, g, or t
  misc_feature (291)..(291): n is a, c, g, or t
  misc_feature (314)..(314): n is a, c, g, or t
  misc_feature (364)..(364): n is a, c, g, or t
  misc_feature (386)..(386): n is a, c, g, or t
  misc_feature (417)..(417): n is a, c, g, or t
  misc_feature (524)..(524): n is a, c, g, or t
  misc_feature (528)..(528): n is a, c, g, or t
  misc_feature (533)..(533): n is a, c, g, or t
  misc_feature (563)..(563): n is a, c, g, or t
  misc_feature (589)..(589): n is a, c, g, or t
  misc_feature (593)..(593): n is a, c, g, or t
  misc_feature (605)..(605): n is a, c, g, or t
  misc_feature (609)..(609): n is a, c, g, or t
  misc_feature (671)..(671): n is a, c, g, or t
  misc_feature (705)..(705): n is a, c, g, or t
  misc_feature (758)..(758): n is a, c, g, or t
gtcactttcaacttaaaattcagagacattgatgcngcaactgaagcaaggcacaggcttgagaaagacacagggcagaagcccgagaaaggaaggngaagggaattcagtgggagacanggttntttcatgnagatggngaatgctgggtttttggtgaaccattactgaaacgtcttggggctgccaagcattaggttgggagatgcaaagnttatacctgatgatcagggcagtaggcataattcagcaacanacattcttcctttgggagaaacctgttcattccantcttctaattacagtggttcctntctcagggatactggactttctgacgcagatcggacaattaaggggaaangcttcccttttccctctgtggnagttacgattttgacttcagtcctgagaaanacttcaggttttgagaatcagatgatgtcttctccttttccaaaccccacacgttgaaggcatttataaatccaagtctgaaactctgggctctgggacggctgttnaganacacnacttgtttttgtatcatataatctcggganacacacacacacacacatatatatanacanacatacgtatanacanacatacatatatataaatatacctgatgccagattgttttcataaatattctgcctactgtnaatatgggttcctctgagttgttttagaaaattngcgcaatgtattaaaatcaagtgttaggaaatttcatggtcttacctacaatnacttttattatcgcaatgtactatgataattacatctg

SEQ ID NO: 671538 - DNA, 414 bp, Homo sapiens
agccggaggctcctcgcgtccgggagcagcatctgtgcgggctagcttaagcacacggcgaaagacgcgtctcagttacgggacgcttaagaagcacccttctgtccgtggtcgggcgcttcaggcgcacgtgatcggcgggtgctctgtgacggctctgcgtggtgagatactgagtctagtgcggagcgtccgggccagacgtccatgcccaaagcacaagaaaaagtgcgagggaaagtctcatccttagtagaaaaggtatacgagagaggccaacgagaagggcggtcgctggggttcacttggtggaatgaggttcgatcattgacccagaagaattcagaagatgtgtgacttgaagcttatcatcgcagtgactggcgatggttctaacgatcggacagccggagg

SEQ ID NO: 671539 - DNA, 561 bp, Homo sapiens
tcatcttctgaatcctaatgagccttctggcttagttaaacacataccagtggacaaagctggttttcttctttcttactcaggatcagctatgcctatgcccagagctgacaccattaactacggcagagttggttcattttgaatcaggtgttaaaagttgcttttttaaacaaacaagccctgtaaaaatcctaactcaaataaagggcagctccaacaggtgagatgttacaaacacctcccctggtccacctgattccaaccaagcagtcccctctttaccagaatgactttgctccaaagtatggtcccagcttccaaaagcacgtgttcctggggatcggtacttgcttcacactagtggttaggtatttgcctagtttggaagccttccatgctgggtctttattaagctttgcctttgatagggcttgggtttgtgtccctgcccaaaaaccatcctgaattgtaatcgccaatgttggaggaggggcttgttgggaggtgactggatcatgggggcagacttctcccatgttgttctcatgatagtgagtt

SEQ ID NO: 671540 - DNA, 573 bp, Homo sapiens
gcgaattcactagtgattgtgagctgagatcgcacccggtccaagcactggctttgagataagcaatattaaaaacattttcagcttcatcagacgctgactaactgacctccaaccactgttccaccagccataactacagctttgattggacaagtgactgatttcagtaactttttcctgacaagggtgactacccatcatggactggttctggctggcttacagagctcctgcacttgcatgtctttgtgtcctgaaaagaccttttgccatatagggcctaattataatacatttaaatgttaagtctccaccccaaagtgaccatgggttgtatgttgcatgcatgtttgttcaatatgcatgtgtcagaaccactttcatgaatattcatagctcctcatgtaacctgttgaatgtgtttgtttagtcaatccattgagcatgaagctcctaccctaaaccctccttctttgacgttgctgtctcttgtcttggctgggggacttgtttcccagcaggtctcactccctttctgaggcttggtggagtggtgcgatctcagtccac

SEQ ID NO: 671541 - DNA, 286 bp, Homo sapiens
ctattttctaccaataccaactacagtttaggtaactcagaaatatgatgattaagtcaggccaggatgttgcaaaaagagattaacatttgagtcagtgggctagggaaggcagacccacccttaatctggtgagcacaatctaatcagctgccagtgaatataaagcaggcagaaaaatgtgaaaaggagagacttgtctagcctcccagcctacgtcgttctcccgtgctgggtgcttcctgccctcaaacatcggactccaagtcgaagggtgatctgtggg

SEQ ID NO: 671542 - DNA, 335 bp, Homo sapiens
ctggccttgcaccaaaacgtcagagccatgtggtaattcggatcaacccaaggttcccaatttgtcgaatgggcctcggcaagaaacctcaaaccggtgtgggcgaacaagggctgcccccgggccttggaccaagaagcccaaggggcaagcccaaaactggggcttcgaatggcccggaccaaagccctgtggcttcctaatggggaattaagccttaagcccccctaatgccatttggaccccttcccaccaagggaaaatgccccccccaaacacttggacctttccccttctggttcctgtgtctcccaataaactctctgaccaaccct

SEQ ID NO: 671543 - DNA, 837 bp, Homo sapiens
  misc_feature (159)..(159): n is a, c, g, or t
ggttcccccccgtgttgttcccccgccactggcgagaaaccacctgtcttgttcacccaaagcgcgggcgcccccgccataattgtcgccgtgcgcaagagtggcgtccactggctgttttcttttagtgaacagactatctcgcctcactccccctcnataggtgtccccgccgacataccggaataaagtttgctcccctcaacagagtggatatcctgcttccttccataatggacccccacacgctgcgccgtcggtagcagaagttagagatactttaatttacgcactgagagcggtactcacactctaatatgagcgcgggcgttttccactacaaattcgttgaggaacccccactcaccgcgggccggttgccacccaatggccgttcgtatgtggttatgtatatgtcccgccacaattgtctatacatgaagaggttatttccgcacggcggtcgcctgttcttgagggaaggacacgttcacgaggtggttttctccgagatagtgcgaatactaaataacattgtggcataatcgcgtgctacaggcgatgtgattgcgagagagatagacgctactcacttgctatgcttacaccacgaccacacccgttgtgccaccacgcacgtctaagcgagagaaataatcttctcctcgtaatgtcaatcgccatcccctgctctttcttcttcctcgtgctctcatctcccacacgtattgtagttccatgttcagttcggcgatagtagagaacaccgccacgatgtggattgtttctcccccgtcacaaaaaaaccctctttaaactccccgccccaacaaaaca

SEQ ID NO: 671544 - DNA, 132 bp, Homo sapiens
tctagaggatcccggacgagcatcttacaaattctaaaatactacccccagcggctacatccagggtcactagcatcatggtgcagcatttcaggtaccatatcaaccagagcaacatacatgaataagcca

SEQ ID NO: 671545 - DNA, 542 bp, Homo sapiens
tctcccagtaggctggtactataagattcgtgtaccacaactggctaactttttaattttttgtagagacggggtctcactttgttgcccaggttggtctccaacttctgggctcaagccatcctcctgccttggcctcccaaagtgctgatactacaggcatgagacaccatgcccagccaagaaatactttacttttttttttttgagacagagtttcactctgtcgccccggctgctttgtagtggcatgatctcagctaactgcaacctccacctcccaggttcaagtgatttccctgtctcagcctctcaagtagctggggctacaggcacccaccccaatgcccaactatttttggtattttcagtagagatggggtttcaccatgttggccaggctggtctcgaactcctgacctcaggtgatccacccgttttggcctctcaaggtgctgggattacaggtttgagccaccgcgcccggcctgctttgaacatctcttcatgtgcttttttaccatctgcagagcctcttcagt

SEQ ID NO: 671546 - DNA, 204 bp, Homo sapiens
aagggcaagcagacgaatcttctattgatacttggaggggacgcatcatgtcgagacctcttcttctgccatttcgagttctactctgattgcccatgaagccgaactgtcccccaccaaaaatgtgagagaaaatatcatccatgccaccacctccgccgctgccttcccgaagaccttgctctccaatcagtcaatcataat

SEQ ID NO: 671547 - DNA, 362 bp, Homo sapiens
  misc_feature (124)..(124): n is a, c, g, or t
  misc_feature (216)..(216): n is a, c, g, or t
atccttatcctacgagcgcaacaaaacaagagataggaatgtccagtaaccacatgaatagatgatcagtgatctgggaaatgcaaattaaaatctcagtgagattctgctttacctctgctgnaagggctaaaataaaaatggctaacaggccagacgcagtggctcatgcctataatcccagcactttgggagaccaagacaggcggattgctncagctcacaagtttgagaccatgcctggctaattgtttttggtagagatggggtgtcgccatgttgcccgggaggcggaggttgcagtgagctgagatcacgtcactgcattccagcctgggcaatagagccagaccttgtcacca

SEQ ID NO: 671548 - DNA, 107 bp, Homo sapiens
gaggtgatattttagagattattgcatgtggtatgatatctgtgcttcatatatgctcgtgcaggcataaaagttggaagggtggtacttgctatacagaggtggat

SEQ ID NO: 671549 - DNA, 196 bp, Homo sapiens
acatcaagcacatgggaagcacatggctaggtttatagatagttgggtggttgttgtaaatgagtgaggcaggagtccgaggaggtgggttgtggcaataaaaatgattaaagatactagtataagagatctggttcgtcctttagtgttgcgtatggttattatttgttttgaagttagtttgattagtcattgt

SEQ ID NO: 671550 - DNA, 463 bp, Homo sapiens
aggagttcaagaccagcccagccaacatagcaagaccccgtctctaaaaaaaaaaaaaaaaaaattttttttttttaaataagccgggcatgggtgggcacatggcctggtaaggcaggagagagatcgcttaaaggcccaggaagttaggaggagctgcagtggacgctatggattggtggccactgggactcaagcctgtgcaaccatgtggagaacctggtctctaaaaaataaaaaccacgggccggggacgcgggggcgggtcaccgtggtaattccagcgccacttgggggagggccagaggccaggacggcgatcacctggtagggtatggagtctcggagacccagcctggggcacgattgggggaaccccttatctccaggtgggaaattcacaaacatttgcgccggggcatgggtgggttgtgcccctggtaaatcacacgctaatcagggg

SEQ ID NO: 671551 - DNA, 140 bp, Homo sapiens
atagagctcggtccagcggccgcctttttttggttttacctccaggagctctaccaggttctcacagtaaagatcaagccagtgtggtggctcactcctgtaatcccagcactttgagaggccgaggcaggtggatcact

SEQ ID NO: 671552 - DNA, 217 bp, Homo sapiens
ggtggggttaggtagggggaaagttgagggagagcgctttgaggccctttgagatgtcgaggcgggcgtcggtttttatggtagcatgtgcagggctgggggaggggagtggattctcagggaaggcctgggttggtgtgtatgggtttgatatggagccttcccctgccccctcccgtatttaccttatagcaccccctttaccccctttagagcc

SEQ ID NO: 671553 - DNA, 172 bp, Homo sapiens
ggggttggggggccttaaaaaagggggttttttttttttagggggggaagtttcccccccaattaattagcttttaaaatttgggggcccccctgggcaatatggcccccattgggggccccttaaattttttttaaaggggggggttcctttttgggttttttccccccca

SEQ ID NO: 671554 - DNA, 172 bp, Homo sapiens
  misc_feature (70)..(70): n is a, c, g, or t
ttggtgtagatgtggtgaaaagagaaccattttacactgccgtgtgaaatctcgcgcgatactccaccgngaacacgtagatggctgacagctgatctctacctccgtcagagtactcctcgttccgtgcactcttcctccgtcgtagtcctaggtgccgcctggaaaatca

SEQ ID NO: 671555 - DNA, 256 bp, Homo sapiens
gatttttgcatcaatattcatcagagatctttgcctgtagttttcttttttggatgtctctttgtctgtttttggtatcagggtaatacttgcatcatagaatgagttttgaagtattgcttcctcctctgtttttcagattagtttttgtaggtttggtcgtagttctttaaatgtttactagattttagcaattaggtcccgggcttcctctctactgagaattttcccttattatggcttctatctcattact

SEQ ID NO: 671556 - DNA, 423 bp, Homo sapiens
ggacctagtttcgagtttttttggtattatttagtattaactcacacgatcagaggtcccacaataggccatctgcaggctgaggagcaaggagagccagtccaagctccaaacttgaagaattcagagtccgatgttcaagggcaggaagcattcagcatgggagaaagatgtaggctgggaggctaggccagtctctcttttcacatttttctgcctgcttacattctagccatgctggcagctgattagattgtgcccattcgggttaagggcgggtcttcctttcccagcccactgactctgttaatctcctttggcagcaccctcacagacacacccaggatcaatactttgtatccttcagtccaatcaagttgacactcagtattaaccatcacagtaacgtacagccatatattg

SEQ ID NO: 671557 - DNA, 119 bp, Homo sapiens
gacgactcctctgaccacccagagtcctcctctagccagcctccattataccaactttctgaattatgctgacataggcatatgctttgtcacactgagtgagagacacaggttttctc

SEQ ID NO: 671558 - DNA, 491 bp, Homo sapiens
  misc_feature (482)..(482): n is a, c, g, or t
tagtaaccccatgacaattaagctaactggtctggggcctttcctggtcaaagggaaaaaacaccggctatggatataaaagtgctttttaaaaaacattaatatgaatccctgtgcttggggaggctgaggcgcgaggatggcttgaggccaggagttcaagaccagcctgggcaacatagtgagacccctctctacaaaaaattaaaacatcatcggggggtgggggcatgcatctgtagtccgggttaatggggaggctgaggcaggaggacggcttgagcctaggagtgggaaatggcagtgagctatgactgcatcatggcattccagccggggcaacacagagggactcgggtctctataaaaacataaaattaaaaaaaattaggagggggcgcaggggctcacgccttaatccaggtacttggggaggccgaggggggttggatcacaaggtcaggagatcaagaccatccggnttaacatgg

SEQ ID NO: 671559 - DNA, 138 bp, Homo sapiens
cacgcgtcgtgggtccccaggtggccccctgcggcctgggcccccctgcccacggcagcttcctgctgatgaacatgctgttgtatgttttaggaaaccaggctgtttgtgaataaaacgaatgcatgttgtgtcacg

SEQ ID NO: 671560 - DNA, 203 bp, Homo sapiens
ggggggggggtcccccctggccccggtccacctttttagcggcgaatttaattttttggcccccccaaggggtttttgggtaccccctaggagggggtttcccccccccaaaggggggggttttttttttttttgggggggggttttttttgtttttcccccccgggtttttggggtttgaaggggggcccttggggggccca

SEQ ID NO: 671561 - DNA, 650 bp, Homo sapiens
gagtaatacgcagtcacatcaggtcataacaacagtagtaaggacttactatgtgcccagtactgtgctttgcaggttacagatcatatcatataacctataacctaacatgaggaaagagcttttgttattcccttcagagagatgagcaacttgcccaaggccacacagccagtgctaagaggctagtgcctggtgatgaatccacatctctattgtaccaggaacagggcaaggacattgccttggtcatgactgtacatcattcctgcagagcctacttcattggtggcacatggtaggcacccacatgtgttagtttagaacctgattaggcaccttgagatgacatgctggtcactggtagacagaaactgacaaagaatgctctgagatgtatgattcttcatggcatctactgatcactcagagccattaggcacaccagtcatgcttgctatcttggacctcaggatcgccaagctgaagatgcagctgaccaagcttgacagtgaggccatgcctggggagctggactcagacagggaccgaatgatgcttatcaacgggagaatgagctgctgatgcaatgcgcttattagcccccgcagtgtactcgtgcttggagcttgacaggacccgtagccgtg

SEQ ID NO: 671562 - DNA, 298 bp, Homo sapiens
  misc_feature (52)..(52): n is a, c, g, or t
  misc_feature (95)..(96): n is a, c, g, or t
  misc_feature (98)..(98): n is a, c, g, or t
  misc_feature (101)..(101): n is a, c, g, or t
  misc_feature (104)..(105): n is a, c, g, or t
  misc_feature (213)..(213): n is a, c, g, or t
  misc_feature (233)..(233): n is a, c, g, or t
  misc_feature (245)..(245): n is a, c, g, or t
  misc_feature (258)..(258): n is a, c, g, or t
  misc_feature (286)..(286): n is a, c, g, or t
  misc_feature (292)..(294): n is a, c, g, or t
  misc_feature (297)..(297): n is a, c, g, or t
cgcgctcactgcaacctccacctcccgcattcaagcgattctcgtgcctcangcccccaagtagctgggactataggcatgcaccatcatgcccnncnaanttnntattttagtagagacagggtttcaccatattggccaggatggtctcgatcttttgacctatgatccacctgcctcggcctcccaaagtgctgggattacaggcgtgancaccatgcccggccccaggntattcttttgtncaaagtttaggcnactccatgcccttctcaaaacatcagangctggnnnctng

SEQ ID NO: 671563 - DNA, 425 bp, Homo sapiens
tcatacgcactatcctgaagactgagataggctaactaggataataagtactacctacaagagccttatgtcaacagacataaagagagcagcagcaatagtaggggccccaggtcataggtgaagcaggtcaagatcatcagctggcagtaggcacacgcaggaataatgccctcagaggtggcacctcgcaagaagcagcacataccacacatagttctcccgaaacaagcctgtactagcatcctacaggcattacaataacctcatacttgatggaataggtaacaatgtaccaccaggatgtcttgctcaaagtcctatgactccaatacacaaccttatacagcttaaagcgaaactacctccagggtcaagggtgcatactagtaaaacgaaaatttgttggtttgtagctaggtcag

SEQ ID NO: 671564 - DNA, 572 bp, Homo sapiens
tcgtccgtctaatgtcccgttgtcttgattgccgagtgcctgtccgctcagtccttggctttgcctgtcctctggtccctcaatccagatgtcccttcactcgttcgcctctccgcatcgccatggtgtttctttcacacggtgccaacgtccggcacgcgtggatcgtgcccacgcttgatccggagcttttacggctatcctaggtcgggcgccacgtgcccacgactagcaggtcctgcaggaccgggagctggtctgtggtagtcatgcagaggacggcaccacctccaaatactttgtgagcacgtcggttctcatgcgcagtgaacgccgactcttcggtgcagttgttggccgaagaaggcctgtgacgctggacatgttggacctgggggcagcacaaggcaaacttggagaaggcccaggcaggagctggtggggacagctgacgaggccacgcgagtcagagatccagatctgaatacgaggccaacgaggacatggatgaaggacctggagtaggcgagccagccagccaacggttacctcagcggcgagcatcctacctg

SEQ ID NO: 671565 - DNA, 792 bp, Homo sapiens
  misc_feature (416)..(416): n is a, c, g, or t
  misc_feature (418)..(418): n is a, c, g, or t
  misc_feature (488)..(488): n is a, c, g, or t
  misc_feature (513)..(515): n is a, c, g, or t
  misc_feature (558)..(558): n is a, c, g, or t
  misc_feature (639)..(639): n is a, c, g, or t
  misc_feature (659)..(659): n is a, c, g, or t
  misc_feature (726)..(726): n is a, c, g, or t
  misc_feature (733)..(733): n is a, c, g, or t
cccaacccgtcatctactctaccatctttgcaggcagactcatcacagcgactgagctcgtagctgattttttacctgagctaggcctagacatataaagcatgctagcttttattccagttctacccaaagaaatagtaaaccctcgttccacaggaagctgccatcaacgtatttccttcatcggcaaggaacaaacctgctattcctattagatccgttactaaatagactattccctctatcaagctaattactacgtcatccgggcacagagtgaacgcactcaaccatagtaacttacctagagtctaaatacttgcgatcagttaaactagattcaataaatggactgatatgccaatagaaagcaataggtaatatgaccaccacattctagcactatacttgcagtntnaccctagtgatggttaaaccacataagagtcgatccgccttcttgaatcgattcacgtggccctgtctgnacttctctaaacacaattgtgacgnnnaaaatctcagatcccccgccaatgcctcaaagttccattattnacacataaattctactaacgcctgcaacgtacaagcgtctagagtcacgtgtacctccttctattctctgtctctaagtcnttattccatgtctagtaggncaggtgcatgcttgaagtcgatgtggattataacccataacaccctagtcttaacgggcaagatatntcttagncatgtatcttacctctaagcttatcctcaagcatagggattgcggataactaggcaatt

SEQ ID NO: 671566 - DNA, 795 bp, Homo sapiens
gaccagcaccatggcggtgggtaagaacaagcgccttacgaaagggcggcgtacaaaggtgagccaataacgaaagtggttgatccatttcctaagaaagatccggtatgatgtgaaagcaccatgctatgttcacactataacgaatatatttggaaaagacagctcgtcactcaggacccacagggaacctaaacatttgctatcatgatcgtgtactcacaggagtcgtagtgattgtgaacgtgacgtctctgtctggatttcgcagatactgatgaaccttggcatttgagaatacactgcaatgctgattgacttgacagatggtacacgggttaacaaagctggccttgacgtaaccttcgcatggcgatggactcttaccgcagagacagaaatgtgttccagtggtcatgaatgatggcagacagatgatcgaaggctcacgttgatgtcgaaggacttatccgactggttaccttgcatacgatcttgattcatgatgtggggattgactgtgaaagaaccgctaaacaactcaagataccggaaatgaccatcgttagtgcgtcagtcgagcgaattcaggtgcagcacaaaagtcccggagagaaccactggagtgggaaatccattggatcgccggaagaggttgccagaccaaaatggaactttggaagcgggactgttggtgccaattaaatttgggactttcccggaacagacattgtgggaaaaagtagcaattaggaaaacgggttggcccagtctatttattcctactgccgtgag

SEQ ID NO: 671567 - DNA, 106 bp, Homo sapiens
acgggcctccttagctcccgagcctcctctacttcatccgactctgggaggctttcaagcagaacactcctttcctcacctggaatgcacttattgcggcggcggg

SEQ ID NO: 671568 - DNA, 509 bp, Homo sapiens
ccttcgacgggtctgtgaatgtgactgttgtataagggatgctgtgaggcattaaataagctattctcaactgttcatgacacacagtttttctctccttagcagaggatacacatagctccaattatcaaagggtatgacacttgtttttaaaaggtggggaagcagacagtattttcacataatatcatttgagcaaataaattcttccttaatatttttgagtcatgatatgccagcactgctgttccttaacctaatacaattatacttaggtctgcattgtaaatggaaaactggtcttctacatgacaagatttactctaactaaactacaggctggaggtgggggacctcccatttcaactaaaagaatccatgtcacaccttaagtgtgataaaaatttagtgactaaaaaaataccctaaactaattgtaacttcacttcttctcattccatcagtaacttttagaacaccgaactgctaaaaaatacacatcagcatta

SEQ ID NO: 671569 - DNA, 690 bp, Homo sapiens
  misc_feature (656)..(656): n is a, c, g, or t
gggcttgaggaatttggcaccgggcgggatcggtgctgttgccttttatactgaagatgccgccccaccccaagcagatgtttccgtcagcgctgccctgagtcagtcggtccccccgttctgctctcctcccttttggggttctgctcacttcaagcttcttccatggacttttcagggcacagtcatctctagcccccaaatcatctcttcatcctctgtgtggggcattttttaacccaatgagacaagaaagtcatactttggggcagcagaatttctaatttagtagaatcactgtatagagatagatgctgatatataatgtttgtgcacataaatcaaacccaattcggatagggggaagagtcgctttaacagatgcggccgaagagagctttttagaggtccggtgtctaagactgctcgccctggccgcaccctggcgttcggtacccttgccacccctgaacaccattccgccctgggtccgaatgccccgcgcctcttgatctctccgtccgcacccgttactccacttattccctgaacaccttgggccagctaattctcccattcttgacgtctcccacccctcgcgggttgactttgtgatggtccagagcgactcccaccgcctgcgctgccctcgctgntcctcctccccttcccttgctctccgtcctctcc

SEQ ID NO: 671570 - DNA, 95 bp, Homo sapiens
gcggccgcctactactactactactactgctcgaattcaagcttctaacgatgtacggggacatgctgggttaataaattgcctcattcgtaaac

SEQ ID NO: 671571 - DNA, 574 bp, Homo sapiens
  misc_feature (60)..(61): n is a, c, g, or t
  misc_feature (108)..(108): n is a, c, g, or t
  misc_feature (110)..(110): n is a, c, g, or t
  misc_feature (117)..(117): n is a, c, g, or t
  misc_feature (130)..(130): n is a, c, g, or t
  misc_feature (135)..(135): n is a, c, g, or t
  misc_feature (151)..(152): n is a, c, g, or t
  misc_feature (155)..(158): n is a, c, g, or t
  misc_feature (168)..(168): n is a, c, g, or t
  misc_feature (193)..(193): n is a, c, g, or t
  misc_feature (204)..(204): n is a, c, g, or t
  misc_feature (223)..(223): n is a, c, g, or t
  misc_feature (241)..(241): n is a, c, g, or t
  misc_feature (244)..(244): n is a, c, g, or t
  misc_feature (256)..(256): n is a, c, g, or t
  misc_feature (293)..(293): n is a, c, g, or t
  misc_feature (327)..(327): n is a, c, g, or t
  misc_feature (363)..(363): n is a, c, g, or t
  misc_feature (373)..(373): n is a, c, g, or t
  misc_feature (419)..(419): n is a, c, g, or t
  misc_feature (425)..(425): n is a, c, g, or t
  misc_feature (474)..(474): n is a, c, g, or t
  misc_feature (486)..(486): n is a, c, g, or t
  misc_feature (540)..(540): n is a, c, g, or t
tgttgattcttactattctctggctaatcagagacttccaaccttttttcttcaaaaagnncatttttaatagactaaatactggttatcactgcctttttgtttaangnacaacanccgcatggctcanatgtnacttgtcgttctcggnnggnnnnggggttttgngtgatgaatacagagaaggtagggngcgcctttggntgttttgggtgccactgtnctcttgggagggtattcnagncttctaggatgncagagttaagaaccatttccaaggggcgggggagatncagggtcacaacataacttctgaacaagtgtgtncgcgtatatatatatgtatatagatgtattaagatnggtgcaaaantaattgcaggttttgccataaaagtcatggcaaaaaccacaattanttatgnaccaacctaatatatgtgtgaaacagagaaaaggatgtcaaactacttnatttatttctgntaaattaacttctggaatttgaagcaaacattttgcttgatcaaaatgtgttcntcttcggggtgtttgatcccaattccatgctaaa

SEQ ID NO: 671572 - DNA, 101 bp, Homo sapiens
ccggctggaaagagaggtaggtcgttctctctgtttacaacatttattggcgcatcatcaattccagggcccgaggacacagctgcgtcaacgaactcgaa

SEQ ID NO: 671573 - DNA, 119 bp, Homo sapiens
tggatcttagacattcaagactcaatgctttaaagacatatatatatgtatatatatactgtctaacattttatggaacgttaaaaatcagaggcttttccctgatgatggctctgggg

SEQ ID NO: 671574 - DNA, 493 bp, Homo sapiens
tcacgggattactcaaagctgcatcttaggtctttgccggtgcaattctgtctttccagttacctagcgttaaaaccttgcagttcttgactcatctttctctctagtaccacgtatctcaattctctctgcataaaaattgtctgttctcccttcataatatagtcatcgtgtcattttattatggggatacattcagaaatgcgtcattaggatattatcatggctgtgtgaacatcagagtatacatagacaaacctagattgtatagcctactacacatctaggctatatggtgtggccaattactatgatgaatactgtaggttattgtaacataaaggtaggtatttttatctaaacgtattgaaacatagaaaaagtacagtaaaaaatatggtatcaaaaataaaaaatggtacaactgtataaggcagttgtgatgaatggagcttgcaggatatgttgctctgggtgagtcagcgagtgacga

SEQ ID NO: 671575 - DNA, 960 bp, Homo sapiens
cttttgtcaggctcactcatcacagcgcttagctcgacactgattgtttacactgaataggcctagaaataagacttggctaccttttgttccagtgtctaaccaagaaagataaacctcgctgccacagaaggctgtcggtcagagtattatctcgtacaccgctaaagactaagacgcctactccataaatcgcgtttctaaataggtctcatccctctgtactaaccaaatcactatcgtctcacggtacaattggacaccagtaaacacgagatagctaaccagagtcaatatctgcatcattaagtaaatctttacatggctattagtcacataagaagctgaaggaactacgtcccacctttcaacttgcgtggaggtactcgcaggagggtctagccgcaacggtcagccgcgctgctgaacatgccggatcctgtcattccatctcatcggacatgagcggaagaaaacgtagtcactcccgatacgtgcagagtgcagtactaaccagaagtttctcccccttcatgtaaacggtaagccgtttgtcctccaactgctctgcaaatttggttgatgttcatcactagggcaggccagtttgaggatgggattaaaaacgccaaaactccagactattgccaacacattctttaagacaatactctcgtctaatataccccactgtagggatgacatacctatacagtatctaccgtatcaatgctaagataacacgttcttagatttaagctactttaatagttatcctaactaatagcgaatggcctactactcgaaattagaagctccagcaagcacgagcctacttaatatatcgataacttgaaaacaaggctaagagtgacttaacaacctgtaaatccatgcaacccttcttttcctaagagggcctgcccccggtaagccgggtttttgtcccaatgggcattt

SEQ ID NO: 671576 - DNA, 159 bp, Homo sapiens
ccgttgttaggctctcagagagaccttcccctgcacacaccatcacctagcgtgtaattctccacattatagctgccatgatcttggtttacagtcagtctcctttctctaaatgtaagctgctggagagcagggatcttgtctatcatgtcaaggagt

SEQ ID NO: 671577 - DNA, 254 bp, Homo sapiens
  misc_feature (128)..(128): n is a, c, g, or t
  misc_feature (146)..(146): n is a, c, g, or t
  misc_feature (171)..(171): n is a, c, g, or t
  misc_feature (173)..(173): n is a, c, g, or t
  misc_feature (219)..(219): n is a, c, g, or t
  misc_feature (223)..(223): n is a, c, g, or t
ttggcagagggctagaagtaaaaaatgtaaagaaagaattggacagaatggggttgcgtgacgtatagttttgatttggtgaaatgcaactgaaggtggtgagcttgataaagggccacatggagggnaggggagatagtgagtgntttttggatgtgttttttgggtgananttaatgtggagtgggtggttggagttaaaaagaggggttgaggaanatgnaaatgaaaaaagatttatgaagtgatttgtt

SEQ ID NO: 671578 - DNA, 331 bp, Homo sapiens
tctttttttttaaccatagttcatcgaaaagcagctttttttgaacttcaaagatagaatcccctttttaatggactgaaggagcaaaatcatctttttccttttttagggaaaagctattgcccaagggaaggggtagataatacctagtcttgttacataaaggggatgtgggttgcagaaaaattttttttataaaattgaagttttaaggggcggcaggggttatgccctttttccagttccaaaatgattcccttcccttttagaaatttgaaggatgtaacctgaaatccttaataaaatttgggtttaattttataaaatggga

SEQ ID NO: 671579 - DNA, 545 bp, Homo sapiens
tgtctcagttcgggacgccagatctggagcaagaagatctcaggcagtgaccctctagatggaagcactgtctgtggtctaagaaaagatcgtgcatccttttagaggtgtactgttgtgagaaaatcaacgttgaagatgctgctgatcttggtaacacattggcagagcgtgcttatcatcagacttgcatgatgtgggggttctgttggtttggttttttttttccaagacagtgtctctgtggcccagactagagtgggtggcacctccaaccgagatctctggggctcaagtggtcctcttttaatttttggatttttggagacccactcgggtttcacggggagtgcagtagcagaatctctgtggacgggaaattccacctctcagtgtccagtgtttctaccacctcagccggccgaatcatggggaatccagtggcttgccatcaggtctggctactcattatggtttttctggttatttttttagggggggggagatccgctcttgttgcccgggtgggggggattagggcgatc

SEQ ID NO: 671580 - DNA, 329 bp, Homo sapiens
tacttaaaaagggtatttttttcctaattataaaactgatgtgtcagttacggaaaaatcagaaatgcagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagtgagactccgtctcaaataaaaaacaac

SEQ ID NO: 671581 - DNA, 118 bp, Homo sapiens
aaccgaatgccgtgccttctggtccgaatcggaggtgggctcttcggtcatacacgaggggggacggtgtactcacttcccagcccccagcatatcttctcaaagacctcatagttgg

SEQ ID NO: 671582 - DNA, 137 bp, Homo sapiens
cgctgcaggctcagtgccagagttctctccatgtcctcaaactcttccatgcagcacatggtcaggaaggctagctccatgtcaatgttcatccaacatgcaggcctccaccttgttgaatttgcactcctcttccc

SEQ ID NO: 671583 - DNA, 289 bp, Homo sapiens
tcgagctggacccctttcctctctacgatccatccctctctcacggagaactgaaaacgtgctcatattaaaacttgtacacaaataccgataacagcattattaatagccaaaaagtggaaacgactgccgatgctcattaatcagagtagataaaatgtgtatctctatacaatggaatattggttggcaataaaaaggaatgaaatgctgatacatgctacaacataggtgaaccttgaaaacattgtaataagtgaaagaagccaggcgtgaaagaaggaaggat

SEQ ID NO: 671584 - DNA, 1247 bp, Homo sapiens
gcttcgatgccaactaacattgatggctgtctgtgacccccgtcatggccgatacctcaccgtggctgctgtcttccgtgttctgtactgtccaatgaatggaggtcagatgagtcaagatagtcttaacagtgcatgaatcagtgaacatgcagctactttgtgcgacatgagatcccataacaatgtccacgactgtccgtcttgtcgacatccgcgatcgtcgtggtcgtctgatgatggcaagtcacctttctagttggcaagtagtacagccgatccaggtgagctcttcaagcgcattcttcggagcaggtctacgtgccaatgttcgcgggcggatagggggcgttccctccgaaatgggtaacacgaggcagcagtggcattaggacctgatgagtggactttcagcctgaggggctgtaagagctagacaatgatagcgaacccctcgttcttcgttgaagcctaattcagtgcacagctatgcctatgaggaattgcccatgcggcacgaaacgcacgggaaggaagggagtcttcctgcgtggagcgcagggcccgggaaagcattcgcaagtgccccttacaggagccagtagaccgcctcagtattaaaccactttagcggctttcttcaagggtgtcccactcaagtcgcggatacttttcattgtcaaaatgcgtggtggcccgcccttgtacgcgatccttcacgctacccaggaaaagtaacgcgagggttttggggcatgccccatccttaattccgtgggtacggtcgtgggctgaacaaataacagtacatcattgacagagagtcgtgggtccactagttaactcacggtgtgcccttgtggtcagagcacatatgttcaaggccggacgatcgaaatttaagactctaaaccttttgggctctatgcgcgatccggtacacctaaaagaccaccatttggaataacgcttgcccacttatgaccactatacagtacacgcacccaagagacaagatgcaccacagcaagttcctagtcacaaatttacacaatccggtcacatattatccaattgagaacagcagcgtgaatgccttcgcaggcgctgcaacacttagctatattggacgccaagagattgaaatcactcagtccgtcctaagttggccagtaggacagtaatgggggactcagaaccctcctatagactatggtatgtgccacgttacagatgtagcaccgccc

SEQ ID NO: 671585 - DNA, 359 bp, Homo sapiens
  misc_feature (11)..(11): n is a, c, g, or t
  misc_feature (31)..(31): n is a, c, g, or t
  misc_feature (42)..(42): n is a, c, g, or t
  misc_feature (66)..(66): n is a, c, g, or t
  misc_feature (72)..(72): n is a, c, g, or t
  misc_feature (101)..(101): n is a, c, g, or t
  misc_feature (112)..(112): n is a, c, g, or t
  misc_feature (137)..(137): n is a, c, g, or t
  misc_feature (269)..(269): n is a, c, g, or t
  misc_feature (305)..(305): n is a, c, g, or t
  misc_feature (321)..(321): n is a, c, g, or t
ctcccctgaanagtggaaatgtctggacccncccagcagaanttgtatagagatgtgatgttgganaactanaggaacctggtctccctgggttttgtganctctaacccanacctggtcacctgtctggagcaaanaaaagaccctgcaatttgaagatacatgagacagcagccaaacccccagttgttcagcacttctggtctcttcagttctgatatgattttagattgctcctttttttttttgaggcggagtggagtgagtgngccatctcgtttattgaagtccgcctcccatgtcanaccattgcctcctcanccttccctagtagctgggctacaggtcccgccaccacg

SEQ ID NO: 671586 - DNA, 243 bp, Homo sapiens
aaggatttcttttttgggtacagaatctcactccatcacccaggctggagtgctatgacaagatcatggctcgctggagcctcaatatcctgggctcaagcaatcctcccacctcagattctccagtagctgggactacttaggggcatgacaccatgtctggttaattttttttttttttttggaatttttcctccaccgggacggggagggggatcctttagaggcaacctagaggcttcc

SEQ ID NO: 671587 - DNA, 653 bp, Homo sapiens
cggactgcggcagcgcctctgtctcgctttatctgatttttcccccctttcccctttctttttattttattctcttttcttttctcccactcccccccttaacaaatttcccctacggaggcgctaacccctgggaagggtgaaagccggtcctcaaccccacagcgatgactgacacggacaacacagccagacggaacacgacccacacgggaacccacacgcacacaaaacacgcggcccacacaacccgcacacacacacaaaacgaaagcaacgcaaacgacgcagatccgacgaactacacgcacagacaagaaacagaaacaagccgaccaacaaacgacgacacacaagaagcaaaaacagcagagaccaagaacacacgacaaacaccacgacgactaccaaacacacacaccaacaaccccacctacaaaagaagcagagcaagacagaacagagcaagacaccatcaagagcgaaacaccaggaacgcgagaccaacgagcaacaacaagacgacaacagaacaacagaccacacagagaacacacaacgaacatcagagaaacgtcgaaacaacagagatcacgacagaagcgaacaaagacaaagccaacgaagaggcagaaaacaaaagcgacgacaga

SEQ ID NO: 671588 - DNA, 1558 bp, Homo sapiens
  misc_feature (252)..(252): n is a, c, g, or t
  misc_feature (348)..(348): n is a, c, g, or t
  misc_feature (461)..(461): n is a, c, g, or t
  misc_feature (629)..(629): n is a, c, g, or t
  misc_feature (719)..(719): n is a, c, g, or t
gcgcgattgcatcggtgggcgtcatgtctgtggtcgtgctcgggtgagcattcgttggggtacactgggggtgacgcatggacacgtgcatgctcccgggccgggttactaggcttcagaccgggaggcagcacgctctgtagggaactatcccgcgcgccatcgcatggctcgcaagtttcgactagcgcgtataccgtagggacattgagcgaaggacgttggtgccatgcaagtcctccgtgcagattnctgcgcgtacactgcggacctgtgggctgtgggagtacacgaatgggtggaagcacatgggacgagagagctgcgttgtgcaggtgcgtgaagaanccagatggggtgagaaccatggactccccacagagggcgtgggttcgcgcgccagtgggagagcggcgtacagtgcgcatatacaacgcagtgcaggcgttagttggagcgtnctctcaatgcatactcgctggtttgggcagtatagcaccacgtccacgtcgtgtcgcgatgtgtgggagtacgtggcgcgtcttatactagatgacttctgcgcaaataaatgtgatcaattcaaggcacgggcggatcgtcattacccacgagaacctcgatacatngagacactccggcaaggcgtactttacgcgcagtcgagacgttaagtaaaccagagacttgggcaccccaagtggggtgtccaatcttcnttgtagaggacacagggcttgtgcggggcctgtcggagctattcccttgtgaaactccacatgtgccaacgagcgcttcaatccttaggaacaggatggcccacgacgcgaacttgcaaggttcatgggtgggtggtctggaaggacgcatggagagtctggcctaaggccctaggagcctcttgtctaaatctttgtcaggaactaggatcactggtggcctgaagggccttcccagcgttccttgacggggtctgaagggcccagtcaagccgctcgtatgaaagagttagggcctccgtgggtgttttggtggcctccccacgtacaagattgggcttctgggggcgaataaactttcctatgaatttaattcccctgggaatgggcccagggggaagggctcgtccctgggtctacaaggcaagggttgagttgaaccgggggggttccccagagggattgccctccttggaagagaccacagtctctgtgggtgagtttacccccgtggtttgtgttccccctttttggccctgtgagtggtgcagaagaaagagacttctggggtttcatatgcgcagaagtccgcccgtaatggtagtgctacagggtaaagggttcttttctccccccttttgaagactcggaggggcgttagaaactcacaactggtgtgtagaccacgcctgtgtagggtgatcaacacgccaatattagacgagtcgcaagagtaaagaacgaaaccaaacgagtagtagttgagcaacagagggcgtgtctactctacaaaagtgatctctgcgcgacaacagacaaagagcgccttctctgcgaca

SEQ ID NO: 671589 - DNA, 173 bp, Homo sapiens
agggactctatattaaaacatactaaacaaatggggcctcgtggaggaaggtggagagaagagagcctttaggattccttttgctttgaagatagaataatcattacttccttctccaaatatcttttggcccttcctagaaccacgatggcggatgttcggaatttttaata

SEQ ID NO: 671590 - DNA, 294 bp, Homo sapiens
  misc_feature (7)..(7): n is a, c, g, or t
  misc_feature (11)..(11): n is a, c, g, or t
  misc_feature (29)..(29): n is a, c, g, or t
  misc_feature (173)..(173): n is a, c, g, or t
  misc_feature (175)..(175): n is a, c, g, or t
  misc_feature (269)..(269): n is a, c, g, or t
ggggaanccantggacgcgcagattgtcnggtctcccaacattcacatggttttctctccagagatcattcttagaagccaggctaaatcagagtagtctgtttttaaagaagatattggatgatggctatagggacttaatgctgtgttgaaattggagagctgctcttcananacatatactcaactgaagtagagcagactgagcgagggagtagtaaatgctgtggatatttcatgtctgttgtaatgctctcttgggagttctngggtgcattaaatagattattaggt

SEQ ID NO: 671591 - DNA, 335 bp, Homo sapiens
actgagtacacaacctgcaccatgtgaaaaatacaagggctcactaagtatgacaactacatcatcggccgggcacgagggcacacacctgtcatcctagcgcttagggcagctgaggtgggtggatctcaaagtgctgagataataggcatgagccaccacatccgtccttatatacatgtataagagattgtgtctcattctgtcaccccaataggagtgtagcagaagtgatcacagctaaactgcacccttaaataaacaggacttaagtgattctcctgcctcaaactcctgagtaagctaggataaaacgcgcctgccaccacacttgg

SEQ ID NO: 671592 - DNA, 347 bp, Homo sapiens
  misc_feature (303)..(303): n is a, c, g, or t
ggagtttgagaccagcctgggcaacatagcaaatgttatgttgccacctctacaaataattagccaagtgtggtggcatgcacctgtagtcccagatactcaggaggctgaggcaggagaatcacaggtcgaggttgtagtgagctgtgatggcactgcactccagccttggcaacacagtaagaccccgtctctaaaaaagcaaaaagggctgggtgcactggctcacacctataatcccagcactttgggaggccaagacgggtggatcacctgaggtcaggagttcaagataagcctggncaacatggtgataccctgtctttaattagccaggtgtagtagta

SEQ ID NO: 671593 - DNA, 310 bp, Homo sapiens
tagtgtttctatgttcttctgcctacttttattctggccacactgggcagtgagtagattgtgctctcccagattgagggtgggtctgcctttcccagtccactgactcaaatgttaatctcccttggcaaccccttcatagtcacatccaggaatgatattttgcatccttcaatccaatcaagttaacattcaatattaaccatcaagagtccaccccttgtcaacctgaacccacacacatctcctgaagtcatacatgattttcaaataaagaaaataaagacaaaaggccaaaattatgcctaaa

SEQ ID NO: 671594 - DNA, 1528 bp, Homo sapiens
  misc_feature (734)..(734): n is a, c, g, or t
ccaggtgggcccgcagttggaaccattcttggtccctggcaactggcgcaccatggagttcaagtagattctccagcgccctctcccgagtagctgcgattacaggcttccaccaccacgccgggccaattttttggtattctcagtaaaaagtggggctttcaccacgtttgttccaggccggttcttcaaactctcccgacctctcaagtgtgactccacccacctctcggcctctcccaaagtgtgccgggatctcacaggcattgtagccaccgagccccagcccgggaaacccaacaggttttttgtggatgtgtttcttcttgaaattgttcatgtgtataactctcttttatatttttttatattctaacaaacaacttttttgtgtgaccccagtatattcttgtgcgtggtgtgatgtgcccaaagacactgtgggagttgcccagcgtggcaaagatatccacagcggtctcacatgtgtcaagctttctccaaactctcccgcgtgtctctccagagtgtgaaatcttataccgtggtcaaacatgtgaagtatctttcgccaagagtgtcagtatgtgtgaacacacaacacagggtgttgccgcaaagaccacacacaaacacacactgtgggctttaaatatatagtgggaatatgtggggcttatgtagtggatatatatatatctaagcaaaaaagtgggggggctctctatctcgcngctattaacaggagttgtggccctgattatattacctggtggggtgctctcttcgagacaactgttgggatgtggaggacccttcatacaaaggaggaccaaaacatctctcttctcgccgcccccttttggtgtggacccccagccccccaacaaaaaagtggtgttcctattgggagacatattttaccccaggaggcgcccagccaagaaggctcctcccatcctgtttgttgtggtgccaaccatgaggagtctgtttgtcaacgacgcaatcgttctttttttcatggtgggcaagcgtattattaagagacatccatataatacatgtaggaggttagtacacccaatgttgtggctgaccacattaatgattgtagtatcaaaagtatatcttgccaagtcattaaggaggaaagaatcttccccccaatattaaaaatcgatgttgtggcaacacaacagtggggagcaacaacaacagttcttccccgatagagcacggagctttaccacaggaacaagcgccgaccaatcacttaacccctgctatttatgtttcgtgcaatgtagccgaacaaaccaagccacgctatttgtgcaacattacgcatatatcttagtcaagcacgtcctatcaaacgaacacaagggctattgtatacgtgatttagatatagcgccccgagatcaaatacacgtatgttaaaaagagatgggttgagccacactagtagtgcatcattattcaaagcgcgacaataaacacactcaccacacatggtgatgaa

SEQ ID NO: 671595 - DNA, 326 bp, Homo sapiens
cctcaagtgatccacctgccttggcctcccaaagtgctgggattaacaggcgtgagccacgcacctggcctatttttatttttaatcaagttgtgggcctagcttaatactggtttgtgtaatttgctccaagcactagaatatatctaaagaaaataggctataataaggaatatttttaaaaagatagaagtggccaggtgtgacagctcatgcctgtaatcctagcactttaggaggccgagatgggtggaccacttgagctcaggagttggagaccagcctggccaacaggtcaaaaccctgtctctaccaagaatacacat

SEQ ID NO: 671596 - DNA, 326 bp, Homo sapiens
tttgctctacatgcgccgggcttgatggcctcgggacagcacagatatgcataggtcaggtccttcatggcctctgcaccatctgcaggtgccacctgccccttttggcgttggccttgtcaacagaggccacactcgcagatgagctgctcacgggccttggtgttgactgcaatggtgaatctcacgtgtgtcaccagcgagcttgaaactggggttcacagcaggcagctggtggtacattgcaatgggcaaacactcagacaccagcatgtgttcgccgcaaggtgggtgatgagctggtggacgtggaagtcactaggaac

SEQ ID NO: 671597 - DNA, 136 bp, Homo sapiens
tatgagtgctggagaccaggccgtgggtcactaaccattcagtgccagacttgtcttgcagtcactgtgccgcagaaatgcatacttgtgcttatggcagcagcattgagcatgcacttaatccattatccagtgt

SEQ ID NO: 671598 - DNA, 192 bp, Homo sapiens
tgagctggtccgcgaggtcgttggcgcgcgcaccgcattgcgcaggtcatcggcggtcaggccgagcgcgttcatcaggcgcaggttgacgtccacgcgcaccgccggcgtcgaggcaccggcaatgtcgaccgaagcaacgccgctgatctggcggaggcgctgggccagcagcgaatcggcgacgttgta

SEQ ID NO: 671599 - DNA, 103 bp, Homo sapiens
gaggtgggtgatatagacagcaggacgggggccattcaacgcctccgggccattcaacgcctccgtgccattcaacgacctgggtacctgagactcgaagggg

SEQ ID NO: 671600 - DNA, 158 bp, Homo sapiens
gccgcttggacctttgacttctaagatttggtctacatcgtaaagtgtccacaggcagactcacagctgccaagcgttgatgatcatcagactaacgtaccgcctatgcttgtacatttacaaatactaggcatagtgccaagctgtaacatggacat

SEQ ID NO: 671601 - DNA, 685 bp, Homo sapiens
gcagggtgtaggcagcatggcgcccagccggaatggcatggtcttgaagccccacttccacaaggactggcagcggcgcgtggcacgtggttcaaccagccggcccgtaagatccgcagacgtaaggcccggcaagccaaggcgcgccgatcgccccgcgccccgcgtcgggtcccatcctggcccatcgtgctgctgccccacggttcgggtaccacactgaaggtgcgcgcctggccggcggcttcagccttggaggaagctccagggttggccggggcatttcaaccaaggacacgggtggcccgggaccaatcggcatttctgtggatccgaggaggcggacacaagtccactggagtccctgcaggccaacgtgcagcgcgctgaaggagtacccgctccaaactcatcctcttccccaggaagccctcgggcccccccaagaacggggagcaccagttcgtgctgacagaacctgaaaccttggccacccaggttgacccgggacccggggtccaattgccccggtccggacacggtctatacaggacggagaaaagctcgagttcatcacctgagggaagagaccgaatttcaaaagcctctcgcctaggtcatccgggttaatgggcccgttgccaactgccccgggcttcttcggcgcataccggggcaacaacag

SEQ ID NO: 671602 - DNA, 1500 bp, Homo sapiens
  misc_feature (1098)..(1098): n is a, c, g, or t
ctactgaacgtttcccgtaacagtactagcacaccatactcactttctctcacccagctgcttcacagacccaaacttcttaaactaagtgactggccactaacccacttaactgcaaacacaagctgttctgactatacatcttgccttctctcctctacaacacactggcacacactcctgcaagctgctcgccctgcacaaccactgctactcttgccctccacctgcagcagcccttctcatcaagctacacggttccccctctcagccccactctctcctccacacacgcgacacgcagcttaacacacactgctgcctgcctgcacctcttctgcctaactgcacgcgcttctctaaacgcttgcctgccaccactcggacacgaactctagccctcaaacccccaagcgcacacctgcacaccgccactcttgccaccgtcttaccgcatacttcctctctccgcactgcacgcacacatcaacactctcgtgcacgcttacttacccgagacaccacgctgcacaaaacccctgtctctctgcaggcgaagcacccacttcctacccacgcactacacctacactctggcctcgcttaaaggcccaaaaccgttgaactagcccgtggacttgcttagcgcccaccctaaaacgcgccggggaacgccgaactccaaaaccggaactctctccaacgcggaacgccttcctcatcataagctcctccaacttctgacttccacagaccttaacaccttcctcgtcggcccacgacacactacggctagcaaccgaagcacccccttaacgttggtacacggcggcccacacccgtggcacccctttttctcccccccggccccacgccaaagcctttcccaacccaccgcaaccctttctgcaacgcccaacacgcggaacgaaaaaatttccgcggccaagccgtggggttccccttgtcaacttggggcgcccgaccttggagcccccccacgaacactggcaacacgcggaagctcccatttggcgcacgcaaatatagcgcgacaccccccctggcgacacaacttgcgccttcacactgtcgacntccctcccccaggcttcatctaggcctttaaggcccccacacggcttctcccttacgttgaccgcaaaggctcaaccccccgcaatgtaggcgcctttcacgcggcaacgcagcccccttgggcccgccttggaccttcggcccgcttgtggcgcccccccggcccgcttcgccgtgtctttcccccactcctgggcgccgccaacttctcttccacgcacagcgcccctggcggccaccggctgcgtcctcatcgtgctcctccctgctctggtcccggcgctccctactctcttgcgccgccgacgacgtgtcctcctccccactctgccctccagcaccacccttatttgtgccgtaacagcgcgcacgtcttcacccgcgccctcgatcgcgcgtcct

SEQ ID NO: 671603 - DNA, 111 bp, Homo sapiens
aaacaatcacttaattggttattagaggggttagaacctttctcaaattattattgaaatgtggaacattgctgtctttgtaaagtaagctaagaaaatgtattgtgattg

SEQ ID NO: 671604 - DNA, 545 bp, Homo sapiens
aaacaggctaggtacgaggcctgggttgcgggcatctacgcctatggtctggagacgccctctggcatccagcagcgaggccattctacctggtactcgaagggttatgatgtgatggctcaagcccgatctgggactgggaagacgggcacattgccatatcgattctgcagcagatggaattagatctaaaagccacccaggcctgggtcctagcgagcccactcgagaacttggctcagcagcatatcagaaggtggtcactgtgcacataggaggactactagtggtgcgcctcctgttcacgcctgtatcgggggcgaccaaacgtgcgtgctgaggtgcggaaacgtgcagatggaagctccccacatcatcgtgggtacccccggggcgtgtgttggatatgcttgaatcggagatacctgtgcccccaagactacatcgaacgatgttctgtacatggatgaagctgacgaaatgttaagccgtggattcggggatgcagatctaatgacatattccaaaagctcaagagcaagcac

SEQ ID NO: 671605 - DNA, 115 bp, Homo sapiens
  misc_feature (74)..(74): n is a, c, g, or t
agatgtggctgagtcacccctcgagagaagggaaattctactcatggcaaggaaatcctcagttaagcttcagntgagccacaagcacttaaaacccatgaaccttcagctgatc

SEQ ID NO: 671606 - DNA, 1268 bp, Homo sapiens
ggctgaattgggccagagaggtctcattggctgaattcctagccccggctcgtcggagtgcgggaccctgagtagcgctaagcctacggaagctgggtctccgttgcgtgttgatgcgctggatggtcgcgtgcgggtagtggcggtcggtctgcgttgcgtgccgtcagtccacgtcggcgtccgtcgcttaggctccatgtggacgcttgaccctcccagtgtgcagtgggacggcttgcgtcgggggtattgcttgcatgattcgttccgggcacggggtgctgggcctgggtcttcggacctaaccggcaaggcaaggtgcctgaggttcgcctggtcggagagatggcagacgacgtgtcgatcctgagaagcaccggtagcagggtggctgaagtctgacgggtcattccctggcatactccggtgcctagcttcacacagttcgatgctcctcgcgtagcgccgagcgtcactcgtagctccctcatgagtgtcacgtgcctgggatcagagtttcccttggacgtgggtttcgcacgctagggacgcgcgattgtggttgctggggccgtacgctggcgagcctccgactggttgttcagccggcccggtgccctaggcttggagcgattaactgacacccaggtgtatgctagtggtggccatgacaggacacgttcaaggagcaagttagctgtactgccgatagtaccataggacgaggagcccgcagtgctgctgggtgccgtgatgccgcccggaatggcccttgtgtcccgccatgacaagtgcacttggggcagtgggccacggtaccttgggtcggcgctattccttgctcttgcccgccttctcgtgccgagcgtaagtgaaggggtgtttgcaccagtgggcccccccggaggggccgcgaccagagcttatctgcgttaacagttggctttgccccattgaaaggttgcggcgcctgcctgggggtcttcagagttggccacttggacccggtgtcaataggcctaggcgccccggggaagctggaaccttcgtcagccatttcactcggggaacttccccttaagaaaagctttggcccagacccggaaggaacctcacgagttaaaccttgacacacagaaggatctggcgggcactaaacccggccggttgggggggggactctcgtaacttccttccttgggaagtttaatacacacacgacaggaagaatatgccacaaatagcttcgcggggaggggcaaccc

SEQ ID NO: 671607 - DNA, 394 bp, Homo sapiens
gtacaggaaagctatccaggaacagctataccaggaacagctgtaccaggaatctgtctatagccgtcaacctgctcttcggggaggccgatataccggagtcatcagctcttctcaggaaacctagatatatcggggtaatccgtcctgcttgcgaataatggcatcagccttcataggctatgtcctcccgtgaggcctaatatcattctgagggtccacagtaattacaaatttactatccgccatcccatacatcgggacagacctagttcaatgaatctgaggaggctcctcagtagacagtcccaccctcacacgattctttacctttcacttcatcttgcccttcattattgcagccctagcagaactccacctcctattcttgcac

SEQ ID NO: 671608 - DNA, 1077 bp, Homo sapiens
tgtgtgttattggattagggatgggccttgtgaagcgtttttttgtgtgtgtatttataatgtgggtctttagtgaagaaacttgcccgtaaagcgcacagtgtatattgtcatatcttatagcatagggttctagcgataatgtgtgtccaggtttccctggtaatgagtcattacgtggttgaacattatacaccggttattttcatagttaggatttgtcaggtgagggcattgttgtggcctacagtttcacatgtaccttttgtctgtcttgaaagctagccggtatctaccgtagatatgttttggaagtttatcagaaactaaatgtactgtttaaaactgtatagggtcagggttgggggtaaaattacaggtatagtaagtaagaaagagtgactcctatgaatgaaagcagtcgtgagtttgtatgttgcttgactgtgattaatatgcggggctggtgtaagttgtaatgtggtgggctgacttgctcgtgtaactatgtacatgacttgttagggatggctgtcccatattttgtatattcggaatcatcagttctataaattgattgtaactagaatgtaatatattctaaattaagtcccacttcttaagtcacatggtttctgtcttggaaattttacctgtaaaagattatttaaagacaggaaccaggatggctttgggaacagggaaagacgggaaatgttgtattatgtgggtcattggggcctctaaccatcagtatagggtttatttcatcttccttgatggcagtagaaagacgctcattcgtcataacagtaactactcgttgatacctttcgtttacagacactttttattgaagattctatcatgaggtatttggctgggagatgggaggctaaagcgctcatgtcctggctcttcagtgtatttaactgtgtgaccttgggcaagtcacctaaccatctccgtgtattctagtctccctgtccttgtatatatgggagtaatacctacctcacagggttgttgtggggattaattagagataatgtctgtataacatcagagggtctgaag

SEQ ID NO: 671609 - DNA, 925 bp, Homo sapiens
tctgttctagccatacattaatttccaagcttctcgggacaaccctgtaacagcccctctgcctcttctttttccaggttcaataaccatgccttgaacaagccctgagacaacaaatgtttctctggaaaaatcctccactttttacagcgtcccaaacctcaacgttccgccgtgaccccctaccaagttttgccaagtctttctttcccacacagcccagttggtccctccacccctcgataaaaccctgggacaacccatcccaaataacccggtcgcagcaccgcggcacaccgtggccacaccataacccctcaatcatctgtgtgagccctccgtcacaccacctctaatgtatgacgctttatccccatgttgcacccgggcctctctcaaccacctgttgcccccacatgcatttcacaccacttttcagggcttgtctcccacgacgtgcttaatacccggccatatttctaaaccaccgttatatacatgaactttccaagctgtatatatcttcccccccctgataatcgctatcaaaccaatctcccccacaaacacttgtccacctgggccacctccccacattctcagagtcaaacacttttagtcttaaaccccaaacccggtgttgcagtaatacaaaaaggaaaacaactcttctatctcccaaaaccaacaaccatgcataagccactccagaaaaacaattatacaggaatatcttttaagaacaccaacatttcatccgccatagttcaaacatatgtttaacctccttccctccagccagcgagttactgttagtagttacatatctgtctcaccacccccctcacccgattgagcttcccccctggctaataaaccaaagccccctatcaataaatttttggttaaacaccccaccaaaaca

SEQ ID NO: 671610 - DNA, 260 bp, Homo sapiens
cccccccgcatcagagcagtctatagacatcatcaaaagcaggccttgggattctgggctttgagtacaaaccacggatctggtgcagaaacaagtagagactcctccattccttccagaattttcagagatgaggtagacccacctcaaccatcctcagcatcagttggctaaattgccaggctcaatgacaagctctcctgccatctccaagcccacttttcatagttccgctctgtcttgggctgcagcactttagg

SEQ ID NO: 671611 - DNA, 1489 bp, Homo sapiens
  misc_feature (1)..(1): n is a, c, g, or t
  misc_feature (1267)..(1267): n is a, c, g, or t
  misc_feature (1353)..(1353): n is a, c, g, or t
ntcacgcatgtgggtgttgtctcaccacgctcggtggagaaggctggcgggcctatatcattatgaccgagggggggggcgccacccaaaagaggggtattatatattgtgtcgtcggcacgcccctggtgtgggttgcgaggccgcccccgccaacatgtggtgctcgtaccacagtggggttgtttgcaccacctctgatagggatgggtttgttgttactacccgctcgccgtctcctagatgtttttttcctggcccaagtgcgcgttgtcttgtgacgacagccacaccccaatcgttggctttttgacacacaccccccgtgggcgcaccaagggctgtcaatccccacagtggaccaaagacctttttggggtatttccggttgggagagggaaacctttcattgtggtacccccccccgtgtcccaatgcgcaattcagcctggccccccccagaagacctttgtggtgaatggggcccccccccccgggggaatccttttgggccgcttgtatggccccccgcggggctttctcaccagagacaattgcaatggcccctggcgctttctgatactttgggcgcaacgtgtccccaaaggactcgttgtggggcccaaagggttcaattctccccttgaggccttggtaccggcggagaggtgctttcaccctgggacacatggccctcttcccgctggtgccccccacactgggccccaacgtgtgtgtccacactgggttgggagacactcgagacctcgaccgctttctatagagaaaacgcgctcgtgcgcccacatgatgtgagtggacacactctcacagcagagaagggtttggttgagagagcacccagagcgctctcgcgagagggcccccccctcctccaaagggcacatctctctcggggcgtaacacacactctgagagacacacacacagagtggtgttctctcctctctgggagactgttccacacacacggcgggaacacacccgacactgtcgctctccacccctctgtggagacgcctcgtggggctcgggcgcacttgggcccttctcacaacgcacaccacactcttgtttcacagagctctcactgtttccgtcgggtattgtaccacaccgagaattttgtggctatacacgacacacacacaggcgttggtgtgaccctccactgtgcgccacacacatggcctctccacacaggagagtataagagacccctcggagccacccacgccccaccgcnccacagaggcacaccacaagagaggaaagagaagagaaccctccacctcgctgtgggaagttccctcgccaccacactcacgtccncccacccaccacctgaattctcccctccctcaccacgttgccacattgtagagacccctctgaaagaaggggaaggggcctaagggaagcccccccttgtcatgtaccatccataaagtaccctgtgctcaaccca

SEQ ID NO: 671612 - DNA, 647 bp, Homo sapiens
ggctgtaggaattcggtacgagctccaacatttgtgcacaacacgataatctgtcctcaaacgagaggactaacggatatttttcctaaaggacgcccatcaccttaaaagaatggactctgttaagtatgagagcgttttcctttgtaattgacatctggcccatcttatactgagagccgggaactcaggagtaggagcctagatatttaacctgatactcaatcaggaaatatatgatatccgtatttaaaatgaaggtagttatatttaatgagctccattcctaaatcctttttcggtaaaggagctctcatttatgagaatgctggccgaataacatgactaaatagaaggattgtaccgggagacattatgttactaaattagcacagtaaaaaactttcggtctctaaccaaatttgttgcgacaatagaacatgtaactgcccgggaaaacgaacggagaaaattagccgggaatatttgatctgaaacccaacgaaattaattcattaatgcccacccaagcggagccggttgctcccaaaaccacgaactccttatttaatgatctaaggggactaaaaaaagctcggggtttggcctactttctccccgcactattcccctcaccttcgatttgg

SEQ ID NO: 671613 - DNA, 312 bp, Homo sapiens
agattggaaaagctcctgcgggtgcgtgtgtgtgtgtgcacttgtgcacatgtatatagtgtgtgtggtgcatgtggggagtgcgagtgtgtggggtgtgtgtgtgcgtgtatttataaagtggcttacggaagagtcccgagtaggcacatcaggcgcttgggttcagatcctggaagtctgacctcagagctaagaacattgcagccacccctgtctcctctcttcttccccttccacatctaatccccagcaagtctaggcagctctcctctcagctgtaccctgaatccatccatttctctttctctc

SEQ ID NO: 671614 - DNA, 1082 bp, Homo sapiens
gcaggcggcgagaacgcgctgggggaacccttggtccgctctgcgcgtcgctctagcgatcctccgagaaatggatgcacgggctgcgaaaggctggccagggcttgggccaggcatctacgagaacgacttgccttggcagcatgtgctccactggcccaccgcgtggaccttgctagtcattggacatcgtggatgatgctcagctgtccctgtcgcgtgaacccttccttgcatgggagtccatcggtccatgtgcatcctggctgtggctgtcggacaccgcgcacccaccgtgctcggtggcaccttgccactggtgtgctcccgttagacctcgggctggtatgcgtctggttaagatggcggaagttgtcactgtcctggggacacggcgtaaacccctaaatccctgcctgcgccgaacctcctgacccccggtccccacggtgacgactagactgggcctccctgacgcgcagcgcggctgccgtggacaccgagtgcgttgcgaacacggagggacctttgtaacgccacgttgtttgctctttgttgaagaagaacaacgaataaatgtgttagacttgtctgatgaaaagtagcatgcttgaatcatcatcatgggctaacactaagcaccagtgggcaacattgtcagagggtgtctaggccagaaatcgttgatggaagccggcatgtcgcgaatgtgtttacccggacacccccgatatgtttgtgtgtcaacacaaggcgggcaaagttcttcgagggacgccccacaaaatggtagtggggcgaactaaaaactctgcgatatgcccgttataatccctgttatataacctgcccgtcaacaacagggggaggtaataatcgggacgatcttgcgctgagaacagagaacattaatcgaggggtcgaactgagaggacacgtcttgcctccgtatctcgcccgggagtacctgccggacatcccccggattttgcgatagatcggggtgagcatggatgtaagttgctttaggatacaaaaaggaccaataatataatgtcaccaccgatgggccgtcaagactc

SEQ ID NO: 671615 - DNA, 327 bp, Homo sapiens
tatgagccgcccagcttatcagtaggctatctggtcggcctttttgaagacattaacctgtatgttatccatgccaaacgtgtaacaatcatgccaaaagatgtccaactagcacaatgcatttgtagaaagcatccttaagaatctactatgatgggtcaggcatggtggctcacgcctgtaatccttggcctccactttacagacatgagccaccatgcctggccttttgttttgttttgttttgtttttttataagggcccaaacccattcatgagggctctaccctcattatataattaccttccaaaggttctacctccata

SEQ ID NO: 671616 - DNA, 158 bp, Homo sapiens
agtcgggaccccgggccgaatcctgtcgctcgtgcaaaataggagcttcagcctaaagaatgtgaagcactgtgggctggacgagcgtgacaagatgctggagcagctggacatgcggcgggatgtgcgggagatcttccgcctgacacctcacgaga

SEQ ID NO: 671617 - DNA, 1226 bp, Homo sapiens
tggatgcttccaaatttttatggaccagctaaggaaatcacaagggcaattaaaacctttgccacggtaaggcaaatgcccaatgtattaagaaagcgcaaagggcgcaagggttcactggattcacagcatgtcaagaaaaaatgtggctttaggagacccaaaaatattggttcccagcgcctggaaaagcgctttggtgtgggcaattcaagaaaaggggagattgagagatattaaatatcagaaagagacttacaggtcctggagatttggtggcgatgagaccctctccaggtattggagccctaatatattgtgagttctctctcctctatatatcctctatattctccccccaatctcttgcggggcgctctaaaattgaaaacttgtgaatgtgcgccccagagaaatgtgtgtacacaaaagtgggcgccccttactgctctatatcacctgtgatctgtggcgctattatctgtagagcctttaacagagtgggtttttttctctaacacgagaaaaactctagaggggtcccctttatgagggggtatcattaaagggaaagtattatttaccccgtgggtatatccttgtgaaaagcgatatatcctgtagagtacccttatgtgaggaaatctctgagggcgagagtcgtgaccatgacaatggggtttatatagaggaaagagtcttcttatataacaccacaattatgcgtcgaaaattatgcgacaacatttatgagagtgagtggcacatcttaatataatggcggggaccttgaggaaagacataactatctctgcaggaagtaaaaatagcgacaatattctgctccaattatacaacctgtggtgggtgcccggccctctaatcatacctcctatcttccaacagcgcaatttccccccgcttacgaaagtacgaatctacgacaaagagaacttacacatttacgatgatcaaaaattacaatgttacacatactctcattgtacaaaacaaccacagtcaaaataccccagctccgatgatacaaagaaccaatattccatcgtacggagaaccaaacaacacaaactctctgtcatcacaaagataacaaagcgaaacggaccccaagaagattattacacaacaccttattaatagtacacctgtagtgtggagcaaaaaaccccctcttagtgcaattaaaccacacgacgcatattaag

SEQ ID NO: 671618 - DNA, 192 bp, Homo sapiens
gtcttacgagtcaaagacagaagcgacatgtagctgagtgagccacgaagttgtacacaacaaaaggaatgatgaacttagaatttgtctatttaatcatctctttttctttctttccattttttttttttgtctttttcgggccgcaccctttgtatatcgagattccgtaacatcataaccactggggct

SEQ ID NO: 671619 - DNA, 1306 bp, Homo sapiens
  misc_feature (807)..(807): n is a, c, g, or t
agcgggcgcaaggtctggcctcgggtatccgtaacaggtgctctctatctacctccagactctcgcctgcgcgccagctccccgtgtttccttctgctcctaaccacgaacgagtgtggctggtgctctcctgacagacagcaaccgtcttgcatccgtggcatggttcaatcgcttgagtcggtgtgacgcgtgtgaccagtgaatgactcgctgtgtgatcgggtcgttcacatttgcaccggtcaaagtctcgttcggcgacctgagtaggagaagagactccaatgagatcggaccacacgtgtgatagcgacagagacgtggttagtggccagagcccgtcgcagatggtcagctattttggctctggtcagcgacagacgattcagatcaaatagcgtcgaatctatatcagaacagatagtacccaaacgaagacaagatcgctggcatagcattgagttgtggttgctcccccgctcgcttgaacacagctcagattcgagttagtccttgaggggatccaaatcctatcattcctttggggaacggattgagaaacgcattgagtccaccgaaaacctcacacgcatgttcatcgccaattagaaaccccatgtttggccaattcgtatgggaagcaatagctctgtggctccatatcacgaattggagcgcaatggctctaactattgcattcgtcccacttgtgaaatatgccaactatgcgttgtcctttcatctatgccgcaaggattacctgatcgcccttgctagtctcatgttgtagtcccggggcgacgnaccagaattggaacgcatttggttactgaagacaatacacaagtcatagatgccaagtgtaacagtcacgtgaacgcgcggatctttgatcacacaggcggctcgtggcacgtagatagacacgtaaataccagtcatacttgtaatgtgcgggcggggcacatttccacgggcgcccccattggttttctataccatggggctcacttatagattgatcgagtgaggggaagggagccaaactatgaggaaggaaaaaggatggatacacattttaaagtttcttcgagacacacacttcaggaaggaatctggaccaaattggaaatttgcatttccccagggttttgtaccaaaaaaggaaagacttttgagaaggcaggcgtttggcaacacatcggtggcaacaacacacacgaattggggtttcctttgaaggaaagccaagcgtttggttaaaaggacatccttggagaagcctttcttccagtggaaaccc

SEQ ID NO: 671620 - DNA, 1164 bp, Homo sapiens
  misc_feature (14)..(16): n is a, c, g, or t
  misc_feature (34)..(34): n is a, c, g, or t
  misc_feature (69)..(69): n is a, c, g, or t
  misc_feature (73)..(73): n is a, c, g, or t
  misc_feature (274)..(274): n is a, c, g, or t
  misc_feature (299)..(300): n is a, c, g, or t
  misc_feature (326)..(326): n is a, c, g, or t
  misc_feature (329)..(329): n is a, c, g, or t
  misc_feature (876)..(876): n is a, c, g, or t
  misc_feature (895)..(895): n is a, c, g, or t
  misc_feature (976)..(976): n is a, c, g, or t
  misc_feature (1164)..(1164): n is a, c, g, or t
aaccgatgcgccgnnnaacagaaccaccgcgccnacccacacacaactcgcgcacacgccaactgcacncacngcgacgtacgcgccgacagcgaggccacacagcccgcccgacccacacaacaaacgacagccacccccacgcttctgttaacgccacccatcgctctcctccaccctccccatctggctcaacgacaccagagaagtcgaacgcgagaaagtgtgagacatactataagtcatgaattatatacgactcctttaactattntattatattctatacacctccatcnnatgatatattataaatccacaactcnacnaaattgccttagcttccctccgccctgaccccttcacatcttcgcacgtcacttacttttctctctactttcttctcttctcgcaaagcgcacgtcttagacctctgggataggcacgtcggttaggcggcgcccgaccactcacattatcttcgtcacactctcttctgccgccctccccccctgagcctctcttatcagtctccgcgccaccgacgtcgcttctgcgcaatcctcgtactgactcaatgaggttatatatctcgcggacctaaacgcgagatggattagtgatacagtatctatagaacgactatattattaatagactcacggccataatacttacgataacatatgtagtctttcgacctaattaattagtatatactttacatttggatagattagatatacgtagcatatcactaagtcataaactgagatgcatatataagatgataaggatgaaatgagtcatggtaatttaaagattgttggtggtgataataaacttctacagatacgcacacctcgcatcgtgcgntaccgtaacattgagccgncccacagctcatctctctggtcagttttctctacctacattgttcgaagcatttcttgtagtagatcacatacaagattancgtataaccgagtacgcatcaccgaacagatataccacactgctcattcgttccccatgatacagacagtaagggcgccgtgctcgccgtgttgctgagatcatgcatccgccacacatatgaaggaggtcgagcgcggatgcaccgtaccgaaccctcaattataccatagaactgtgcaactacgn

SEQ ID NO: 671621 - DNA, 279 bp, Homo sapiens
  misc_feature (168)..(168): n is a, c, g, or t
  misc_feature (199)..(199): n is a, c, g, or t
gaggtctctaccacataggtacgggtatctaccacataggaagtacagcacctatctatgccatgtagcctagactatatggggtatgcccatagataggcagagagcagcaggacacggtatgccaaacgctagtacaaacgaacctactagggtaccatagggtangacacaccagagagcctatcccagggtttcntacctaccagcatactatccacatatacacctatgcccccaacaggctatgtagataagtaaagcctatgtacctaccta

SEQ ID NO: 671622 - DNA, 749 bp, Homo sapiens
gcccaggtggagtgcagtgagccgagatcgcaccattgcactccagtctgggcaacagagtgagattccgtctcaaaaaaaaaaaagaaagggaaaaaaaaatagtttatacctcttcctggtctcaaccgccatgaaaattctgaacactccaatttcacgtggaataacccaaaacaaaattttataacgtataaaataattttactctcttatagtaatagtatacttaaaaagcctcggggtatattatctctctaaacagctacaatccagggcacgcttacattaaccaactaggtcctctagtgagaacaactaggcctatttcactggctggtgtagcctcaggggcctaacatgggttgccaaataaatatccggtagaataccctgaatggtaaaaaccatttcggttttgggtttccaatgtggccaaaaactctcaaaaggtctgtcatatgtaatcctgggacaactcatatttaaattggattcctcagtaatgagatgctgggtgtgacttaagaaccataaggtactcaatattataaaaacctcaaaataacttgacttggaatttaaccaaatcctcccctttcctacagttaattttacaatctggggtatccctaagtcgatatttgaatgttctaaacagggtcacaattggcttacggaatattgtataatttccccacaatgcaattaaagacaatctgcgggattggggagtactaattgggtta

SEQ ID NO: 671623 - DNA, 283 bp, Homo sapiens
  misc_feature (164)..(164): n is a, c, g, or t
caacatccatcttgttgtacaattccattagagctcttgggtgagcccaggtgcactgtcaatgaacagcaatattttgaaagtaatcatttttttctgagcagttgaacaggtctttacagtggccttaaaatattcagtgaagcatactataaacagatgtnctgtcatccaggctttgttgtttcatttctagagtacaagcagagtagattaagcataagtcttaaggggtcttcgggattttttgggagtggtaaatgagacctggcttcaaccttaa

SEQ ID NO: 671624 - DNA, 170 bp, Homo sapiens
tgtgtatactgctctggggcagtgaaggtagcacagtgctcagcaggaaggagtcaagactttgctgtcgagcacaggtaggctggtgcctgagtgctcagcgtgccagtgatccacgcctcactcccagtgctgcgcagaagagctaggaatctactccctcttcctgt

SEQ ID NO: 671625 - DNA, 300 bp, Homo sapiens
aggttagttcagtcaaaacaggcaacccccttgtgggccctgaccctgcccctggggtcatggcggttgtggcaactggggaggtttggcccccacagccctcctgggcctgcttccctgtgggtcggggtcctccagggagctgacccaaaggtggaggccccggaggcagggtctttggggactgtcgggggggacaaagggagaaggctttgcaaaagctccctggcaatacccccctggggaaatgctttgtgtgccacagggaggaagtttccataaaacagccacaagcttcca

SEQ ID NO: 671626 - DNA, 350 bp, Homo sapiens
gcttctactctctgtcttgtgccggggctgcgacgggtgggcactcggtgcggggcggtgggccatgactgcagcaacctagtccgtgctctttaagccccggagcaggactgcagtggccaggactgtgctgcggggttaggggtgcactctctaccccagaggggtgcatcgaagcagacatttgtgggcttgcccgatacagtacaggtgactgtgtaggctcatgggtcctgcctgctgagcccttatgggtagtgatctctgtgtcttgtgagtgtgcttatgtgtgtgtgtgagagagaccctcatccggtgtgccgatacgctgagccaggactcagtgtggg

SEQ ID NO: 671627 - DNA, 224 bp, Homo sapiens
tggaaacctgcgaccttacacacaggacagtacttgcttcttcaaggggaatcttcagcctcaggtggctctcatgaagctgatttatcaagttgtaaatcttcacctgttgaattcataagttcacgtcttccaaggagaaacgtgtaaggatggcatgactcgcccgctactttcattgcccacgttgcattacctctaattggccagagtaccatcctctg

SEQ ID NO: 671628 - DNA, 265 bp, Homo sapiens
ggatgctattgatgggaacaagccagaagaacaaactcttgttcccctttagggagctctttgaccatggctgtgactctctttccacagtatttatggcagtggagcttccaattgccgtcgcttaggaacttatcctgactggtttttttcccgctccttttatttgggatgtttggtgttttattgcgttcaatggcagacttatgtttcaggcatgttgagatttggaaagtggatgtaactgaaattcagatagctttag

SEQ ID NO: 671629 - DNA, 781 bp, Homo sapiens
cgactgagcaacaggcaggactcagcctgggacaggccccagagcagtcacacaaaggaatctttatttattacatgacaaaataaccacaagtccagcattgcgagcacaactccctgctgctgggctataactatgtaaactggaaagccaattggaaacacgaacaagcgacttgatcccctatgcgcacccaaagggccgcaagcacctgcttcccgtcacaaacgaacgtcccatctacactcgacgcgggacacgagcagctccacacgggccaacagcagaaacgcaattgcccactgcttgaacacacacagaacaaaaacttggcaagcacacgaacactgctacgccccaccaaggcacgcgataaaccccaacccaaaaccgggcacgaccgaaccgaacaggccaaactaacggccccagaacgcgcacaccattatgcgagagaggggaacttggggcccgaacaaccaggcgcttctcacaattggcccccctgagagacaccccaaaaaagggaggggattggccaaaccaagagcgggtccaaaaccctttcacaacctaggggagccattacaccccaacctatattaaacgatacatcaaccaactccataaacctcaacaaacaccaattttcccacctttaaaaggcgcgtccacacaaaacacatttatctataaaaccattttagtaacgcgccaaacatccccaccctaataaaaacattctacatcacaccaccgcatcccccaaaaacaccctcat

SEQ ID NO: 671630 - DNA, 169 bp, Homo sapiens
acgtgcagccaccccacgaggagtgggacagacactcagcactgacacagaggccacagcagccaccccatgaagagtgggacggacactcagcactgacacggaggccacggcagccaccccacgaggagtgggacagacactcagcactgacacagaggcctcggca

SEQ ID NO: 671631 - DNA, 935 bp, Homo sapiens
  misc_feature (9)..(9): n is a, c, g, or t
  misc_feature (156)..(156): n is a, c, g, or t
  misc_feature (158)..(158): n is a, c, g, or t
  misc_feature (160)..(160): n is a, c, g, or t
  misc_feature (164)..(165): n is a, c, g, or t
  misc_feature (172)..(172): n is a, c, g, or t
  misc_feature (176)..(177): n is a, c, g, or t
  misc_feature (181)..(181): n is a, c, g, or t
  misc_feature (184)..(190): n is a, c, g, or t
  misc_feature (192)..(193): n is a, c, g, or t
  misc_feature (195)..(195): n is a, c, g, or t
  misc_feature (197)..(197): n is a, c, g, or t
  misc_feature (202)..(202): n is a, c, g, or t
  misc_feature (206)..(206): n is a, c, g, or t
  misc_feature (209)..(209): n is a, c, g, or t
  misc_feature (211)..(211): n is a, c, g, or t
  misc_feature (230)..(230): n is a, c, g, or t
  misc_feature (261)..(262): n is a, c, g, or t
  misc_feature (264)..(264): n is a, c, g, or t
  misc_feature (312)..(313): n is a, c, g, or t
  misc_feature (336)..(336): n is a, c, g, or t
  misc_feature (343)..(343): n is a, c, g, or t
  misc_feature (345)..(345): n is a, c, g, or t
  misc_feature (353)..(353): n is a, c, g, or t
  misc_feature (355)..(355): n is a, c, g, or t
  misc_feature (360)..(360): n is a, c, g, or t
  misc_feature (362)..(362): n is a, c, g, or t
  misc_feature (367)..(368): n is a, c, g, or t
  misc_feature (383)..(383): n is a, c, g, or t
  misc_feature (408)..(408): n is a, c, g, or t
  misc_feature (411)..(411): n is a, c, g, or t
  misc_feature (417)..(417): n is a, c, g, or t
  misc_feature (427)..(428): n is a, c, g, or t
  misc_feature (430)..(430): n is a, c, g, or t
  misc_feature (434)..(434): n is a, c, g, or t
  misc_feature (465)..(466): n is a, c, g, or t
  misc_feature (470)..(470): n is a, c, g, or t
  misc_feature (481)..(481): n is a, c, g, or t
  misc_feature (493)..(493): n is a, c, g, or t
  misc_feature (507)..(507): n is a, c, g, or t
  misc_feature (544)..(544): n is a, c, g, or t
  misc_feature (562)..(562): n is a, c, g, or t
  misc_feature (612)..(612): n is a, c, g, or t
  misc_feature (622)..(622): n is a, c, g, or t
  misc_feature (681)..(681): n is a, c, g, or t
  misc_feature (683)..(683): n is a, c, g, or t
  misc_feature (804)..(804): n is a, c, g, or t
  misc_feature (835)..(835): n is a, c, g, or t
tattttttnaacatcatttatttttatttacttttatttgcaaagatagttgtgctgccaacaacttgaggtaaaggcattaaaagggttagactacaagaaatgaaaacaaaacaattgcgatacttcctataggagaccgcacaaaaagcagtngncngctnncatattncatnntcanctnnnnnnnanntnancaacnaaanaancntccttgtattaacataagnatcagaccttggcccccacacagtgttggtnncngtatggctggaggtgtccttactcaattgacttcactggaaacatacnntgtatgtcaattcatctttcagnacttccncncacacaananacttncnctatnnaacccaacgacaggngcccgaaccgagcggccgcaagcgnganacccgnggcaagagcnngnggancgcgcccattgctttgtcctgaaacgggacnnccgncagcacggtantccagcatggcnacagagggaaaaancgaacgcagagggggggggaagggcgggagcaacggntgtgccagctgggatagngccacggcttccaacccgttctgtcctatcagcacaaaataatcgagtgngatgtctctnctgaactacaatgtaggttattccaggttgatagtctttctccaaactgatgcaggctncncgaattgctagtagttcataatataatacctgcctaaactgcccctctgaaacaccatcccgataaaagatgatacgagtaggcttgaaccgagttgacttataaaattgaataagaagtncccggaccatggaggccaagtcctggatganctcctgtcggggtctctgaactcttactgtggcacagtatctgcttgggtgtgcatccatactacctacaacagcagcaatagaaggcttctatccatca

SEQ ID NO: 671632 - DNA, 113 bp, Homo sapiens
agtctgcaaattaatgaatgccatcctctgcaatggactggataaaataaagtaaaaaaagtacaagacaataaaagataaaggtcacctactacccagagagtttccacttt

SEQ ID NO: 671633 - DNA, 537 bp, Homo sapiens
  misc_feature (404)..(404): n is a, c, g, or t
tctacagcggccgggagaggctgtggtggccccgagcgcgagtgtgtggtgacaggacagcggcaggcccgccctcccctggtgatggtcattgtcctccagagcagtgatggaggaaataccagcccaggaagcaggcagggtcacccaagggtccagttttcagtctttggaagacccagttctgagtgtctgtcccccagaagccctcaggttttgtgcaggaccaccggcaccttggaaacagggggaacttcaacttggggctccacccttgatttccctcagggttgcccttgcttcttcccccgttgaaggggaagcccaggagacaggcagctgcgctcttgacagccaggtaccaggagtttgtgacattcgaggatgtggctgtgcaccttacncgagaggaatggggatacctggaccctgtaacagagggacctctacagagaagtgatgtcagagaattatgggaacgtggtctcactgggcatacttctccgccttcccaccacccggattcatagtgtgaca

SEQ ID NO: 671634 - DNA, 528 bp, Homo sapiens
  misc_feature (87)..(87): n is a, c, g, or t
tttatacccccaaagtttttttttcggaggttttttttagccttttcccattccgccctagccctccccccccaattagggggggantggcccccaacaggtatcaccccgtttaatcccttagaagtcccactcctaaacacatccgtattactggcatcaggggtatcaatcccctgggctccccatagtttaatagaaaccccccgaacccaaataattcaagccctgctcattacaattttatggggccttttttttcccctcctacaagcctcaaaggatttggagttccccttccccatttccggggggatttaggggtcaacattttttgtagccacagggttcccggggcttcaggtcatttatgggccaaactttcctcacaattggtttcatcccccaaataatttttccctttacatccaaacatccctttggttttaaaccccccccctgaaactggcattttgtaaatggggtttgacaatttttgtatgtccccctttattaatgggggtttta

SEQ ID NO: 671635 - DNA, 228 bp, Homo sapiens
tccccgtggcgcgcgcattacactgactggttcagcgggtgcttaccttacgcgggcaggcgcggttaacccgttgaggcccattcgtgatggggatcggggattgcatttattccccatgaacgaggaattcccagtaggtgcgggccataagcttgcgttgattaagtccctgcctttggaacacaccgcccgtcgctactaccgatgggatggtttagggcgcgc

SEQ ID NO: 671636 - DNA, 280 bp, Homo sapiens
  misc_feature (147)..(147): n is a, c, g, or t
tatctcaggccaggacgactggggctccactgtatctcaggtgcctgctcttccccgtgagggaagcccaggagacaggcagctgcgctcttgacagccaggtaccaggagtttgtgacattcgaggatgtggctgtgcaccttacncgagaggaatggggatacctggaccctgtaacagagggacctctacagagaagtgatgtcagagaattatgggaacgtggtctcactgggcatacttctccgccttcccaccacccggattcatagtgtgaca

SEQ ID NO: 671637 - DNA, 430 bp, Homo sapiens
aggacgttttttggcttgtgggattctgtgtggattccggatattattagtcctttattatcagaggcataatttgcaaatgtattctcccgattctgtagatttcctgtttatttggttgcattatttcttttgctgtgcaaaggcttttgtgaacttaagttccatttgtctatttttgatttagttgcatttgctattggggaataagccataaaactctttgtctaggccaatatccaaaagagttttaccttccagggcttttcatagttacaggtcttatatttacgtctttcaatcccatcttaattttggtcatatggtgcagagacaggggtccagtgtcattcttctgcacaaagccagccattttcctagcagcatttgttgaatggagtgcactatcccattgttcattttcgtccac

SEQ ID NO: 671638 - DNA, 1257 bp, Homo sapiens
  misc_feature (14)..(14): n is a, c, g, or t
atttcagtaacccntgggttaatgtagcctgcgctcgccggcgcctggtgtctctcccggggaatggagggttgtcgcggtggtgacggcgggcagcgtagtgcgctgccaaaacctgagtggagctgcaagccttgtctgcctccgcctccgcctcctgtctccccgcccgccctcacccctgcacccgcagcggagtgagtgagggacctgtgctgcctctgtctagagactgtgttgtgctacccgtgctgctcctgtgctccctgtgccccataagctaggatgcctgtgaacagcaggcataggaccgcttcatgattgcctgctatacgaggacgagtgacgagtgagttggaagaagcaagaggaagctcgaagcgacgcgacagcaaagccgagaacgcgaagcgcgacaagcagggacacaatagagagaaccggcgacaccacacacaaagcagtcaaagacagcggccgacgaaccggcaacacagaaacaaaacaacaggcagcggaaggcacacaagacacaggagacagaacagagaacagaagacccagcaaacacaagaggacaacaaagcagaggacaagacacggaagagccacaaacaacgcaaggagcaacgcagaaccgaagaagaagcaacgagaaaggacacacggagaaacaagcagcacagaggacaagaacagcaggcgacacaacgagacgcaccaccagaagcacaaacagaacagcagagccgcacaacacacgacacaaaggcgaaaaccaaccagacccgaaagccacagagagacaaggagaaagcagcaaagaaaaaacaaccacgacaaagacagaaagcaaacacaaacaacacagaaagaacaacaaaagaagagaacacgcaacacaacaagaacaaacgcaagcagaacaccaaacacgacgaagaggcaagagagaacagcgaaaggacacagagaagaggaagagacacagacaaaaaagaagaagaaaagagaagaagagaaaagaaaaaaagagaaaagaaaagaaaggaaacagagaatgaaaaaaagaagagagaagaatgagaaaacagcaagaggaagaaggaaaataaagatgagagagagaagagagaaagagaaacaagaaggcaagaaggagaggaagagaggagaagtgaagagagaaaaagagaaagaaaaaggaaaaaagagaagaagacaccaggaggaaagagaacaggaggacaccgacct

SEQ ID NO: 671639 - DNA, 261 bp, Homo sapiens
  misc_feature (12)..(12): n is a, c, g, or t
gattttcagccngactgccggaatcagagccgcgggtgagatccccagccctgtgagcctgtaggagtagaatggttccccaaagtgtatgagttccgatctggcattatcgcccgagaggagttgttgagaaagtggacggggtgacatcagtatgtctgtgcgaagaggtacgtgtccatcgaaagcgatcttccaccagcgagcttaagagcattttcagggcttgccgtttccgaggctcgagggtgcccccctggt

SEQ ID NO: 671640 - DNA, 1392 bp, Homo sapiens
cctggagctctggggagcggagcgtggtggggaggggagctgggacagtgcgacacatggaagacagcggcgccgcgtgcctctccccgacctagtgctgggcccgtgatcctactggacgccctgagggcacaccagacctgcgcctctagatgtcaccccactgccgaaccccatcaccctctttctctagaacgtatacttttccagtcgcgttcgcactgacgttgtaggcaatcagatgagtagctttagaagagtggtcgaacagaggaatgctactagagggggacggacaacgtgaggaacagaaagaccagggaggactgacggtatcatgttaaggtcgagaagaagggaagcgccgagaagaaacgataactgagcacaaaacgacgatgagcgaggacgaaagtgggcagcatgagagaatcaggaggagagagacactcaaatagacacgacagaagccaacagcgaacaagccgggcggatgcgagatgacgcgagacgcggagaaccggaagcgatctactacaggagctgatgacggagcgatcgcacaacgaaccagacacatccacaacacacactcaccaccgatctctcttcctacctgcccaaatctcaacaatcggtatccaaaacatgaactgataccccatttccctcactacacatcatcagacagcagacaagtcccaaacccaccactctataaacaactcaacagtgtcttcaagagaccacaacataacagctaacagaaccagcaatctacgaccataacacaaaacactagcacaccaccactaagatgcaccagcaaacaccaacgaccaagaacacaacacaagcacactatctccaccgtccaccaataactacacaacctacactacgacgccatcctacccctacgacatcagacgccgcccaaaaacaccatagtataaattatctatactcacaagccgcacacgacgctcacccacatcagcaagtcacaggtagcccaccagcgtagaacacaggcatcagagtccacgccggcgcacacagcagcaccccaaacgaacagcggaagcggagccgctacatagggaccgcgctagcaggagagagcagtgagcagaacggcagctcgaacgcgcgatgtggaacaggcggcgcgcggggcgacgggaagccgcagaggcgcggcagcagctcgtggcggaaccggccaggcgcgcggggtgcgagacgagcgcgtatgtgccgcccgtgcggcggtcgcccccgccaggtcgggtttgcaagacaggggcgcgcagcgggagccgaagtgccgtggagaccctcggctgtaggagggaatacaggacaggagtacacagcgagcgaagaacg

SEQ ID NO: 671641 - DNA, 317 bp, Homo sapiens
gttgtcaggtctggagtatatacattaaaccaagcttctggctggagtgggggctcatgcctgtaattccagcactttgggaggctgagacaagcagatcacttgaggtcaggagttcaagaccagcttgaccaacatggtgaaaccctgtctctactgaaaatacaaaaattagccaggcatggtggtgcacgcttgtagtcccagctacctgggaggttgaggcatgagaatcacttgaacccaggaggcagaggctgcaagtgagctgagattatgtcactgcactccagcctgggagacctgagcaagccagg

SEQ ID NO: 671642 - DNA, 108 bp, Homo sapiens
acactagaggatcccgcggcattacaggtcacggtggactgaattggctttttatcttcccactgtatcatggaagtatctgcttgcttgtactgtccatccgggata

SEQ ID NO: 671643 - DNA, 166 bp, Homo sapiens
  misc_feature (12)..(12): n is a, c, g, or t
gattttcagccngactgccggaatcagagccgcgggtgagatccccagccctgtgagcctgtaggagcacaacgcctccttttttgcctgagttctctccgccattatccccagaggagttgctgcaacgccccggggtgcaccacgttgctccccaccgccgctg

SEQ ID NO: 671644 - DNA, 945 bp, Homo sapiens
tcgagaggttagaaggagcgtgggtatcaccggcctacagcagtcaaactccgggccacaggaggcaataggaccaggaccctggacccgtggggcccagtcggcacctcagatgcccttgcacgtcgggtatgaagatcgtggcggattgaggatgtcagccccatcccctctgacagactcgcaggaaggggggtcgccgcggtcgccgtctgtgaacaaagagttccctcacaaaagtattttcttgtgtactagaatttgtccttcatgtacacaaaaaataaaccacggggcgcggctctgcgaggcataggtacccgctcgggagggatcgctcgaatggagtacccgtttttggacccacagggtctatttgtggcagcacctgggcggttccccaaaaaggagggcacggcccattatactgctgcataggaccatctggccggcgcttgacaacgcttgaggatgcgagacaagagcgggcagcgctcagagggcgtctcaggaccaggagcacaataacgtacttggccgctgtagactgcacatgaggcaaacaagaccctaccggggagatatcgcaagcccgcaagaggaaaacaatctgcacaaccttcacagcggcggggaccccccggtgggcagcaacgaacagcggcacgtcgtcgcatgcgccagggcaaggaaacagatcatggaccacgccgggaaccaggagcgcagctcggacacctcctaaccgcacgccggcaccctcggaaggaaataaagtcaggcggcgacacgacgactgacgcacgacacccacagcacaacccaaggcttacccagccggctctccatagcacgtcgggtacaacccagcacgcccccgagcaccgcaccacccacatgccacgcaagaactcacgacagtggccacatactcacaccgccagc

SEQ ID NO: 671645 - DNA, 303 bp, Homo sapiens
ctcagaatatgctgtctcatgcctgtaatccgcgtgtacttaagaggccaagggcgggtgaattgcttgaggccaggagttcgaaaccagactgagcaacatggtgaaacactgtctccacaaaacaacaacaacaacaaaatacaaaaattagcccggtgtggtgggtgcaagagcctgtagtcctagatactcaggagtctgaggtgggaggattgcttatgcccagaaggttgaggctgcagtgagctaggatggtgccactgtacaacggtctgggtgacaaagggagatgctgtcttt

SEQ ID NO: 671646 - DNA, 281 bp, Homo sapiens
  misc_feature (1)..(1): n is a, c, g, or t
  misc_feature (10)..(10): n is a, c, g, or t
  misc_feature (22)..(22): n is a, c, g, or t
  misc_feature (34)..(34): n is a, c, g, or t
  misc_feature (39)..(39): n is a, c, g, or t
  misc_feature (45)..(45): n is a, c, g, or t
  misc_feature (51)..(51): n is a, c, g, or t
  misc_feature (53)..(53): n is a, c, g, or t
  misc_feature (60)..(60): n is a, c, g, or t
  misc_feature (63)..(63): n is a, c, g, or t
  misc_feature (67)..(67): n is a, c, g, or t
  misc_feature (92)..(92): n is a, c, g, or t
  misc_feature (97)..(97): n is a, c, g, or t
  misc_feature (99)..(99): n is a, c, g, or t
  misc_feature (102)..(102): n is a, c, g, or t
  misc_feature (105)..(105): n is a, c, g, or t
  misc_feature (116)..(116): n is a, c, g, or t
  misc_feature (119)..(119): n is a, c, g, or t
  misc_feature (158)..(158): n is a, c, g, or t
  misc_feature (160)..(160): n is a, c, g, or t
  misc_feature (167)..(167): n is a, c, g, or t
  misc_feature (176)..(176): n is a, c, g, or t
  misc_feature (189)..(189): n is a, c, g, or t
  misc_feature (192)..(192): n is a, c, g, or t
  misc_feature (198)..(199): n is a, c, g, or t
  misc_feature (205)..(205): n is a, c, g, or t
  misc_feature (218)..(218): n is a, c, g, or t
  misc_feature (246)..(246): n is a, c, g, or t
nccccgaatncatttatttagngggaaaacacanccatncaaaantggggnanacaatgnctncccncagaaaaagggggggggattaagcngaatngntanatnccattcacatnaanaaaaatttttaaagaagaaattgtagattttaaaagccncnttagacnccagggacncaaacaaaaaacnaancccccnnaccgcntgattttcagggngaaagggtacaataatccatatatttcnattacatggcaggaaaaacaaaagcattttaaaca

SEQ ID NO: 671647 - DNA, 106 bp, Homo sapiens
gcttctgcttctgccgcttcctgcttctgcctcctgcttctgctgcttcctgcttctgccttcctgctgcttcctgcttctgccactccagccagggtctggtgag

SEQ ID NO: 671648 - DNA, 155 bp, Homo sapiens
tattaaacacctacaacttataaactaaactttaagctgctcaagtcaccttcattttaatctaacagcataggccttctataggtataaattcggggctctgtagtccttactctcaatatttctaaggtacggattaccgcgggtaccgggct

SEQ ID NO: 671649 - DNA, 213 bp, Homo sapiens
cagatatcaaacagtggcccacactggcccagaccagacttaggcacagacccaccaaccaatccacaattcagtacagactacattttaatctttaaaacaaccaccaccatcaattaaggtggcttcaacttaaacacctaatgggacaaaatattttaccttaggaaaattcattccaaacccaccgtcacatgggactggtggactggg

SEQ ID NO: 671650 - DNA, 264 bp, Homo sapiens
tagccctgaagctcatgtcccggtgtttgtttgtgtttatctctctgattttttcctccttgaggcagcttgaaatgtgaaagggcaagggaaccgagctaacgtagggtggaaacatggttatatgtacattaagtgtcttactctactcaagtttgcgtactcactgtaagcccaatggggagaccaaggttctggtgtccacacacgcatgtgcagaggaagacagttgacataatgatgaggctagtgcagatctttatc

SEQ ID NO: 671651 - DNA, 658 bp, Homo sapiens
  misc_feature (232)..(232): n is a, c, g, or t
attttccgccaagtttgtaaaacacccccctggactttatttatttaagccattttttttaaacatccttaagttgaacttcaagatattttttgcaaaaataattccctgcatggcagtggctttatagaagcatagtcctactccttaagccggtgataaggcaatttgcgttgtacaagagaccctgtatgtctcagtacatgggctcaaccccaggacgtaaagtgcnctgtttacacaatgtatactcgcatgaggggcatgtctccagccctcagagcttccgatgcaccagtatacatgggtgttaggttcattcggcacacctcagtcaggtatgttatgagtgcttctacagcagtcacagaatgagcacctgacagtaggggtttcctaggcatacttttttatttttgtacataggcctcatacacaacttatgttctaggcatctgtataagtaatctcattcaggttctagagacaatcaactcctcgtatagcatcttttattgttcgatgtggtactatgaacccttgcttgtccgattctagttagttaatatacaaggtctaatctgcgaatagtcatgtcattgtcaataagtctccacagcggtattagtgccctcactgtcgcccatcactttcatgc

SEQ ID NO: 671652 - DNA, 1561 bp, Homo sapiens
cgttgacacaggtgatatctgtccagtcaatcacagtacttggaagagtagtcatgatatactcaatctgcctactgattcatctgaatgaaggagaattagaacgggacacacgacagagagtccacctcgagtgctatcgatagtattactagtaatacgaatagactacataatcagacgatgaaagttagctcagtgcacaaggagcagaatccatcaagtcattgtgattagcctaggtcgactgttgattgtgtatgaaaccttgcgtcgtgacattgaacattgcgcgtgtatatcgaagtttcccaagaggtgaccttctatgctcacgagcacgccatatcgatcatcaacgctgggttgtgtataataactcctaggtttggggcgtaggagccctacacatggacccagtgtgagcattgggatccctattcacatggtagattgtggcgcgccacttttgtgcggatgattctaacaccactcttgcacgttttctcaacaagtacgacccacggaatgcccactgggcaagtcaaaccattacaagcaggaagcaatatccggtacacgggagagctttcgtcgcgataataattttcccaaggtaacagtagccctcttgttctaatccctgtagatactcgtactctatcggagagagacggcaaagcgtcccagctttgttcccgcctaaataggatagcatcacgcgcattcaaggttctcacggatccgccaacggataccaccgccaactacaggtagcaacgtctccccgttttgcctattgtgacccataggctacgaggaacctctcacaagaaagggccgtattggaacaggggcaccaccacaaacatgggctaggggccataggggatcatgaggcaacaagtttcctctaaataacgctcttccccagggtttctcacggactgcgcacacttccacataaagtggagttctcttccccttggggcttagggaacagaagtcaaactgatgttgcctttgtaacacctatattggcgcacaagcctgtgaaggagaaccccctatccttaagtagagaccaccgacgagcgacagaaggcccaacttaacggcgggatgtcaacacacaggcgcgtgggacctagatgcacattagccgaaatcaaacactctgtgtacgggccctaaagggagggcgtggtttacacattggagcgacgatgtgaagagtctagaggagtaggagcaaatcagttcaccaaaggactacagtcccaaagcacccgctaacttggacaaatcccccgccaacagtatactagagacacaacacaagccacacaaaccacagacggcacggacacagagcagtcccccagaacacataacacacccatcccaacgagggccgccccaaagactacaagacaaccctacaacaccaaacgcccaaaacaaagcaaacaaacaaggcagggaccccatacatagtagcaagaacgcacgaacaatattaaacagcatatagaaccaaaggaagccacagacgacagaa

SEQ ID NO: 671653 - DNA, 459 bp, Homo sapiens
  misc_feature (454)..(454): n is a, c, g, or t
ctgggggctctgctgaaaagcagagattctttcccactgccatgtttgaatagtttggttagcaattccctgtagtagagaaagcatttgagaaatgttcgtgagatcagaagtcaaaggtgggtctgtcccactcacgcagcactggatcagtcgggctccggggcactcgtgcagagaaggccattctagagaggggagtgttctgctgctggctgccttgccgtctgcccgtgcacacagccagacttttccaccaagttaactgagtgaggtatgaggagtgttctgagatttctgtgtgtaggggcttctcccttgagtactgggaggcaaacctgtctgcgaatggcctaggcagggcagagtagggtggattttccctccaggttgtaattcactgtgtctatgacacaaatgttgtagtcaattaaagtttaatgttttgaactcnaaaaa

SEQ ID NO: 671654 - DNA, 865 bp, Homo sapiens
tgaagtgggaaagcgcgtgctcggaaagctatgccaatgctgttattgctggctgcaagtgtgcccaccgttcggtggatccctagtcgcctgagcgacgtgacgcgtagtaaagcggctgagtgcagaatttcgccacaggtccgtggagctgtgtcccggcggctaccgtatgtccggggtagccctgctttgtgcggccatggaagtgtcgtgccgatgattccgtgacactacgcgtgcgtgtcacggtgtagtctgccctcatacgggcgcgtatgttgtgcactaggatggtccctcattttgtgcaggttctgtgctatcgtgtaccattgggtgctacgtaacgttgacaaaaaaagaggtgcttgtcacaaagtagggaggacacacacatagagtgctcaggtacaggtatcagtgccccaggggtacgctcgaaacaaaaagcgcaccctttgcgggatcagggagtgagcattgtacttccttggaaacactatcatttcgcagatacgattagccttggtgtccctctatagaggaccgcctttgttgcgcgtgtcccctgcaaggggtacgtcggaaaatggtcccagggcaaatacgttcgaggaggttgacagagggtggaagtactttgtcttattgagggcggacatgggcatgaaggcgagcaaacataggcgtctaaaaacgattgacgctcgaagggaagtgagttgcgggcagggtttgcctgagtgtccctcgaggtgtttcttcaaaaaactttggatgcaaaacacgagggtgtccaaacctcctggtcacgcaatggtgaaagcctggatgcaatggcggtcccattacgtaaggcagg

SEQ ID NO: 671655 - DNA, 148 bp, Homo sapiens
tgcgagtataaccactatacaccacgacgctaggtgcctcagtgtaggccaaactctggagtcactagactggtttgatattcatacggtgcaatatagcataataggtctagtactagactacataggaataaaaccacatactact

SEQ ID NO: 671656 - DNA, 280 bp, Homo sapiens
  misc_feature (53)..(53): n is a, c, g, or t
agcgcatgtgctgcggtcattctagaggatcccgcatggtctgtcggttgctnctgaggtaatgaaaataaaaagaaaatgtgaaacagcaaaaaaaaaaaagcaagggtccggtcggttcattagtggtgacaaatgcaccactccaccactcgggtggggatgctgccagtgggggaggctatgtatgtgtggggacagagcgtatgtgggaagctctgtactttctggctcaaattggctgtgaacctaaaactgctctaaacattaaagcctattc

SEQ ID NO: 671657 - DNA, 278 bp, Homo sapiens
  misc_feature (269)..(269): n is a, c, g, or t
gtggctgggcacagtggccgacacctaaaaacccagcactttggggggccaaggtgggaggatcgcttgagcccaggagttcaagaccagtctggccaacatggtcagattccatctcaaagaaaaaaggtaaaaataaaataaaatggagaagaaggaatcagacataatttccatgtggttgttttacatttttactggttttcttactcttcttataagggatattttcataaactgattatatattttacaaaccaataaatgtntttgtaggt

SEQ ID NO: 671658 - DNA, 130 bp, Homo sapiens
agcacgagatagaatggatctggcagcagataagaataggtcatatgcgaatctcctgttagattagattaaaaacaaatttccattttagtggagaagttgcagataaatatttctccccgggatacag

SEQ ID NO: 671659 - DNA, 117 bp, Homo sapiens
gcccaggtatagttcaactatctttcgggtcctaaaaagtgcgctacgtgatctactcctctgtgctgtccatgtgctgtacacctcctcagcctcctctgtgctgggtgctgtcca

SEQ ID NO: 671660 - DNA, 339 bp, Homo sapiens
  misc_feature (339)..(339): n is a, c, g, or t
gagattcttagctcttgggatgcaggctcagcccgctggagcatgagctctgtgtgtaccgagaacttggggtgatgttttacttttcacagtatgggctacacagcagctgttcacaagagtaaatattgtcacaaccactgaacctctggctagaggccatattcacagtgaccataactgttaccatatatgacaggcctccttgggactttgaaatcaaatggttttgggaattggtcccctttgagaggcaccctccccattttgagatgtttaaaagacccctcatatttgcgcatcctctctttaaactataggtaattaaggcagctgtan

SEQ ID NO: 671661 - DNA, 713 bp, Homo sapiens
tacgctatctagaattgtaccaaccaaaatctcgtattggcagatcttgacaggctggacctgcaagatgtggcttgaattttaaccatttattacataatctctagtgatcatgcatctagttatcataagaaataatttaaaaggtttggtggctgaaagccagctaagtggtgcacgtaaaatacttaagttattcaaagacatgtaatctttctttgcaagagtaatttaagcacatgggaacagattctagactttcggtcaccttggcaacaacaagtgcccatctgctggctagaaacccttttactactttactatcatattcatgggtggcttgagctcagctcaatctgagtgcagcatgacggctggacatactaactaaccaaataaaactgacggacgtgggtccaaaaacgcttacacttgcgaacatttactaactttactcctaaacgttaactggtaaccatctgaccaaacaacttttcaccttttctgggaccaaatttattcacacccacacaccattttctacaactttatacttaagaaccattggtcctaccaagaggctcaatttgcccaaatttctaaggaattcatcttcttaaaccctttggtgtggccccaaggacacatttcctaagcaacattttccaggcttgaaccttatgggcctatacgtaatcctatttactcacgga

SEQ ID NO: 671662 - DNA, 108 bp, Homo sapiens
tgcagaggcgtataggttatgtacgtagtctaggccatatgtgtgggagattgagactagtagggctaggcccaccgttgcttcgcagggggcaagactagtatggaa

SEQ ID NO: 671663 - DNA, 424 bp, Homo sapiens
  misc_feature (13)..(13): n is a, c, g, or t
  misc_feature (38)..(38): n is a, c, g, or t
  misc_feature (43)..(43): n is a, c, g, or t
  misc_feature (265)..(265): n is a, c, g, or t
  misc_feature (355)..(355): n is a, c, g, or t
  misc_feature (417)..(417): n is a, c, g, or t
aaatccaccaccnctttggcccgtgaatattttgcgcnaaagnaaatgcgaggcgcaatcatgactgagcgcacgccagaacgaaccttctgagcgatatcgtcaaatttcgtgtgatggtcgagatgaattgccagtggatggtgatattcttcgccatcgcgctgaccagcgccaacagattttctgtaccagcatgagtaaatgtccaggcgttccggcgatgatgaccggcgcatgcaggttggcagcggtttctaccacnacttgcatcgtttcgagattgtgaatattgaatgccggaaccgcataaccgccgcgctgtgcgttgttcagcatctgctttgtcgatacnacgtacattttcatatcctgtcgtttgttttcgatttcaaaatataatgaaattatttgttnttaaata

SEQ ID NO: 671664 - DNA, 902 bp, Homo sapiens
tttaagattcagttcagggggaaatgactagtttcccagcactttctggttaccatggggagcgggtgatccacatccaaagcctgcgggttacactcagggactcttgccaactcatgaataatatcgctggaagcccggctgccgcgtgcgatgaatgacgacatgtgttcccaattgtcatcatgaataattgaattatggaccggcccctgggggggggggggattaagggagggagcacaagaagcgctgcggaccgctgttgtgaggggcgggtcgattacaagagagccgcgccgacgccgtagcggcctatgacgtgccgtcagaatggacgacatacccggccgttattggtgctgcacgtgggcgaagtgagtgtgttttgttgtcgtcagcggtcgcgcgtttcggtgtgtgccagcgccggggtgggatgagctcgtgtaccatggtgagacgtgttgcggggtagcaaggagggatcttagcgtaaccacacggagccggggtctttgtattacggggtgcggacgccgggagtggtgtggtcgaggagcggcaggcgaagcgttgtgggatgcggtatggcgcacatagattgttagaagagtagttgaggacgttcggagcgccagttgttaatcgtcggggtagatcgagaaaggcgtgtcatagtgcattggtcgtgccggtgttgggccacgggtggcgtgtgtgtgcagtgtattgactcgcccggtgaggcgtgaggatggtagtgataacgccggagcggcgtctcagaggggtgtggggagtcggaggacgatgagtggcgtgcgttgacacgtgcagagcgcgggtggcgggagatgcgtgcaccgttcagtgtcgtatggaggtggaagtggggagga

SEQ ID NO: 671665 - DNA, 333 bp, Homo sapiens
  misc_feature (150)..(150): n is a, c, g, or t
tgtgagagaacaggaagacagtagacgactgtaaaaaaaaaaaaaaaggatgaaaatacagggtgagttttggtttgagaataggcatggagtttccagaaaagcccaggacaaaaggagagcagaattaagcagaaagggtttgggganagcttgcaaaggctctctggaaaaaggagagccaccttgtaaaggcttgtatttgggagaagtgctgaaatatgcatagggcacactgaagattacaactgggccttaagagatctctatggaatccctcatgcaaaagatgtttccaggcactggctccaggcagcaggcatcaagaattgt

SEQ ID NO: 671666 - DNA, 373 bp, Homo sapiens
caacctggccaacacagcgaaactctgtctctagcaaaaatacaaaaatcagccaggcgtgatggtgggcgcctgtaatcccagctactcaaggagccgaggcagaagaaccggttgaaatcgggaggcagaggtcacagtgagccaagatcaggccactgcactccagcctgggcgacagaacgagactctgtctcaaaaaaaaaaacaagaaaattttgcatgcagaacactgccagctgtgtgaacgagtgaatggcaggaacaccataatccttggaatttttgaaatcctggggccacttcaaatactttctcttctctgccattctttctaccctattcattcattcattacctcaatccatcacac

SEQ ID NO: 671667 - DNA, 244 bp, Homo sapiens
gggcaagagccttaagttgagccttatttgcagaaccattattttacttaaatatctagagaacaagcctttgcagggtgttcgggcttacgactttaacttcaacaccttggaggccgaggcaggcaaatttcttttaccccggagttcaagaacagcctggcaacatgcgagacttcatctctcaaacatatataaaatgctggtgcatgctgtgatcctagctactcaggagcttaggtgg

SEQ ID NO: 671668 - DNA, 250 bp, Homo sapiens
gtggtggctttaggatcccagtttctgctcatatttctccccttttgcgggttcggctaacgcggagagcacgccatgaaggcctcgggcgcgctatcgatagtcaaggtcgtgacgtcgcagactgctggcgcccaaacgccacacgccgcccctctaccgcatgcgaatctttgcgcctagtcatgtcgtcgccaagtcccgcttctggtactttgtatctcagttaaagaagatgaagaagtcttca

SEQ ID NO: 671669 - DNA, 141 bp, Homo sapiens
  misc_feature (109)..(109): n is a, c, g, or t
ctagacaccttgacggtaccaacaggactaggggcttgtatgaggtgagaagggacaggctaaggcagattggcatgtctggggacattttggttgtcacatcttccangggataggggatggggggggactattggcatc

SEQ ID NO: 671670 - DNA, 419 bp, Homo sapiens
cgtcgacataggcataccaacggaaatatgattcgccagcactttatgacgtggatcaatgaagacggcccccaggtcgtggggtgctaaagctagcgttggggctttagctggacggttgattttccctgaagacacgctttcggcaaaaacagccattctgtgcggtctccaaaatttagggtcgactcactatttccaattgactgctgctcaaaagcaattgtcttgataagctctggtaccagcgaatggagtcgtagtgatgcctcacatgatagccatgcctactactctcgaatcggtcaatgacgacaaaattgcgtttgctatcgaagtgggggcagcacaccacgttatcgtgcaaaggcgagtttcaggtcgacgcggccgcgaatttagtagtagtaggcggccgc

SEQ ID NO: 671671 - DNA, 167 bp, Homo sapiens
  misc_feature (54)..(54): n is a, c, g, or t
gggggggggccccccccccccccccttttgggaaacttcttttttgggccaaancggttttccccccccggttttggggggcccccttaattttttttttctttaaaccccccccccccccccccccccttttttttttaacaatttaaaattccccccgggggtta

SEQ ID NO: 671672 - DNA, 783 bp, Homo sapiens
tgctctgtcggtttgtcttttgtctgcttttttcttttttttcctttttggttttggggtgatgtggcttaaatgcaatagttctttttggggacatatttctgccaattaaagactacaagggcacaacttttttttaaattcccatagagaaagatactttaaaaaaaatcttactggatggttttggtgacgccataactaaattcatcggtaaaaatttggcactattggtcgaaaagggagcaactgtagtttggggtccactggtgggtattggtttggtattggcttggttttttcacgagattacacatggtttctgggataaggattagcttctcgaagtgtccatcatttcggttgtaagaacgcttaccatatgtaatggtaaccaaactccagtattaaaaatctctcatgttggttttctttatacaaagcaagatacgggcttttaccatcggccattacttggccaaaatggttggctaccttagtttaaaaaacaatctcaaaacaaacagactggctcacagggggtttataacaatcaggcagtggactccaaagaatttcttattaactggaaatgtatactattggcgactaaaccctctcttccctggttgagctctggattcctggcattagggggacacttggtggacctaccgtttttccccacttctacgatcagatttacaagttggctaacattcacttatccaaaggcaaccccaaccaaacccttggtctatcacccacgtataaacaaccata

SEQ ID NO: 671673 - DNA, 108 bp, Homo sapiens
gctcgtccattgtgctgacaagatgaaggagatctcgtcggggtagaatgcttggcctcccccttgtagctcacctgaccttggcttgttccgtcgttgatcacctgg

SEQ ID NO: 671674 - DNA, 809 bp, Homo sapiens
ttatgcgcccctggacgggtgtcaaagtcctctgcaatggatgcacgagctcctcggtcgtgcatggactcagacctggacatattatgccttggacactaagtttcggtggggaggcggtttacctatttattctgtgagattactgtgatgtccagctaggccaggggccgtgcacctgggcactgttgccagggcttcttgtctgcgcccccatccctcgaggtagatctggtacataacgcccctgctgcatggtgtgcatacctgttggtcgtaccccggggcagcgtctgatgggcttgtgaacgctgatgttcctggatggtgggcctggacgcgtcgggcgcggcgcgctcgatgcatagttgttgatattggagggtcctgtgtgctttggtacgtctcgatgtggtgcaatggctttgggctcttggccttgtcttgtgttgcaggaaggtcttactcactgtttgcccccctcttgtccctatgtggtgttatcggcttgtgctttgcttgatgtgcttgtctttgctcgatgtggtgtgtgctgtccatgacactgctctgccatcctttcccttgccccttcaccacgtggcgcctcgctccctttcccctctcagctcgccctttgcggcccttcctgtgcgctagtcctctgccgcctgttcctctcctcgtcctgcccttgccccccgacacagtggcctccacggtcctctatcatgccttctccctcgccttgcccacccccgcactggtcaccgccccccgcccacttcgtcccacttccttcccccttc

SEQ ID NO: 671675 - DNA, 384 bp, Homo sapiens
gccttagaggatccgatttatcccaacacaggactcttcgtaacatgtaggaagagtgagagcaatctgacagcatggactcatcatggtatgaagatggtttgggtgtattgttggttttggttggtttttgcgaataggatctcgctgtgttatccaggctggtctcgaactcctgggctcaagggattctcccacttcagcctcccgagtagctgggacaacaggcatgagccaccccacctggctggtttggggtttatagggtgggtttggggttttgactacttttttgggggaaatgtttgggcaagaacatgtgaggacagggataaggccgacagggggctatctgggatttagaatggtgttgggggataacat

SEQ ID NO: 671676 - DNA, 122 bp, Homo sapiens
ccggtcagagctgcaggcagttttgagccatgcagctgccctggctccagagaaggcctcgaagtggctgctgtgctgaggatccgggccgagtcgggcaccaagggactcttcaccggcat

SEQ ID NO: 671677 - DNA, 289 bp, Homo sapiens
tcacgctgaccgaatttgtgccaataagtacatggtaaaaagttgtggcatcgaactcttacatatccggtagcgggtccaacacttccacgtcgatccgcatcaacaggatgttgtcctgcgctggtagtgacagacgagcttgagctggaccttttatggcagtcggagtctcgacattattagtctcgcgttattttatcagagcatagaggtggccccagcgactcagccactatggctactagaaaagccaggctggcaagagactttcagtggtcactcagta

SEQ ID NO: 671678 - DNA, 843 bp, Homo sapiens
  misc_feature (1)..(1): n is a, c, g, or t
  misc_feature (83)..(84): n is a, c, g, or t
  misc_feature (192)..(192): n is a, c, g, or t
  misc_feature (388)..(388): n is a, c, g, or t
  misc_feature (438)..(438): n is a, c, g, or t
  misc_feature (488)..(488): n is a, c, g, or t
  misc_feature (490)..(490): n is a, c, g, or t
  misc_feature (544)..(544): n is a, c, g, or t
  misc_feature (549)..(549): n is a, c, g, or t
  misc_feature (553)..(553): n is a, c, g, or t
  misc_feature (555)..(555): n is a, c, g, or t
  misc_feature (557)..(559): n is a, c, g, or t
  misc_feature (565)..(565): n is a, c, g, or t
  misc_feature (567)..(567): n is a, c, g, or t
  misc_feature (578)..(578): n is a, c, g, or t
  misc_feature (583)..(583): n is a, c, g, or t
  misc_feature (594)..(594): n is a, c, g, or t
  misc_feature (603)..(603): n is a, c, g, or t
  misc_feature (676)..(676): n is a, c, g, or t
  misc_feature (697)..(697): n is a, c, g, or t
  misc_feature (716)..(716): n is a, c, g, or t
  misc_feature (744)..(744): n is a, c, g, or t
  misc_feature (831)..(831): n is a, c, g, or t
natttcatagataaagtggcaatctttgcagcttctattgcaccaagtatcgaagattaaaaacacaaaaaaagaaacgattnnggtttgttggaaacactgcaaatagccaagtacagtactttggtaaataaaaaataaaatggttcagatgaacacaatccgtggaaagaaacaatctagggggaaggnactatggacatcagacaatggtcacaattctcaccatcgagctccatagataaggcaagacttgctaagtctatggatcacgaccccatggaggtcttaagtatctccagactgaagctagaacaagtatagtgcaattagaaagagagaaggcccctcctccacggatacatccacccctctgtaaaggagactnacgcatgccaacacttctacatgggaaaggggagcccccgcgcgctgctnacgctctgcactcctggcccttttcttctttcctctgagcttagtgctgntngaggctctggaagaggcactggggaggccaagggccttcctactatgaaaaatnaactntaanantnnnaaaatntntcaagcctctnaccantcctgctcganggacctgcnagcgcgcatcaaaccgccagccgagcgctctgctggcctgagcctcacaatgcattgtcatggcatgcgctgnccagcctgcccgccagcgcancagcgcccaaggcatgcanagcccaggcccacagcagagctctgctncgcgccaatcgccgcccagcccgccaaggcactgcgcagctgagcagcagcagcctctggcatcacggcctatgaacctgccttagnaataaaattccc

SEQ ID NO: 671679 - DNA, 201 bp, Homo sapiens
ctcgtaagaatagtgagaatgatgggggatgtgtacctggacggtgtgtagcttctgcctgagaaacaagtaagactttgagggctggggaggagaaaggagggcatctggcctgagcaccgcctgagccaaggtgtgggggcaagaaccggcatgttccttaaggtgtgagagaaagggaaggaagtgcagggattgggg

SEQ ID NO: 671680 - DNA, 322 bp, Homo sapiens
aggggacacgcactttcgacaagtctgcacaaaggcgactctttcctgacgcgtactgaatgtcgtcaatatttaagttaccatcaccttaacccgagagttcactctcacgtcttggtctgtcattcaaaatttgatgccgacgattgtcttacatctttttccaatcccgacattcctcacgtgtacgcaaacaggcaacgcaaaaaccggttttcccctcaaatttgcatattttaatgcaggatgacttgacactcatactttaggttgcaatctgcgagtgaacttcgacagtaatgtgcgacaagccttgggccga

SEQ ID NO: 671681 - DNA, 329 bp, Homo sapiens
cacaggatccagcgtatacatatcaagacgttttagcccggatccgatggcaaatgatgagcaagatcgatggcggaggcttttagatgaggagatgtctgaagtgatttctccttacctagtagagcgcgatgggatttctaccgaactggctacagtacgcgagcacaaaaggcaaatcgaatatgggattaaagtgcggaagcaacagaatgaaatattcggcgagattgaaacgttaggccgaacaatcgatcgcataactttgcagcttgatgagttacgcaaaaaagctccgtcaatcggagaagtgttgtcggtgcttggtg

SEQ ID NO: 671682 - DNA, 342 bp, Homo sapiens
agccgccgccgtggattcagcagcctcccccttctgggccctcgcttcccgacgttccgttcccccctgcccgccttctcccgccaccgccgccgccgccttccgcaggccgtttccaccgcggaaaaggaatcgcctcctaatgtcgctatccagaacctccactctttcgacccctttgctgatgcaagtcagggtgatgacctgcttcctgctggcactgaggattatatccatataagaattcaacagagaaacggcaggaagacccttactactgtccaagggatcgctgatgattaccgataaaagaaactagttgaagcggtttaagaaaagttt

SEQ ID NO: 671683 - DNA, 349 bp, Homo sapiens
gagtgcagaggcgtgatcttggctcactgcaacctttaactctctggttcaagcgattctcctgcctcagtctcccaagtagctgagattacaggcatgcaccaccacgcccagctagttgtgtatttttagtagagacagggtttctccatgttggtcaggctggtctcaaacttacaacctcaggtgatccactcgcctccgcctcccaaagtgctgggattacaggcatgagccaccgtgcccggccgagtatcagtcttttaagtggatgcaatttacttctctttgataaacacctgggagtggaattgctgagtcctatagggtaagtgcttatactgttctg

SEQ ID NO: 671684 - DNA, 659 bp, Homo sapiens
tccgcacatctggcctcaagtgatccatccaccttggccctccaaagtgctgggcttataggcgtgagccaccacgcctggactgttaaaggaattattaaacaagaaacataaatgaaaattaatgcaaactgcattcttattttccttttacttattaaactatttaactttgaatagtttaaaatattttcaatacctatattgaactgccctatctaaccatccaaatacaacacttcacattttttagtaaaggtggtgcaatgctattttaaaaagtaatgagctttataataaaataacatgctgctgcaatgttcatgcggctttccactaaacgcataaagcaaaaaaatcacttgcatttctgcacagcttcatgccatgaagttcataaaagaatatcagcaactcttaaataacagtaaacattaaattgttcctaaaatattacaatataaatatacaacctaaaaaataaattacataggctaaatatacagaaatcaggtgggaaaccattcatatgtctcctgtcttctgcggcatctttcatacaattcttacaataaaatacaacacatttcatttatgtggcagacaaaacgctaggctatgctgacagccaaacagcacaaggctctctgacaaccaaa

SEQ ID NO: 671685 - DNA, 944 bp, Homo sapiens
ggaaaaaaaaggcgacatggatgaggcgcacatagaccaggtgagagcgaaaggccttgtgtgaagagatcgatcgcgagtcaggcaatgacggaagcttctgaacaccaggaagtggacgggaacccatgtttggtcacgctgggatactgtgtggtttccgaggaacgtaggaccaacacaactcgaaccattatgctcaggacttaattgggctagggcattctagataacaccttgtccccattctgtttccaggactcgacgctcgcgacgcaggcctatcggatgtgcgaatggcctccaagctatgggccctgcggtcgataggaatgcgctggtgtgactagctctgcatggcagaatcttgcagtggcgtgtacgaaccagggtcattgagcttgggaagtacaggcccggggaaggccggggccgctcgtggtgtatctccaaactcggtcctcacaagcgaaacgcaatcttgtttggacgagttttgatccaagcgggcaaaactggctttccggcaaacggttcaaggatccacacggaccgtgcgggagaggcaatttaaattcaaccctccgtgaagcgaagggttgtggttagcttccgcgccccgaaagttaagctggcctagcaaaaaatatgccggttggactttacttcccagtattaatggcctgggagtttataccacaaaatttttggttctgggtggaggtagaacagtcaagactcttctgggttgaggggtagcgccattcggaaggcccaggactaccacgtactaagttaacatatagcttccccaattaagggcgttacgcgtttcccaggtcaattggggatacacgtagggcataaaactggtcctaatgtcaagtttgttgccacaagttgaacaggccaatcttgactggtttggggtccagcattggaac

SEQ ID NO: 671686 - DNA, 385 bp, Homo sapiens
gaggatcgtgttgaggtgtctgttcatgagctgagggttgggttacccagaggagttggaggaggtgagtggggctggggaggtggaggaggtggtgaggaattgggtgggctggaggctggatgaggggagagaggggtatcctggcgagtccccgtcttctcaaagggcgtttgtttttccagatccaggcttatgacccagagcactgggtgtgggcgcgagatcgcgctcacctttcctaagagctccagggaccggggaggttcataatgattgacgcacttgagttactgattggggtcgagcgcgtcagctgaagctctggtttacatctcgtgccagctaaaccaaggtcgaagcacagagcatgagcacttcatca

SEQ ID NO: 671687 - DNA, 639 bp, Homo sapiens
ggcaagactccgtcaaaaaaaaaaaaaaaaaaaaaaaaattgatttttgggcccccctttaaaattggagccccattcctttttccaatcgggcccgaaattagggaggatgactgtttcggaatggggggtggcctctctcgcttgccaggggccctttgttcagagccagccgggcttggacagacgggccttcccttccttcttccaatctgaccgggccacctgtgctgctctcgggggctttaggccaccggcttcccttgatccccaagaggagatacgccccagatggcactggaatgtggtcggcatgagagcgcttgtgtgcgatgcgccccggcttggtggctccccttctttgtgtccctctccattccgtgatagtgctgtcccgtgggctcccttttgcattgttgttccgtgtgtacagaggtgagcggcggttatggcgattcaaacatcaattggggcctcttgtggcttgctctcaaagaggccaaattttgtgacttgtggcaagagcatttccaatcctcctttggaacaccaaagaattcccttgaagttcccccttaaaccctgggccctttgttcccaaccaaaggggtaaatcggggaaatggggggaatggcaat

SEQ ID NO: 671688 - DNA, 742 bp, Homo sapiens
ggcaggctgatggaagggcctctagggaacttggcactttctataccttggtactatgcatgcctatggattctacacccaataatgatattactgtgaacccatctgtaagaaactgcttcggaaatcattgtgtgtatgtaaataacacaacatagaaccaggagggaaaaaagtctgcagtaatgcaggtattttttccttccgtgtaattcccggttgagcttaaagtcctttaattttaaatcccctttggttccttgcggtctgggttccttcgggtctatatgggtgccctgatactccagcagagatcagaagggctaccaagatccattctatccatcgcgttaatggtggctggccattccaagctgtggaggtgtctcttaacaaaaggatacatcaccaggttggtggtccctgggctacttcgttggggatggcatagacgtggacaacacatttaaaaccacacttaccttgggtaaaccatgggtgggtacaacaaattaccatttaacttcttaaataggtaaggaaggcggtagaatgtttttaacagcagtggacaggcgggctttttaaatttcctttacattccgtaacatgggtgggcgaaaggcagttctgtttgaacacatccagtcttgggttgacacaaggttcccattggtccacaactggatttctaattaacaatgtcggtgttacagacaaacaaagacacaaaaacagtttg

SEQ ID NO: 671689 - DNA, 603 bp, Homo sapiens
  misc_feature (515)..(515): n is a, c, g, or t
ggtaacgctgagctcccttctttgtcagagcacctcggctaatgccagcggcgtgttcattaccgatgcacactagatgaaggttgactgtcggactgaagcgtggcgcgatgatcattagctagcctagaggctgattggctaagctaaggaactgcacacaggatcaattgaacatcatcatgcatcagcgaacgaagctgctgacaccgttgcatcatgcattgctgatgagtcctgtgggaagtgtgacaaaacactgtattcccttattggcgacagaccatgcacagttgcatctctgagcgaacactacgctggggtgcttgctgtactgaacacgagcctgctagagatgaaagcttcttgccgcacactgatgacaaccgacacctacagcctatggccagaccatgagttataccatgtgcactgcttgccatgacaaacaagacacactccagacaataggcttatgtgaaagagcccgaagacatccttacatgtatgccccnggaactctcattgttcttctgtagtcaagctagacgaacttcagactcagtggacgctacgttgacacaagagactaaacgtgccgct

SEQ ID NO: 671690 - DNA, 359 bp, Homo sapiens
aattagtatgggaaattattagcaaataaatatttttcctttaattttttattgtgaaaatgagaccccaggcccaggctaccatgcagggctaattctttataaagctagggtcttgccatattgcccaggctggtctccaactcctgacctcaggtgatccccctgcctcgacctcccaaagtgctgggattacaggcatgaacccctgggcccagctgacaaaatgagtttttaaacttttttttttttcagttttttttcccctttgaatcaaaaatataatttgcagtatcatacttgtttatattacattgtatgcctccctattcattaaaaatcaagaaagttttattgta

SEQ ID NO: 671691 - DNA, 258 bp, Homo sapiens
cttgagattcccgcacgactctaagcactggtacgccgtcgtcatgagccctgtggaaccagtggacggactaactacagcgaagcacaggcccaggaagaaacgctcgtcgccactagctgctgtccgtctgggggaccgtacggcccggcaccgggggtaacggagtgtgccttccgtggtccccacatgggtcaggctggcatacgaccagtgcagcaccacagtatacacctgtgacatcatccccatcagggc

SEQ ID NO: 671692 - DNA, 376 bp, Homo sapiens
  misc_feature (6)..(6): n is a, c, g, or t
  misc_feature (28)..(28): n is a, c, g, or t
  misc_feature (209)..(209): n is a, c, g, or t
  misc_feature (214)..(214): n is a, c, g, or t
  misc_feature (217)..(217): n is a, c, g, or t
  misc_feature (356)..(356): n is a, c, g, or t
  misc_feature (372)..(372): n is a, c, g, or t
agcagnacgtcggccccgaatgttgganagtcttgtgacgctcggccccgttcacgaaccgccccggattctctcccgccaagtaacgcagggctgccgatgacggtatcgggcgggaaatgcgcctttcgccgttccagcatttgaagggcgccgtggatatgggcaagctcattctcgagcgcgtagtagcgattcatatggtcctncgcgnatntccgcggctgatgatccgtcaaaccggaccgacacgcttgatcgcgctcaatcgatcgatgtatcggcaggccgtcgcccgcgaagcacctgaatttgtccgttgatacagatcaaccgcgccagaagccggcacgccntccatgacgccagatncttg

SEQ ID NO: 671693 - DNA, 130 bp, Homo sapiens
gctttgaggcaggacactggtgagcacagccgtacgactttggaggtgacccccaatgtgagccacagcaatatctattcacccaaggaaacaatccgcagaagaggcacgaagtgatatgcactacagt

SEQ ID NO: 671694 - DNA, 916 bp, Homo sapiens
ggccttggacgaagattcggtatgagaagcctgacagacccttcgaagttggacaggtggtaaagagctgaaaatggacatcatccccaatgcctcaggaacgtagccctgactttggtagacacaggcattgggctatgaccaaagctgatctcatacaataattgtggtgaaccattgccaagtctggtactacagagcattcatggtatggctcttcaggctggatgcagacatctccatgcattgggcaggttggtgttgggctttgtattctgcctacttggtggcagagaaagtggttgtcgatctacaaagcacaatcgatgatgaacagtatgctttggggaagacttctgctgggcaggtcccttcgctggtgcgtgcgtgaccatggttgagcccatttggcacggggtacccaaagccgatgccgtccatctttcataagcaagattcagacagaagtcacctagaaagatgcaggccgggtcaaagaggaagtcatgtggacagaacgctttctgcaagttgcaatcaggctaataccggatgctagcctgtgttgattgtggcagcaagcggaaaccgtaccagggaacgggtataacttgaagaggagaagtagcgaagagcgaggaagagccagacggaaccgggggggaaggaccaagacaagacgaggagaagaagatatcaagaaaaagatcagatcaggaaaacacacggccaagaaggacggcagaagatgaactgccggggggatgaggaaatctggggagagggtacagatccacgtgggggggcatccagagcatggtaccaaacgaatatacacaagacaagaaatcggaagagatcaaacgagaacggcaacagggcaagtacgggaacccagaaggcacggaggccacag

SEQ ID NO: 671695 - DNA, 185 bp, Homo sapiens
cccttaatttagttgggttaatttttcaaggggagggatcccccgcttttttttttggcatttgttttttcaaggggtttccatggtatgaattgggctttttgcccccaaatttttgatttggggttgtttggcgggatttttttttgtgaaataatcccttttataaaaaatttgatgggcca

SEQ ID NO: 671696 - DNA, 184 bp, Homo sapiens
gaggcggtacccatgctcatgttgtcagcttattatctttttcacttcattctccggtttggaaccagattttaacttgtggggcccccttgttcctcgagcttccttcctgttctgggaggcggctgggaggcgcgaaaggccgggtccagtcttagacccctcttgcattgggccagctggt

SEQ ID NO: 671697 - DNA, 220 bp, Homo sapiens
gccggtcccactgaaagaaatgaagcatttattccaaaatatatctcttgacatattttgaaacagccctgcaaagctgtctcttgtggggaaaatctacattctatacaggatccccttcctttcccaggtcttttgctgatccaggagagatttaactaagagtctagcaccttttacagtctgatgagacatctgccacctattctttttttttttt

SEQ ID NO: 671698 - DNA, 252 bp, Homo sapiens
  misc_feature (75)..(75): n is a, c, g, or t
  misc_feature (80)..(80): n is a, c, g, or t
  misc_feature (82)..(82): n is a, c, g, or t
  misc_feature (175)..(175): n is a, c, g, or t
  misc_feature (177)..(177): n is a, c, g, or t
  misc_feature (188)..(188): n is a, c, g, or t
tcctccctgcaccagatcctaactctgacctttcaccttctctctctcctgaaggaactcttctgagtggacatnggccnangccttacctaagcggagagggagggcaggggctgctactcttctctgtaaccttctctgatgggttgtcactttgcacgtctactcttccacntngcactgccccnagctctctgccttacctgtgttatgggcacttaagcagaaatacagcggccattttaaccagca

SEQ ID NO: 671699 - DNA, 171 bp, Homo sapiens
cctatatgaatgggcagctcacggaacgccggatccttaacccactgagcaaggcaggatcgaaccctcaacctcatggtttctagtcggcttcgttaaccactgcgccaggatgacgggaactcccatttttatacattattattcagaccgtcaggaatgctaggcatc

SEQ ID NO: 671700 - DNA, 104 bp, Homo sapiens
gagctcgtccctgttgcttttgcacctacgggggcatctgagtccagctcccccaagatgagctgcagctcgcccctgagttacttgcagctcgcccctgagtt

SEQ ID NO: 671701 - DNA, 1030 bp, Homo sapiens
  misc_feature (745)..(745): n is a, c, g, or t
accaaatgcctattgtctcccgaaactttgacatctatattagtgttgcaggtcatatatgtacatagaggaattgatagtccagtggtacatgtacgaatctcctgctaagtcgaactactaggaaagcaagacgagaccaaatggaataaatggatgaagagattgaatgaacatttttctaaagaacatctcgagctcaagattaccccagataactttctgggcttcaaaatcttgcttgctgtgtgtcctcatctgtaggtggcgcgagactatacatctgattgcctaagccagaaacctcatagttatacttgacgtggccaggacgacatattattgagtttgttcacagaagatgtcacgcttattgaaggtcattgttcttatatggatacataatgcgaacagtgtaataagtgtcatatggtcaatgagttggaatacatttatgtacttgtgtgactatcctcatagatagagaggacaagatttctattcacgacgcggtgaatttcctatgtgtgccatcccaatcaatcctttccccttgcgtggttcctaaacaatgactctttcctatcttttgagaaagattagaaattgttttctagagttccagtaatggctcatacggggtcgaggtcgtgcgtggtgctgttacagatacctgagactgggtaattataactttgggaattattctcacgggtgcggatgcttgagaagtccactgagccancgggcctagcagggtccgtggtcctgagggcccagtttctcaacttgagagctgggggtgtaaaacaggcgccagatgggaagggggcgaaggggccaaacaaaacaaaccacgggcgggtggggggagcgcgcaaaaggggagcacccgggaagagtgaaaaacgccagagcagccataatcgtgggggaggcccatcggggcaacagccacgaaaaatggcgcgggcacgacagggagaggataggccgaacacacaggatcacagaaaaaaagcacacgggg

SEQ ID NO: 671702 - DNA, 332 bp, Homo sapiens
gctggacatgatgggtcacacctgtcatccgcatgcactcttgggaagctatggtagtcagaacagcttgagcacaggagtttgagatcagcctgggacacgtaatgagacctcgtctctatcaaaaataaaaacaaaaaccaattagccagtgtgtggctggtgcgcacctgtagtcccatctacttgggaggctgaggcaggaggatcgattgagcctgggaaatagaggctgcaggaaactatgcacggagctgtgcaaccagtgcactccagcctgggtgacagagtgagaccttgtctagaagaaaaaagggtggccagaaggaggt

SEQ ID NO: 671703 - DNA, 292 bp, Homo sapiens
gctcgacaaaaaaaatcaaacttacctgggaataatgtataaacgaaattttgagaaagtcatgtttttctcatatttactttcccaccataaaactttatctttccatattagaagatgatctaagagtataaatttgaagggtttttttttttcaatgttttatgcttgcactaacatttttttcctgtcacactaaaagcagacttcgttatgctgctcacacgtgaagtttatgtgagatatatggaagtaaatgtgtgtaatgagtgtcaaaacatttaatgtcaag

SEQ ID NO: 671704 - DNA, 582 bp, Homo sapiens
  misc_feature (21)..(21): n is a, c, g, or t
  misc_feature (42)..(42): n is a, c, g, or t
  misc_feature (44)..(44): n is a, c, g, or t
  misc_feature (128)..(128): n is a, c, g, or t
  misc_feature (262)..(262): n is a, c, g, or t
  misc_feature (315)..(315): n is a, c, g, or t
  misc_feature (354)..(354): n is a, c, g, or t
  misc_feature (356)..(356): n is a, c, g, or t
  misc_feature (371)..(371): n is a, c, g, or t
  misc_feature (515)..(515): n is a, c, g, or t
gctgcgcctactactaccctngaccagtgatccatctgcctngnctcctgaagtgctgggatgcaggtatgagccaccatgcccggcttttctttccttttttaaaaatgcaaattaacaaaaatgtnggagaataatgtttcaatacaatattaaggggagaaggaagatgctaaccaatgtgtataatatggtgctttttggttaaaaagttattgtctgtatagtaagtgtatgtttggaaatatatcatctttgaaanggcagagaaaaaactggaaacagttctatagaggagctgagcagttggaggcnaaggtaggaaagctgattttcattaaataaaagcctttngnattctatactattanctattataaaataaatacataaataggaaggaataaatccattttcaagcctaaaatatctgaactgcattatatacagtatgcataccgttgtttgtaatcttccctttcaggctttttactagcttcattacagtcggtgtnccatgggtttctggttacacatttgttactaaataggttatgaggttaagattagagtcatataaat

SEQ ID NO: 671705 - DNA, 887 bp, Homo sapiens
tgctgggattataggtgtgagccactgcacctggcctttattattttatttatttttaggtattcttgccagtacagcatataggtttatctaccccaattacttactggggtttggtcccacatctacataaaggcccaaactcatggaagtatcacaaaaccgttacatgcaggccgtgtgttgctcgtggttagtcaagtggctgattgtgcgttcaacgtgtcgtcagttatgctatgtgcagcctgaaacgtggctccattaaacagtagaatagccgcgggtctcagctcatctctgtgcaaaaacaatgtgcatcatgtgttacacacaagttaaatctcgatatacagtgtggtttgtgacgaaaacacggggcgtaccatgtgttttcttcacacacgtgggtgtggcccatataaacggcctctcaggataaccatttgtgtctccactttgtgtgatagactccatttgtgtgggtgtgctccaccacactgtgttataccccctataaaaccctgtgcacgagggcaactctcaagcgctaacgtgtggtaatattatatagtgtgtgagagtgccaagcaaaaaggcgaaactaaccctgttgtggtgtattcgtgtggaactctttgtatatctcgccctaaaagtggaggatcacctatataaggggcgacgacggggccaactaacgcgtcggaaccacagggaaacaaccacagcaaacaacacccaaaataaggtgtcctacttgtccatattgtgtgtggccccttatactatcttgggcataacgaaaacacacagttatatctgtttattatctccctctccggtggcatcccccttttaataacccaagacaactgttttggccc

SEQ ID NO: 671706 - DNA, 381 bp, Homo sapiens
ttatgtgaggcactatggttgttggcctataggcagggaatgtgataaggccctagaactcgatttaaagcactacactaaacttcgtaaactaaagtcccagtgcagtatagaatggcatggacagaaagactctagaggtgcagctccgcaatggctactttcttgattcagtgctatttctggcatcatgtgctgcaatgtgaatttttgcttatctcccaggagtcgaattcctcaggtcactaaaggtgtccagcagcctctactcaaatcgttttagcatttgttcgtgaacaagctgtgttcactacaacatgaactcttacaccaattgcacatccaggactctggcacttggtgtcagtctgctgatgtttc

SEQ ID NO: 671707 - DNA, 103 bp, Homo sapiens
actctaaggatccccattggatatgcggatagggagaacgtacggtgtgtaggggtaggtgtacttcagagaggttccctgggtttccggcgacgccctcctt

SEQ ID NO: 671708 - DNA, 201 bp, Homo sapiens
ttgattactgaaggtgatctagaggatcccttccacaaaccccctcaacccaatatcttctttgttgggaaaagaggtatgagggagctggctgggtaggctctctagtctgttgggaagcagtgaatgtgtggctccatctccatctcttcatcccttctcatggctagtgaggacaatagggcaattactgagtcctgt

SEQ ID NO: 671709 - DNA, 296 bp, Homo sapiens
tagaggattacgcgatcgcttaggcttcaactaaccatatataaaccctgcaaatgtacgtgactggcagaaatattgctgaatgactaatgtggatcctcaaagggaaacacctcagctttttctaagaagagatgtgagattcccttggatgttgaaaaacagattgaagacccaatagctattcttattctctttgatgaagccagatataatttatagaagggcttaatacagactccatgatgctcagctgatgatcatagacaagtctgcaatagaaaaatagtcatatg

SEQ ID NO: 671710 - DNA, 867 bp, Homo sapiens
tagaattgtgcttgttatggcctggtttaatcttgtgccacgaggcgtgggctgtgtgagatgggcctgggtctgtgacggtgcctgagatccctataactgaaaaatggagaatggatgccccccaaggttgccaaatgcacatgccaatgcctagcagctctgggcaaggagtgtgtggatggctgatgaacactgatgtgatgtgcccatgcctgcatgccccatgccccatgcccatgctccaagcccaagtctcagccaccgtcatccaacaatgctgtcccaggcaatatgcactgcctggcccccctactggcagctcaggcagaaatcaattgtactcagggtggtgcctccagatttgtcagagaatggtgagctgactggccaaagctcctccctgcttcaaccgtcagcaaggaatcggggatgcttgcaagaagcttccctgccctgaaagattcagcgccaacccagtgatgcgggaggagctgatatataacaggacaagcataactgccatgttgccttgctgtaccatcgtatttgagcgtttcggtggtacagggagccacagctcatagttgaccctcgagaaagttcaccgcgggacggtgagatagctgtgagctagaggagctccacagccggaagacttgtgcttgggaagatagcagatcaaccgcccaataggccccggagcattgttggtacatcttgacgcgcccaaatactaacgccctcgaagctgctgtgggctagagcagtgcttgagtgccgatagagatggaacacccttcctattcgctggggatccggcgttcgaccgaccatattagctacggagatacccgagcaatgatg

SEQ ID NO: 671711 - DNA, 381 bp, Homo sapiens
ccagcaggtgcagcaggagaaatcgtagacgcgtattacgcgctgcagcagaaggtgagcgaagctggcgagcagcgacaacgaatctctggcctcgtgtgaagaagctggcggcgtgaaatgcggcgcaaagcgactggttcacccgtgacaacattcctgccgcgctgaacttcaagccggtcgtgcaggcgatcttcgacggctcgctgatcggcgagaacggcgcgccgggcagcaactccgacgtgatcaccgtagacggtgaacgagccttcgtggtgcgcgtgagcggacacaagccggaagtgatcgaaccgtacgaccaggtgaaagaccgcgtggtggaactggtgaagcgcaacaaggcgctgaaggcag

SEQ ID NO: 671712 - DNA, 100 bp, Homo sapiens
cgcttactattctccagctgtttaaagccattttccagctgctgctgggcccgcgcccttcttggaagtgcatcttcctctcctcccaagagccggaatt

SEQ ID NO: 671713 - DNA, 323 bp, Homo sapiens
  misc_feature (23)..(23): n is a, c, g, or t
  misc_feature (58)..(58): n is a, c, g, or t
  misc_feature (60)..(60): n is a, c, g, or t
  misc_feature (75)..(75): n is a, c, g, or t
  misc_feature (93)..(93): n is a, c, g, or t
  misc_feature (96)..(96): n is a, c, g, or t
  misc_feature (115)..(115): n is a, c, g, or t
  misc_feature (123)..(123): n is a, c, g, or t
  misc_feature (138)..(138): n is a, c, g, or t
  misc_feature (159)..(159): n is a, c, g, or t
  misc_feature (173)..(173): n is a, c, g, or t
  misc_feature (223)..(223): n is a, c, g, or t
  misc_feature (228)..(228): n is a, c, g, or t
  misc_feature (240)..(240): n is a, c, g, or t
  misc_feature (243)..(243): n is a, c, g, or t
  misc_feature (250)..(250): n is a, c, g, or t
  misc_feature (270)..(270): n is a, c, g, or t
  misc_feature (317)..(317): n is a, c, g, or t
  misc_feature (322)..(322): n is a, c, g, or t
ctccgctgaggtgatttggaaanccctaaaacgttgaaggcacgaatcgggtcctganancaagtcctcagccancagagccacgttccttangancaccgtgggtttatttcantttcctanaccactgacccgaanaaagcccggcgccaaggggantccggctttggganaagctgaagttgttataccccaggaaataactgtcactccggtccaaganggcangcaaagaaggantancctgcantgctttccttggatgagaangaactcgaagagcagtttgtgaaaagaaaaaggtccaaaggggccangcaanc

SEQ ID NO: 671714 - DNA, 104 bp, Homo sapiens
cagggagacaaagaaaatgaaaggccagtttcactcattatcatagatacatcaattctaaataaatggttatggtgagtgtgctgggaaataaaaataaataa

SEQ ID NO: 671715 - DNA, 326 bp, Homo sapiens
  misc_feature (2)..(2): n is a, c, g, or t
  misc_feature (16)..(16): n is a, c, g, or t
  misc_feature (53)..(53): n is a, c, g, or t
  misc_feature (119)..(119): n is a, c, g, or t
  misc_feature (174)..(174): n is a, c, g, or t
gntaataacattttcncctgtaaagataggctaatttctgaaataataattanatttatagaaagccgagaggaaattgctagtttacccctggtagaggaatttctgtatttgaaaantctccagaaggaataatataaactgtggactttgggtgataatgatatgtaggtncgtcagttgttaacaaatgtatctctctgttgggggctattgataatggggaaggctgtgcatgtgtgggagtaggaggtgtatgggacatctctgtaccttctaatcaattttgctatgaacttaaaactgctctaaaaataaagtttatt

SEQ ID NO: 671716 - DNA, 1005 bp, Homo sapiens
aggaaaacaaaaagacaaaaactacaagaacactaacagagaggcacggacgtgcgtacagcagaggcgagcccgcgtcggggaaccgttcgaggggtcgcgtaagtaaagtgcacacaccgtgggacgcaataagggtggcaaggtaaacctctgacccggagggccccctctagtgcccgggtgggcgtctctcccaaaggccgagggtaagacccccccgcccaaggagaccgggccttctttcaaaggaggggacccgcccctttggccgggccagaaaccaaatgttccccttggggccaccaaaagtcgccgcaagcaaccggctggcgtctcctccctcgggcgcagtgggttcatctactgtaaaagcatgcgcgggtgttttccttgcacacagtgtgcctacagcgagtttgtcccggaaacctcttcccctcctaaggagatggctttcacgagccccccgcctccctccggaaggccaagaccgacgagcaagcccaggtatgcaatcgcggggccattccgtgtgggacaatgtgctggcccccccgcgaaaaggttgtgaaagttagtgcggccccccgggccccggcaagaaagaacgacgaaggggggacggacacccaagacacaacacaagagggagggtattacaactatcagggagaccccctctgctgcgtcaaaatctgtgggatgggtcaacacccagcgccccctcgttcaggtaccaatacgctccacgccttgacaccccactgcgagcttgtagaattatgcggcgtctgtcctctgaccttacacacacacactatgagggctgttttgaggagagaaacacattcatatgggtgggcacatcgattcaacaatactgcctgtcccacgcaaataacatggattgttccacaagccagtggtgtacagcacaacagtttcttaaaaaaaaggaagtgggaaaaaaaacaaaaaagatccccacaaaaaaccatgaca

SEQ ID NO: 671717 - DNA, 150 bp, Homo sapiens
  misc_feature (98)..(98): n is a, c, g, or t
tatatgcgtgtttgttgacgtgtgtgtatgtgtgcgagtgtgagaattgtgtgtgtggatgtgtggactgtgcgtgtgttcatgttcggactgtgtgngtgtatgtaagtgtgtgtgcgtgtgtgtgactgtgtgtgcctgtgtggactg

SEQ ID NO: 671718 - DNA, 464 bp, Homo sapiens
agctggacccacgatatcggtcacattagctccggacagtcagaagtgctttatctccatttgcataagtggcaaagtgaccctatgctgagccagagtgggaatgttgacagtcgagagaaacagattcctctgagtccccgggagcaatggaggatgatggcttgctgtggtcgaaggcagacatagagcaatgtctcctttcagaacagtgggaagtctaaagttgaggataccgtgggggagaagatagggaaatgaggcaagtagatcaaagagataatcacttttgaattctgcaatttacagggatgtgactttaaacagcaccattctccctttaatgtttgacagtatttatgactgtcactctgagaggagacacagcaatacgtgccacgatttggttctgtaatggcatcacctgcatctcaggccatgactgtataatattccagtgtgct

SEQ ID NO: 671719 - DNA, 203 bp, Homo sapiens
  misc_feature (5)..(5): n is a, c, g, or t
  misc_feature (61)..(61): n is a, c, g, or t
  misc_feature (99)..(99): n is a, c, g, or t
  misc_feature (110)..(110): n is a, c, g, or t
  misc_feature (115)..(115): n is a, c, g, or t
  misc_feature (202)..(202): n is a, c, g, or t
gaaantgtacagtgtgaactcattttaaaatgtagtgtgcttatgtttataaatgcatagnaaggtctattcacagctttactttgaaacaagtgtagntacacatgganacttntacaactttattaacatttactcgtattaatattttaacaataaaccacattatttttaaaactttattttaaataaagaatttttna

SEQ ID NO: 671720 - DNA, 433 bp, Homo sapiens
agaagttttgaaacactctctttgtaaagtctacaagtggatattttgagcccttggaggcattctttggaaaagggaatgtcttcacataaaaggcagacagaagtgttctcagaaactgctttgtgatgtctgtgttcaactcacagagtttaacatttcctttgagagagcggtttagtaacactctctttgtagaatttggaagtgtatactaagagcgctttgaggcctatggtagaaaaggaaatatctttccataaaagctagacagaagcaatctcagaaactcctttgtgatgtctgcattcaactcaccgagtggaacattcctcttgatagagcagtttggaaacactctttctgtagaatcagcttgtttgtatttggacctccttgaggccttcgttggaaacgggttttcatcgtataa

SEQ ID NO: 671721 - DNA, 188 bp, Homo sapiens
gcaggccctgagttagcagaggaggactgtaggctgagagggaaagaaaatgaaggttactttcatggaagtttcatttcttttccctgtttgtaccacctgcatttacttttggcctgcttcaagggccaaatttggtttaccttgcaatcctaaaggtacaaaccttgttctcaggaatattttaa

SEQ ID NO: 671722 - DNA, 166 bp, Homo sapiens
gtgtgcaccagcgaagtctcacagaggctcacctttgacacttcctgagagaggtctctttatgaattaagagtacaaaatcctctgagatgaagcaacctatccagttctatggattgaatggagaatctttcagaaagaccatcattgggtagggcaactgatt

SEQ ID NO: 671723 - DNA, 247 bp, Homo sapiens
  misc_feature (8)..(8): n is a, c, g, or t
  misc_feature (147)..(147): n is a, c, g, or t
  misc_feature (190)..(190): n is a, c, g, or t
  misc_feature (211)..(211): n is a, c, g, or t
  misc_feature (215)..(215): n is a, c, g, or t
agctctcngggcctttctctggcttccttgcttgcctggtgggggaagggcaggagcggaagaaggaaagggaagagtcttccaagaccagaaggagggggacaactccccaagaccatccctgaagacgagcatccccctcctctncctgttagaaatgttagccccgcactgtgccccaagttctagncccccagaaagctgtcagagncggncgccttctcccctctcccagggatgctctttg

SEQ ID NO: 671724 - DNA, 956 bp, Homo sapiens
agcggagagcagacagcgccgccgccgccgccgcgcactccgtgcgtccgtgagagccgggccggctcgggccaaccaagaagggcttcccggctaagggccgaccgggcgccggacagcgcgtgtgcccggggcgcaaggccagggcttgggggccttggggcttcaagaagcttaagcgttaagggcgcactccttgaaaagcccctttttgtgtgatatattgtgtttgcgcaactttttccgtgtacacgaggttgggccgtgggccaggaagggcgtatacgcggcccccttgtagacttttttgagattgcgttattgtattgttagtgcgcttgggacagcaggggctgagattcgccgtgattctttgcgtttactttcgtttgagagagacacagccgccaaaacgcttgaacagacaatctcagtgctccccacattttgtgtccttgggggcgcattgtgggcttgtggtgacccggagagacacccagaggaaattgggggggctgtgagagcttgtgggtttttcacacctttaactttttacttctccccacaagagggaggctctttaaagtttctcatatacattctatgggccttgttggaacagggtgtgggagagctgacagaaggggcggtttcactagtgctcacaagagggacccacccagttaaacgctgtggggtgactcgtgtggtggtgcaaagacgacgaagctgaggcctggtggtgttttatccccgcccgggcgttttctacaggttggtgctggcgcccctttttggacccccttttttgggtatcaccagagcggcgctttccaaaacgccgcccagtttttaaaaaaaacctggtggatctctgtggatactctttgtgcccacaacaaacatacagaataaaacaaaaagagtctctctcacaagacgccgcgaaggaactc

SEQ ID NO: 671725 - DNA, 111 bp, Homo sapiens
cgactctagaggacccgcaggtgccttagaggttggttttctagaaagctcacctttttctgtggcaattgatatgatgtgatactattcatctgtaaacaactccttctg

SEQ ID NO: 671726 - DNA, 377 bp, Homo sapiens
gaataaacaaggagaaccaaaacaaaactggactcaaagcctaggatgttccattcagttgtaaaagagatgtggactttcttggtccacccttacaagacaatgacatctgtaatgtgacctgtacttgctaggctttagcaagtcactcgaggtcatggaacatgtttttgaagaaataatatcagttcatgaattctgtacctgtatctagtcgctgaaggggtaagtgacatcagcagcatgttcattccttttcttgtcttctacctgttctccacaaaagtataaaaagccagaattgctttttgggttttgagatggcattgtcttccatttgcaaaaaacagtttataagacaaataatacagaaattg

SEQ ID NO: 671727 - DNA, 409 bp, Homo sapiens
cggatccccgtcttctgttctgcctcgagcacagtcagtacgagagggcgtgtaagctgctgctggctgccaggaagtatcagcgaacccctgtcgagctgtgcctggggcagaacatagcactcaccgaggagatagcggaaaagatgaccgtggccaaggactcctcggacctgcctgaagagtccgcggcgggagctgctctagcagatagcagactgctgcatgcgccagggcagctaccacctggccaccaagaagtacacgcaggccggcaacaagctgaaggccatgagggcgctgctcaaatccggagacacggagaaaatcacgttcttcgcgagcgtgtccaggcagaaggaaatctacatcatggctgctaactacctgcagtccctggactggcaga

SEQ ID NO: 671728 - DNA, 150 bp, Homo sapiens
  misc_feature (79)..(80): n is a, c, g, or t
  misc_feature (147)..(147): n is a, c, g, or t
cgcattcggggagcgtgccgtggctctctcggctctcatgcgtgacgtcagggtaagctgtcgctggtctgtctgtcgnngtctcgtcgtatcactgagagaatctcagtctctcgtcaccactgttgagtgctgcgtctggtcggngat

SEQ ID NO: 671729 - DNA, 748 bp, Homo sapiens
ggcagaacccagagttaccaccccaccgccttttttttgggacggagtctcgctctgtcgcccaggctggagtgcagtggcacagtcttggctcactgcaagctccacctcccgggttcgggcgattctcctgccttagcctcccgagtagctgggattacaggcgcctgacaccgcgccaaactgattttcgtatttttacgtggagacagtgtttcaccatcttggccaggctggtcttgaacttttgacctcatgatccacctgccattggcctcccggcagtgctggcaattcacaggccatgagcccactgtgctcagccgtaccacccactttccaatggcacacaacttgcacaacccgagaagcttatccagccttcttccgtagcaacacgtcctgtcatcagtctgcacccattcaatcttgcactgtacacttaacaggctcaacgtgtaacactactgcactgcacgacactgccgctgacgctgattacctctacgtcacacctacgctaccagggctacgcacctgcctctgccaaggcagccagtacccctcatgcatgtctgctcataggggccacctggctttccactcaaccacgttagggaactcttagagcacaggggatgcaaagataggagtaacatggacatggtacgatgccaagcaactcttgaggaaagggctcgaacagagaggatggaattcgatgaagaaggcccacagagaatctgaa

SEQ ID NO: 671730 - DNA, 416 bp, Homo sapiens
ttgtcggtgagatggtttactttttctgcacgtctgttctggcatgtttcttatgatctcatagctcacctggctcaatgatggccagtggtgcacactctgtggtattttccgcatggctgtgcccagttcattattattgccagtgtgttgatggacaccagttttagccaacatatcatagtactctatttcagatttcctcaatgctgggcagttgttatcgagaatgacgcacttccgcttcgctcttgtctgatcatctcagagtctgcttgtcccccacggcgtattctcctagtttccatctggagtcgtgccctcatagttgctcgactccatcgacttttgcgtcttctttgcggacctgatcttcctgccttaggagcgggacggcccccaaccaagcaacccct

SEQ ID NO: 671731 - DNA, 496 bp, Homo sapiens
gtgttggggaggcattcatgaagaatggagtacacatatatatgggtcagggtgttggaaaggctgccaattcaggaaaaaaaaaaaaaaaaaaaaacaaaaaacaaagtgtgtgtgcgcggcgcgcgcctcgggccctcggaaaaaagcttttagagaaaccacttgcgggtggggcggcgcgggggcccccaaggtgagggtaaggtggaactggggccaaagaggcggtcccacgagaggagaaaccgcgcgggcagagagaacaagagggggcgggggattccccacacacaatatataaaaaaagcgccgccggggggaaaacaccgcggaggcgtttgtgtgaaacaaaaccgagaagagagggagatacccgggggggcgcaaataacggggggacatctatatacacaacgagggggaggctcccaaaggggagagcccgagaaaatacttacaatttatagccccccgaccggggggggggatccta

SEQ ID NO: 671732 - DNA, 169 bp, Homo sapiens
  misc_feature (55)..(55): n is a, c, g, or t
aactggaatggtttctgtacatttgatattatttcaaaataaagctggatgcggntggctcacacccataatctcaacactttgggaggctgaggacagaggatcacttgaggctaggagctggagaccaacctagggaacagagcgagacctcgtctcttcaaaaaca

SEQ ID NO: 671733 - DNA, 792 bp, Homo sapiens
agcgggctgacggaggcccgggaggcggacgaaggctgtcgttgccttggccgtcgcatccccgagggagtcgtgtcggtggccagcccgggcccacgagtcccggagattggccaccgtagagctcgtgtgtgcgtcccccgattcccagccaggcactcgacccctggcgctcgcgggcctgtgtcgtccgcgcaatcactgtgtggtatatttggcgttatcttaatactatccatgttgcctcgaacgagacgagaaatcctggagaccctaatcaaaggccttcagatactggagatacagtaaggattaccgagttctgcctgggtcgtggcgatattagagtcgtgagggccaagtgtactaaaagaaatgtggagacaggcccaaattgtcgctggccagagagactcacacgccttgtatttcatacccaaatgacacaggggcacaccacgttttaatagcggctacctggagcaattgcaacgaaaagctttacaacgaaatggccaacccaatggaatagtagggacctcttctcggattacctacgagactcctgatgtgtacactctgttggcactacgctcatgacctcggttcgggcaacaactagttggagtgaaccccagtccattgtcaatagcccatgccccgagtgcatctggagtagctccatccattgaatttatcgtgtcattcgacagatggaatcgagtcagtcaacgtacgagaaggatcttgacaagaagtttgttggaacgccaagggctatggacttctgaa

SEQ ID NO: 671734 - DNA, 140 bp, Homo sapiens
ttcgatctgaaagaatagggtaaggcgatggacagtaaacttttagactattacaatcacgagctggtctatctgcgcgagatgggcgccgagttcgccgaacagtaccctgaaggttcgcggtgccgtctcggcatgcg

SEQ ID NO: 671735 - DNA, 558 bp, Homo sapiens
  misc_feature (9)..(9): n is a, c, g, or t
  misc_feature (51)..(51): n is a, c, g, or t
  misc_feature (71)..(71): n is a, c, g, or t
gccacgccntcaaacaacaaagggcaacacacaaaactccggtcatatgcntgtgaccttatgaaacgtcntcaccaaatcttacaactaattccgagatacattaaataattattcatcatgaacagtgcaatttaccccggtttacaaaatgattagcatatgtaaatcaacaaagtgatagatcctatcaacagaatgagggacataaaccaaatgatcctttcaattgatgctgaaaaggcatttgatgaaattcagaattctttatgataaacatcctcaaagaactgggtatagaaggaaatacctccacataataaaaaccatgtatagcagacccacaactagcatcatactaaatggggaaaaattgaacacttttcttctcggatcaggaatgcaacaaggatgcccactttgaccactgttatttaacatattactggaagttctatctggagcaatgaggcaagagaaagaaataaagttatcccaattagaaaggaagaagtcaaaatttttgtttgctgatgacataatcttatatttgggaaa

SEQ ID NO: 671736 - DNA, 608 bp, Homo sapiens
  misc_feature (6)..(6): n is a, c, g, or t
  misc_feature (11)..(11): n is a, c, g, or t
  misc_feature (32)..(32): n is a, c, g, or t
  misc_feature (61)..(61): n is a, c, g, or t
  misc_feature (69)..(69): n is a, c, g, or t
  misc_feature (78)..(78): n is a, c, g, or t
  misc_feature (85)..(85): n is a, c, g, or t
  misc_feature (92)..(92): n is a, c, g, or t
  misc_feature (136)..(136): n is a, c, g, or t
  misc_feature (169)..(169): n is a, c, g, or t
  misc_feature (171)..(171): n is a, c, g, or t
  misc_feature (183)..(183): n is a, c, g, or t
  misc_feature (187)..(187): n is a, c, g, or t
  misc_feature (212)..(212): n is a, c, g, or t
  misc_feature (224)..(224): n is a, c, g, or t
  misc_feature (249)..(249): n is a, c, g, or t
  misc_feature (301)..(301): n is a, c, g, or t
  misc_feature (311)..(311): n is a, c, g, or t
  misc_feature (324)..(324): n is a, c, g, or t
  misc_feature (347)..(347): n is a, c, g, or t
  misc_feature (373)..(373): n is a, c, g, or t
  misc_feature (394)..(394): n is a, c, g, or t
  misc_feature (437)..(437): n is a, c, g, or t
  misc_feature (440)..(440): n is a, c, g, or t
  misc_feature (443)..(443): n is a, c, g, or t
  misc_feature (475)..(475): n is a, c, g, or t
  misc_feature (588)..(588): n is a, c, g, or t
taactnttctnaaaaatttatttttaaaaaanttaaaaaaaaaaaaaaaaaaaataaaaanaacctatnaaaatttanaaaaaanacaccangtaaggaagggttctttcaaaacaaccacaggaacagttacganaacttaaaaaaaaatgctttccacactaaactnanaaccctgcaaancacncctgagtggggacggcagccccaancccaggggcaancccccccaggctggacccaggccangcacacctggggagtctcttactgctgaaaacctcacccatctcacttcatntacttatccngctggtcaaccangattttggcggaggacttggcancaaaaaaaaattcactgatctcttcnacatgctctttctcaatgctnttcttcccgttgattttaacaaacaaattggccggggtcaacngcngcnctgagtccctcagtttggtcttggtgccaatntcccccaggtggttcagtgcctcctcactgatgttgattccttccgtctgggcacggattttaatgatctgtttcatttcctgtggagtatacagcatggtccggattatcancactcggtccagaaggtcaa

SEQ ID NO: 671737 - DNA, 271 bp, Homo sapiens
aattaaaaatttaaaatttttaaattaggattgcccatacttccacatttggggggggtttttttagaaatacattttgtaaagccccccagacatttgtcttccatttaaacctttttctttaaaaaatggttttggggggtaacttttacccagttctgggtactgttaatatctgggaagtttcttgggatttcagtgggaagctaaaccgtctaaattaacatgaagtacttccttttggttgggaaaaaaaaaacagattttttca

SEQ ID NO: 671738 - DNA, 330 bp, Homo sapiens
  misc_feature (322)..(322): n is a, c, g, or t
gctgagcttacgcacagggaaaaggtttgacttggagaggggctttgctggcctcaaagttcactagagaactcagggggcagtcacagacagttgagacttctctgctaagaagaggtagaatcttccctctagcagctaccatcctgtggcgtgagaagctagcctgcacctccacagctccactgtggttgcttgagccaacagtggtcgcttcttcactgccaaacccaagggagcttcttggttcatacctacgccggtagcacttggcgcaataggtggttatgttttaagtcaccttggcctctgtaaccccctnttctctct

SEQ ID NO: 671739 - DNA, 86 bp, Homo sapiens
  misc_feature (4)..(4): n is a, c, g, or t
  misc_feature (22)..(22): n is a, c, g, or t
aaantcgaccagcccccaaatntcgaagaaccttgccaatgttgtttaaaaaaaaaattcagggaaaattaaaaacctggaactcc

SEQ ID NO: 671740 - DNA, 144 bp, Homo sapiens
gggctctgaaggtcaactgaaaagtcttgtgggacaaagacttgagttaggaagccctcaatcactccgccttccacggtggcccgccctgctgccatcatcggctgaagcaccaccaggattcacggcacccaactgcttcag

SEQ ID NO: 671741 - DNA, 885 bp, Homo sapiens
gtcatccaggaatgccatctagtgggtcacgctgtggtgcaggtgggagcttgattctcagcagttgaggggatctgttgtgtacgtgtgagagggatgaggtgctgggagggatagatgggggtgctgcctggatccccagtctgtgggtacagagaggtcaagcccagtgaggactgccccgtgcagactggattgggacgctgtgtacgacgattggatgtgatgtgacggcacatgtgggataggcagctatggcatatcaagtaggtggttgtgaggttgaccagttgtcgcttggtctctggattgttgggaatttagggaagtgatgtcatcctcttgaaagatgctgaagcacggtagaagaaaagtgggcatgatatccatggagtggacagggacatgactttgtgcccattaactaaaggcctctatccttgtctgtgtcataccaggccgacccagactctgagcccctgggactagctgcttcttaaccccagtaagccactgccacacgtctgagcctctccagcccatagtgaccggctgctttaccctaaggcaagggcctcttgaggtccacttcttactcacacacgagatgtagccagtatactaggtagtgccctatataacaattgtaagaattgaggcacgagccatgtgaagacactggctcataatcctgcagcctgggaaggccggttgctcagagcttgaccacgggaactcctagttgaaagcaagtcctgctatagactggggacaatcctgtgtgaggcagatgtgtgcgactctggggccaatcagacgggatatgagagggaccactacggggtgtcgtatccacacaaaggcgagaaaggtctacgactacga

SEQ ID NO: 671742 - DNA, 668 bp, Homo sapiens
cggcacgagccaccgtactaccagacaaccgtagtcagaccatatacccagagacagtgtatgcgatagacaatggaacctggcgcaatagctatagagccgcacgggagaggtgaaacattatgaccacgcgttatattggctggactaacccctataccttttgtataatggaataactcgaaataactttgcaaggggagccagagctatgacccgccaaaacagacgagctatctaagaacaggtaaacgagcacacccgtgtatagttttgaatagcgggaagagatattggtagaggctaccaacctaccgagacttgtgattgcttggtgtccaagagagaatcttaggtcaactttaaatttgaccacagaaccctcttaatacccttgtgaatttaactgttaatggcaagagggacagatatttggacactatggagaaaccttgtggtgagagtcagaaggttacacccattgtgggcgtaaaggcagcatcttgtacaaagcgtcaagctcaaaccccatctctaaggaaaccaacgtataactggcttctaccccaatggcccattgtcacctatagagaagtgtgttgttaattacatgggaacatttcttcgctgaggcgcgtacaataacactgatcgcaattcttcttcgc

SEQ ID NO: 671743 - DNA, 312 bp, Homo sapiens
  misc_feature (270)..(270): n is a, c, g, or t
ctgctgccgggcacactgggaccagcaggctcctcagccaaccctgtcccccggccctggccctgccagagagggaccccagcacacgtgggcaccgggcaaggtctcagccgctcccacctgcccacagaagcccaggagtgtgtggacgctgagcccagctttcgcgcgcccttccttggcccctcacttccggcaagccggtccgctcttgcccaccccccctaccccggcgtttccgggcttagactggagaacattcatttcttnctcgactgagtggatattaaccgaaaagcagttggaaaggca

SEQ ID NO: 671744 - DNA, 194 bp, Homo sapiens
gctactctagagatcccggctcttctggaccttactgggtactggccctgggcaatgcgtctcgctggagctttgcctccttctactgggcttccacaagcccaggacatccctaacttcccctttaaactctggctccatccgcacactccgttaccacactgggtcattggcatttggagccctcgtcctga

SEQ ID NO: 671745 - DNA, 168 bp, Homo sapiens
ccctgtcgcttgccctcattctcaccatgtgaaataccgacacccgctttgccttccaccatgattttaaccttcctgagggctctcctagagggtgatcagatgccagcaccatgttttcatttaagccttcagaaatatgagccaattaaactcttttctttaaag

SEQ ID NO: 671746 - DNA, 266 bp, Homo sapiens
ttgaatcaattattgtatgatacaatagttagagtacagctaatcagataagcaacctgcgggcacaatgacctcagttccacacgtacacccgttcagcaggaccctataaaactttcctccaggccttgcctctttgcaggtagccccttctctgctgagctgcccactgcaacatattttcacaatttctctaataaatctgcccttctttacctacaactatcttggtaaatggctttaccacctgcgaaactgaccctagg

SEQ ID NO: 671747 - DNA, 278 bp, Homo sapiens
aaggtgaatggttttgttttgtttcgtttagttcgttcgttatgtttgacgactggagtctcaccactgtcaccaaggctggcggatgcaatgtgcacgttctctggctcactgcaactctccgcctcccgggctcaagcgaccctcctgcactctatctcccacgcagctggtaccacaggcgcccaagaccatgcccggccgatttttgcatgttcagtagagacagggcttcaccattgtcggtcaggcgggtctcttttgaactcctgactggt

SEQ ID NO: 671748 - DNA, 411 bp, Homo sapiens
  misc_feature (86)..(86): n is a, c, g, or t
  misc_feature (381)..(381): n is a, c, g, or t
ctgttgctgccatctttatgcccgtgagtacccagtgtttagctcctacttataagtgagaacatgcaagtatttggttttctgtncctgtgttaatttgcttaggataatggccctcagctgcatccatgttgctacaaaggacattattttgctctttatggctgtgacagactactttttatttaattaattaatttttttttgttttgagatggagtcttgctcttgttgcccaggctggagtgcaatggtgcgaccttggctccctgcaacctctgcctcctgggttcaagtgatctcttgcctcagcctcccaagtagctgagattataggcacccaccaccacgcccggctaattttttttatttttagtaganacgggctttcaccatgttggccaggctggt

SEQ ID NO: 671749 - DNA, 272 bp, Homo sapiens
ttaggtatgcagtctaccctggcactaacatctggccgggctagcatgttagactccgtgctagtcgtgatctccatcttgtatcgtccccgtgtacacaatgtcttcagtaggggggccccctcttgggtcacctcctctgccatcatctgaagaaccccaagccaaacactgaatgtcacctgtgcctgccgcctcggtccaccttgcgagttgtgtatgacacaactcaactacacagaacagacagcacgtgaacaatctcgcattat

SEQ ID NO: 671750 - DNA, 661 bp, Homo sapiens
atacacgaagaagaggaacaaggttagactatataagaaccatttgctgcgcgcatagtgccattgtgatagggaagaacttcagaaatctgtggtagtctatggcttgtctgtgtcttccctgaaccgtgtctccgagctctgtgaaagccagcatctaggggctaagaggatgcaagaggagagcagcatgcattggtctgtacaaagtgtgcagcgagaagtacgcccagaagcttttcctactgtacagatctctcgagtctgctttgaagtgatttcttttcttcttgattatttcttatatttctatatgtatggtgtaatagcctttgttaactaattgcgcttatttatccgtgtttaggaattaagcacgatcatgtccctttttaagccttacctgagaggaacaatgccttagaatgaaatacaagcattaatgagatgaagagtatgcacagaataagtttcctctacttattctgtacttggcctcatgagttccaatgtgtgtgaagacagggcagatgcgtgacagttgaattgcgatgatgttacgaagtgatgtctgtgggtcacattaatatgattgagcagtgggtggccaaaagtgttgtcttccacagggaagcttaaagaaaagaaaattttaaccatg

SEQ ID NO: 671751 - DNA, 670 bp, Homo sapiens
  misc_feature (142)..(142): n is a, c, g, or t
  misc_feature (151)..(151): n is a, c, g, or t
  misc_feature (159)..(159): n is a, c, g, or t
  misc_feature (163)..(163): n is a, c, g, or t
  misc_feature (177)..(178): n is a, c, g, or t
  misc_feature (234)..(234): n is a, c, g, or t
  misc_feature (501)..(501): n is a, c, g, or t
  misc_feature (504)..(504): n is a, c, g, or t
  misc_feature (524)..(524): n is a, c, g, or t
  misc_feature (532)..(532): n is a, c, g, or t
  misc_feature (550)..(550): n is a, c, g, or t
  misc_feature (556)..(556): n is a, c, g, or t
  misc_feature (562)..(562): n is a, c, g, or t
  misc_feature (572)..(573): n is a, c, g, or t
  misc_feature (579)..(579): n is a, c, g, or t
  misc_feature (608)..(608): n is a, c, g, or t
  misc_feature (610)..(610): n is a, c, g, or t
  misc_feature (665)..(665): n is a, c, g, or t
tgctcaccagggcagagccccttcagaacccacagagatccgtccacaaaagcggaaaaaggggccagcccccaaaatgctggggaacgagctatgcagcgtgtgtggggacaaggcctcgggcttccactacaagttctgnaactgcggnggctgcanggcntcttcgcgcgcgcnnctcatcagggagcgcactacatctgccacagtggcggccactgccccatggacacncacatggcgttcggcaatgccaggatgtcggcttcgcaaatgcgcgtcagtggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccaggcaacaggtgtaaccgggcgctcctttttctgaccnggnttcgaggtcacgcctttggnccattggnaccagaatccccataagncggggnaggccngtcagcagcnntttttnccactttcacttgagcttggccatctgtntnttgtgcagggagatagtttgacttttgctaaaacaggctacccgggctttcctgncagct

SEQ ID NO: 671752 - DNA, 421 bp, Homo sapiens
  misc_feature (1)..(1): n is a, c, g, or t
  misc_feature (10)..(10): n is a, c, g, or t
  misc_feature (87)..(87): n is a, c, g, or t
ncacctggangtggtcatggaccccagctttggccagcacaagtacgagcatgattttagaggttgctccagacgactgctctcccnagatgaggatgatgacctgtgagaaagtgaagctggagccctgcggtcagaagtctagttttataggcaactgtcctgtgatgtcagcggtgcagcgcgtgtgccaccttatttagctaagcagatcgtgtacttcattgggatgctgaaggagatgaatgggcttcgagtgaatgtggcagttaaacataccttcattttttggacttgcatatttagctgtttggaacagagttgtttcctttctgaatttcaaagataagactgctgcagtcccatcgcaatatccagtggggaaatcttgtttgttactgtcattcccattcttttcgtt

SEQ ID NO: 671753 - DNA, 156 bp, Homo sapiens
tcggacccgtctaatcacagcagtcctacttcatcctatctctcccagtctagctgctggcatcacatatactactaacagaccgcaagctcaacaccaccttcttcgaccccgccggaggagagagaccccattctataccaacgggaaggaacg

SEQ ID NO: 671754 - DNA, 1787 bp, Homo sapiens
  misc_feature (1107)..(1107): n is a, c, g, or t
  misc_feature (1214)..(1214): n is a, c, g, or t
  misc_feature (1302)..(1302): n is a, c, g, or t
aaacacaccaatattgcggagttcttacgccgagttgaactcggggggccgcaggcaggccctgatgtgcaccattaatagtgtgagtaccatccgacgggtgcgcattaccgaacgacgtgtcttctgtgtcgatccgagcctgtacctaagaggtcgcggagcgtttcagtcagagatcagtagtgtactagagagactcgggtgagcgtccgtgagtgtctccgagatggtagtcatcagtcagagccacgtcagaggtgcgccgcatggaatacagagtatctagcgaatagcccaccgatctattcgcatacgtcttggtgctcgtgctctggacataagcgcgtactttacgcaacgcatccaaaatgccccatagcgatacgtacgcactcttttcatcatatacttacctcattgtctcaatataacatgcgattcattcacgttacattatagcaacttttcatattctcatcgcgtaagtgctcctctttcttcctcaaggagaatttgcatgtgttgtatctagcatatgaaattataattagtctcctacgaaaggccgattacattgcagggaaacgcgcgggcttgtgcacccggtggcgctagtgatgacactcccaaggaaatatacactcggaaccatctacactgtaatgaactatatttctggagtagggtacattaagcaaattggggactctatcagaatacagagttcgtgagagaagtgggattatagttatagacataactctataaagtgcaagtgatttgggtaactaacctcgctcgatttcgcgttagtgtgaaggtcagattcttataccttcgtggtcttcgaacctggtatactaattcacattgtctacgcccccgggtgtgcggcccatgacatgaggcccactcactttggggcgagtgtcacaaaccataagcacatcggttccctcaaagaagccacaccacgaaccaacctgtgggtcctccccctagtgttccaagagcggtgtttggaaaacctccgcggagccccaggttcagtgttctggggggcgtccctttacattggaccctgggtgtgtaatactctgtcgnccgtcacaaatatcccgcgcttcgcttaaccgcaccaccagaggtggggccgaccggtttaggggctagggtcctggtgatacccgcttcaacggagccatcccccnttgtgttggcgcctcttccaaaggaaacaaagcctttgcggggttcgagtttgtgcaacatcggtggccgtatccagggtctattccncccgacatagaacccttgggggctatacgacacaccccttctccaagccccccgcgggagggcctatacacactttgttggcaccccccattagaggggtcctaactcctctcctgggccacaatggggggtcacacccctcttattgaacagccgccaaatatcttcgttagagacagcggctcaactagtcgctaacaacactgtaagatcctcccccggtgaaaccctctgtgtgcaagcggagcgaacgcctcggtgttttttatccgcgcccagagttctccccgccatctgtacgggaggggtccaccggcgggccaccccctgcggccctacgagacaccgcgccacccgaagacatctcgccgagctcgccgagcaccccacgagcgctcccaccacggttggcgctcccacaccccagcggctctttctctcgccgcacacaccaatcaaccgagcggtagcggctgcacacaacc

SEQ ID NO: 671755 - DNA, 456 bp, Homo sapiens
  misc_feature (48)..(48): n is a, c, g, or t
  misc_feature (58)..(58): n is a, c, g, or t
aggaggaccaagagcgtggatgcctgaagaagtgtgagcatgaccccncaagtgctcnggccgtggccaagctgttttggagtcagcggaagatcaccaaggcccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatccccatcgcccacaagaagagggggcaactgaggaggtgcccgccccccccaaacaccttctctaggggattcaacggttgccatggccggtgtcggtggggcagggttgggccgcatgtggaagggctctgagatgtgtcctccttcatttacagtttttatgtctcgtgtcac

SEQ ID NO: 671756 - DNA, 351 bp, Homo sapiens
cgggcaggcactatattgatgcgaacttagtgcggacacccgatcggcatagcgcactacagcccagaactcctgggctcaagcgatcctcccacctcagcctcctgagtagctgggattacaggtgcccgccaccatgcctggctaatttttgtatttttagtacagaaggggtttcaccatgttggtcaggctggtcttgatctcctgacttcaagcgatctgcccgcctccgcctcccaaagtgctgggattacaggcatgagccactgtgcccagcctgcttttttttttttttttttttaaataaaagggtggccttttttgggcccccggggggactcctttaaa

SEQ ID NO: 671757 - DNA, 111 bp, Homo sapiens
cttgatgatcccgtcataaaggcaacgtggctgactcatgggagtctgagctacagcgttagaggtgtcaccactctcagctgccatgctgtcaggaagatgacccgcagt

SEQ ID NO: 671758 - DNA, 181 bp, Homo sapiens
agtgaattcgactcgtggtactggatggatctctagatgtctgaccaggctccagccttaactgatatttggatggtcagcacggtgctcactgtgtctgacttgaacttgtacagtggaggcatgcacctgcagtggtgaatacacgtcgaccatggctccagtgtttaacgatattttg

SEQ ID NO: 671759 - DNA, 1592 bp, Homo sapiens
atgactagaattttgacattatgagttgacatccaccagccatcaccatcctcctcaacagtcaccaatttgcacaacacacacaacacatccacacaggtccagcaacagcaaacatccatcagcagccccatcccactacaatctctatgcaacatccacatcatcaatagatccacagtgcaacaacccatccaacacccattacaggtcaggcatcagccatcatcatagatgcaggcagcagatagttacagagcttgcacatccaccagatcaggtcaccatatcacacacacacacacaatctccagatgcagatcatcactcgtatatcagcacattggtatcaacattcaatcacatcagtagcatcatttcatttcatattctcaaatcaggtagcaatatacaagcacaatctatcacgagccagagatcaacatccacaaaacagagacagcacacagatatgcagccgaacagtcacagcacaacacaatcacatcatataaccgagaggcatctaatgcacaattatgtagtacgaaacacgctccaaacactcccaatcacacgagtcagttacgaaacaacgacccattaacagtgggtcacacccaagccaaagattagcaattcacccaaaagtgatccaatcaatccccaatggttaattcccaccacaagcacctattgggaagacaaccattggggcagacgcatccattagcacaattgtacaacggatttacaccacgagtatatacagatacatcaacagaacaccgtccacaacatccggcaaactatacactatacagacacatacaccaaagcacttaaaacataacaattacattcacatattaaacttaacacccattccttaatctttcatcacctatataatcatagatcccttctttaacagaaaatggttaatttaacgaacatatcaccaaaaacgttagccccctggttgtaaccttatcatgattattatcaccttgaagactttaaaacaaaatctacaaagttaacaacaaaaagttcccactagagtaatcacaaacacagcacttgcaaataagcaaataatatggacaagagatgttttaaacgcaatatcatcagatcaacacacactgtacaaagtggcactcattaaacttctacgaaataatcataccctagttgaactcagtcatgacgacccgtgagaaatccccacacagggacaaaatacggacacaaagcgaaccaaacacacagatgacactacaaagaaaaacagataaacaaaaaacaaatgagcagaagaaacacacaacaacagcacatagaaacaagacaacacagaaaagacacaaacacggaaatctagcaaaacaaggaaaaaaaacacaacaaacgaaagggcaaagacacgacaaagaagataagcaagaagaataaggaacatgcacaaaaaaaaaaactaacgaaacatccacagatagacaccagacaccgagcgacaacagcaacaatgaaacaaaacaacaaaaaacaaaagacaaaacaaaacagaagaaagcaaaacaaaacaa

SEQ ID NO: 671760 - DNA, 794 bp, Homo sapiens
taccgcacggcctcacctactacctgtgacatcaccaacccgccgcgtaccaacgtggctgtactggagctggcgcagtacgcctcggtagccctcggaagcaggagctgcatgcgcaagatggcctcctcctccggcgagggcaaggagctgtacctgagctgggtggtggaggtgcccggtaggcacatccgtggccatcctgcaggactgcctcgtccctgcggtcccctcatcgaccacctgttgtgagctgctgctcgcgccttgcaggctcgcgcctactacttccatcgcctcatcctccaaggttcctagccccatatctcatgttgcacagtctgttgctggtggttgtggaggtacgagtaccttatggccggtcctgctatcatactaatggggcgtggccaccgaactgggctgcgtgtgtcgcaatggtatgcctgccggggagaatcgggcgtgccgtgcagcttggtgcccatgttcgtgcgcatgtcccatgttccgcctgctccttcaagggccgatccatcgcctgtcgtcatgcgtgtggccccggcaccggggtggcacccttcgtaggcttcatccaggagcgggcctggctgcgacagcagggcaaggaggtgggggagacgctgctgtaactacggctgccgccgtcagatgaggactacctgtaccgggagggagctggcgcagttccacaggcacggtgcgctcacccagctcaacgtggccttctcccgggagcagtcccacaaggtctacgtccagaacctgctaaa

SEQ ID NO: 671761 - DNA, 256 bp, Homo sapiens
  misc_feature (52)..(53): n is a, c, g, or t
  misc_feature (128)..(128): n is a, c, g, or t
  misc_feature (130)..(131): n is a, c, g, or t
  misc_feature (164)..(164): n is a, c, g, or t
  misc_feature (187)..(188): n is a, c, g, or t
  misc_feature (243)..(243): n is a, c, g, or t
  misc_feature (252)..(252): n is a, c, g, or t
caggtcgacactagtggatcctgggtgtcattggctctgggaagcggcacannagcagggaccactcggggtctggtgtcggcacagcatggcgggcgcgttggtgcggaaagcggcggactatgtcnanngcaaggatttccgggactacctcatgagtacgnacttctggggccagtagcaactnnggtcttccattgctgccatcaatgatatgcaaaagtctccagagattatcagttngcgggatgngaaa

SEQ ID NO: 671762 - DNA, 144 bp, Homo sapiens
ctatatctcaggtcacccctctgcttcacaggagtcatgagctgatatctgcagagtagcatgtcgtgcggagtcatcccgttcttaagatgatgcccacgctgcgacgtgctgcctcttgttgctgtacaattccacagggcg

SEQ ID NO: 671763 - DNA, 842 bp, Homo sapiens
ctgcaggttgtacactcacctgtctacctggactctaatttccatatttccagccacttgaggactgagaggtggatgataaaccctgtcatagtggagcaagttcaggtgtttaaccgctgttatgggggatctgccttttctccctcttctttcttacttccataagtatgtatgtgcagagattgaaaaataaccttgagagagtccatccatctaactccagttcattggaaatttctgcttctttgagactgaggtatattccacttcttctgactacaccaccaccatcaatctccttctctgaactcttggatcattacttcaacctgaaacaactcatcatgcataatagttgcctactgccccaaccctaccaaatgttccagcacctttgatattacctcacatggcaagagggcttttgaagatgtgattgagtcaagtgatcttgaattggggagattatcctgaatttattcaccttggacccagtgttaatcacaaaaggttttttacaagatgtgaagataggctttaagaagccagaaaagtgatattgtgacaatgggattcagttgtcagaagttgggagttgactttgatgttgatgaaggaatttaaaccttgcttggtttctgggccttttaagggattgaaagttaaattgggtcccattgaagcctcaaggcacataccacggtgtgcgcttcttttttcaagtaaatttttgtatacagatgggttaattcattttttgctaaatttcaggggtttttgaattttttgggctatgtagggcaattggggcttcatggatgggacctcttgtgactttt

SEQ ID NO: 671764 - DNA, 271 bp, Homo sapiens
  misc_feature (221)..(221): n is a, c, g, or t
  misc_feature (229)..(229): n is a, c, g, or t
  misc_feature (256)..(256): n is a, c, g, or t
  misc_feature (259)..(259): n is a, c, g, or t
ttttttcctggccaaagtgatggggttccacccatggggaagcaacccaatcctttgtttccttgctccaatggaggcaaaaaagcccaggacccaagctttttggcaggggtgctgtgaatgtccagtggtcccagctcccccccctggccctgccccagcctgtgtagcttttcctgcatgtggatgctgcatgtttggtttggggcttggatgttgcnctgccccnctgcctgtcccttttggtaaaataaanaanttttaatgccca

SEQ ID NO: 671765 - DNA, 280 bp, Homo sapiens
tactgtagcttatcttttccagaatgtcagatacatggaatcatgcagttatcttttttgtctgggttcttcttcttttttttttttaaaaacagaatctcacttggtggcccaggcgggagtacaagggcatgatctcagctcacggcaacctccgcctcccaggttcaagcgattctccgtctcagtctcccgagtagcggggattacagggtgcccgccatcacgccgggctaattttggtattttgggtagagacggggtttcgcacatgtgggtc

SEQ ID NO: 671766 - DNA, 539 bp, Homo sapiens
aacaaggcgtaatgtggaacagcagatactaccacccctacacctacagccatctattgctcctggtatctccagctagccctcctgggagtcttgagcctaaggcagcatggcttcaccctatgcgtagagagagtggtcgccccatcaatgcccccacgcaaagacttgcctgactctcagcaacaacaccagagctctaaaaaaggaaagctttcagaacagttacaacatagcaatggcatttatgaaggagttactctctacgaagcatgctgcctatgcttggcctttctatacaccagtggatgcttctgcacttggactgcatgactaccatgacatcattcagcaccccatggacctcagcacatgtcaagcggaagatggagaaccgtgattacctgtggatgcacaggagtattgctgctgatgtacggcttatgtactccaactgctataagtacaatcccccagatcacgatgtcgtggcaatggcacgaaagctaccaggatgtatttgagatccgttatgccaa

SEQ ID NO: 671767 - DNA, 235 bp, Homo sapiens
ttgactcgtgaagcatagattagtgagttttaatgtctttgttactaatcagaaataatcagtgaaatttagtatggcatctggagccttcatgattgggggtcagtgtgctacgtatcccactggacagtccttgcattgacatactggcacaccgaataggactgcatcttgagttatgaatgcccaaaaaactgcccaatctttaacgtctagagatgagttacctgcttga

SEQ ID NO: 671768 - DNA, 973 bp, Homo sapiens
ggttattactcaattcaaagaaaagaaagggctaataaaacttaaacttcaagtcaaaaaaaaaaaaaaaaaaaaaaaaaaaaaaaaaaaaaaaataaaaaaaaaaaagaaaaaaaaaaaaaaaaaaaaaaaaaaacataatatagcagatacctatatttgatagaaaaatatgagcagagctcaaacgctaaagacccccgtaaaccagaccgagctaccgtacgaacagctaaaagagcgacacccgtctatgtagcaaaaacgtgggcagatctataggtagaggcgacaaaacctactcgagcctggtgatagctggctgaccacgatcgaacttcttcacgttcaaacctccaatttgccccacaaaaacccctctcaaatccccccttggtaaactcgcacctgtcagccccacagacgaacagcctcctaccggacactccgaacccaaccccttgtccaccagagtcaacaaacttccacccccccattagctcggcctaacaagcaggcacctaccttatccacaagcgttcactctcaaccacccgactacctcaaatatcacaacactattcactcgcactcctcaaaccaaattggaccacctactccccttaccaacgactactgtcgcctcctccccccaccaacactcacccccgaactaacctcgctcccgtcctaccctccctgcccctcacgccccctctctccaacaaccagcacctccatcaccctcctttcaccctcaacaccggaccccgcaccacacccccccgccccgccctccacacgactagcaaagagcccacacccactcctaacccacccccccaaccccatctgacccacccctctcctgccccacccccccgccatccccccccgcatctcccctgccccccggctctcgacctccgccgcgcaccccccccccgctcctcccgatacactcccccacccc

SEQ ID NO: 671769 - DNA, 454 bp, Homo sapiens
tttaaataatattgggcatacaacagtttggactcatcacaatgaggtcgggtgtgggattatccacttggggcattatactggtgctcaaaaagtttcaaattttggagcattttagatttaggattttcagattagggatgctcaccagtaagtgttatgaaaatattccaaactccggctgggcatggtggtgcccacctgtaatccccagcattttgggaggccaaggcaggtggatcacctgaggtcaggagttcccaaccagcctggctaacatggtgaaaacccatctccactaaatacaaaaaaattagccaggggtggtggtgcattcctgtaatccgagctacctgggaggctgaaacaggagaatcgcttgtacccgggacagcaggttgcagtgagcagagatggcatcattgcactccagcctgagtgacagcactgcact

SEQ ID NO: 671770 - DNA, 146 bp, Homo sapiens
taccatcttctgctcttacacctagtaggtgtctcctctatcttaggggccatcaatttcatcacgacaattatcaatataaaaccccgctgtcataactcaataccagacgcccctcttcgtctgatccgtcctaatttacagcg

SEQ ID NO: 671771 - DNA, 805 bp, Homo sapiens
acttatttggattctatggtgtttgtttcttagttagtatgtgcatgttttctttgctagtaccggttccccgtgggtattctgcgctctgggtagtattccgtgcgagatgtgtcatcttgctgttgtcacggaagtgttcaccgcagttatgatagtggcttgttgaatgtggacgtgatgaaggcagagcgatgtgtctgtttcgcggtgtgatcttcgtatgacagtcggaatgtgctgtggcagacgacggtgaggtgtgcggtctcgtacactgcgttttctgaagaaagtgtctgcgctgttagagtgaatggtgcgctctgaggtatctggcttggggcagcttaggagagcgctgctcgcgtgcttggtggatggcaggatgtgtgcgagattacgtgggggtgctacgtgtttctgggtgatagtcgaaggatgcctgtgtctgtcgttgccggtggctcgtgatcggtatcgcctgggtgtacacgtcggcctctattgtcgtgacggttcatgcaggaccgcagagatgagttggttggtctgcatggtggagctgtcaggggcgtttggtcgatggtagtctggtatccgcctgtgacggagttgtgttgtctgactcctaccttgctgctgcgagacgtcgtaggctctgaaagaataagaatcgggaaatagacgcgtcggtccacaacgtgctattagcacacactgagtctatacagaacgtcaaggacctactctcaacgcgagatcagcccttaaacaatggatcgcaaccaaagagcaacagaaa

SEQ ID NO: 671772 - DNA, 434 bp, Homo sapiens
cctgttagacgataatattacagaagtgtacgttacgctaagtgatgagtagtcccgctaaaagacatttatgtttttataaagatggtagttatggttatcaggaggatataatctattatcttaaattaggctaagaccccggccttcaggccggggatacagccgtaatttaacctcatgctccattttttggcctccttttccctaacagactcccataactaccataaagcacatctagctctagctagactatatgaacgtgtcagtaaccagagacatgactggcagcacaagatcactcgaaagctggtagacgaaagccaagctatctgcatagaggatcttcgtagctccttcatgttccataaccgcagacttggtaaagcctcagaactagagaaggagatactctagaggattaagtagcc

SEQ ID NO: 671773 - DNA, 369 bp, Homo sapiens
  misc_feature (1)..(1): n is a, c, g, or t
  misc_feature (45)..(45): n is a, c, g, or t
  misc_feature (231)..(231): n is a, c, g, or t
  misc_feature (312)..(312): n is a, c, g, or t
  misc_feature (355)..(355): n is a, c, g, or t
ngtgacagagtctcaccctgtcagcgggctggagtgcggtggagntcttggctcattgcaacctcccactcctgggttcaagcaattctcatgcctcagcctcccgagtagctaggattacaggcatgtaccaccacacccaactaatttttgtatttttagtaaagatggggtttcaccatgttagccagggatggtcttgatctcctgacctcatgatctgcccgcctncaacctcccaaagtgctggggtacattttaatatctggtagtgttcaggaactccagataacttcccctgccctgctcttntttttacacaagttttccaaatattcttgtgtgttcatttttnaacaccaccttaca

SEQ ID NO: 671774 - DNA, 467 bp, Homo sapiens
tggttatataacaaaaaatggtggcatagatgatgtgttccttctacccctccctctttcccatttgcacgttattgaactatttcccttaattctcctataagctggtggaagatacagacagaatggccagactctacacttccactgacatttaaaggtcaagtctccttgtatcataaataatgatatctcccttccacacgtagggaaaggataactgaaaattacctaaggtcagagggggagggaacctttgaaagttcacctggcaaaaggacttgatttactgcaattttgctgaacactttagctgagatagctcgtttcatgaagagttgaaggaagttaacatcaaaggatgaattcatccagctattgtttttcacctctgttgttaattgattttaatttggttaccctctcaataaataaagacttctaaaactgggtcaatgacataaaaa

SEQ ID NO: 671775 - DNA, 295 bp, Homo sapiens
tcggccaggtctctccgtcctgctgtaaagcgtctgtggtatatgaaacacgtctcacatatttcttatattgcattcattagtgaaaagagaaactatacgactcataagtaggacacattccagtatatctgtccaaggcagcaacaagctcgttcgtgtttaaggcactaaaatcagaattctgcatataaacatggctcatattcgaaattgctctatagtcattagaagccagagaactgctaagtctcctgcaatgtttttctgctttttgccttccccatatatatgg

SEQ ID NO: 671776 - DNA, 178 bp, Homo sapiens
tctagagcatcccccgtgactgacccaatcaactcacaatgagaaatcaccggccaggcgtggtgactcacgtctgtaatcccagcactttgggagggcaaggcaagagcttgagcttgagcctagacgtttgagaccagcttggtcaacacagcaagaccctgtttctttaaaaaaa

SEQ ID NO: 671777 - DNA, 223 bp, Homo sapiens
gagtgcttacgtgagaagagggcacaaattatcctgtgctaggcgggtggaccctatcttctcggtagtgagtggatggatcacgtcttagagtgatagaaacccgtagaatgactgagattatcgacgcacatatgaatgcatacagtcaggccactctccttacatagatgaactttaggaggtcgtgacaaggatcgcacaaagtgacgcatattcatgt

SEQ ID NO: 671778 - DNA, 1382 bp, Homo sapiens
  misc_feature (1136)..(1136): n is a, c, g, or t
ggccgacgggagccggggcggggctggctggtccagctgaaggagcgcgcgggctggtctggccccgccccctcctccgtcccgccttcccgtgtgaccttcagagggcccgggtggctgggcgcatgtgcccctgcggctgtgcggcgggatgttcgtgcatggaggagaagatcttcgctgggcaatggtgctgctgtgtctgcactaatctgcgcggtccgactggcgccgaagttgtgcttggtatggaggcctacctgatggacatccctcggtgtgacgtaagtctcagatggacggcgctagcttcaatgcacctgtctgtctcactgcgcgaggcttcagacatgagtccccaatatagctactaatgcccaatcactaataattacatcccatctgcttgtctctcaggatgacgggctgcctgcagctgcatgccccagtgaccattacctgtgcatagtcagccaacacttccagtgacccataggcatgctaccatatttactttgcagtacaccatagaccatgtcgttggctcttcattccaacccaggctttaccacaatgcattgcgccctgaacgttttgtttcctttctcagggctgtgtcggactactcgcatctcatcacctggctctctcctccagcagcgctaccgctgggcatccaactgtagaccatgctgctttccccgtacggaagtttaccgagctctcgagcggggccctacgttaatgcctttcggctggtgtgtccctacctcccttgtgcgcttagtcgcctttagcgccgcttctctctttttatactcaagcgatgttcgcgatcccctcggtgcgcccccttgtgcggtggtttccccatctggtagagctctctaacaatcgccatgtttagacggcgaaggatacccttttttacctcctactgcgaaatcctgtctggaccttgctgcttttctcgctggctggtaccatcggaacattaagccttttagtgcggatttggccttccgtttcgtttcctcgtgtttctcgcgacgcgggcgtttgggtccgctctggcctcctggcgatatggcgtccctgcgcttatatggcgggtacctctggtattactgtcctgncaagtgctatatttggtccgggggcttggcggcaatatgccttttgggtattttgtagttccgtgaaatattgcatggctcctagcgatccttagtgcactgcatgctttgtgctcttgtggaactgtcggacagtggggattccgcatgtgcgtacctttgcatcctgcccggtttgtattggcgatctcgcattctgtggggtcattggaggccccgcttgttgtgagtgcatcatgctgtctc

SEQ ID NO: 671779 - DNA, 223 bp, Homo sapiens
catagaggccacggaggcaaaccttctttcacccccggttcagccgagtgaaggccaacatatctcaaaaggaatttggctggaaaatgaagagaaggcaacacatagacccggggaaatggaaagacaccgtaagcagaagcgtaaggagcctcagagatttttctcatcctatgtaccttcttcccttcagactggctccggtggcgctctatgatggggt

SEQ ID NO: 671780 - DNA, 218 bp, Homo sapiens
  misc_feature (218)..(218): n is a, c, g, or t
tccgtaacgacgcatcccctatgttcagacaggattacacgtgtccgcctactcaagtcgacaatttcactttcgcatacggggctgtcacccgctatggccgatctttccaacatcgttctgctaattcacttgtcggcactggcctggtccgcgttcgctcgccactactaacggaatctcggttggcgctcgttacggaggatccgagctcgaan

SEQ ID NO: 671781 - DNA, 169 bp, Homo sapiens
gtcacagtaacactttattacagagctgattgtttgttcctaaaatttttcagggaccctagaggagagcttttatacaattaccgatgtgaatttctctaaagtgtatattgtggtgtccagttatattatttaaaaaagggttactttgtaaaaatggtatataaag

SEQ ID NO: 671782 - DNA, 1009 bp, Homo sapiens
ggccgacttgagtgaactcagctcagagttctaacggaccagcattctgggggccatgttctctacaggcaaatggaatgcttttccataagcatccagaatgtaatgtggttgctcgcgtgaacggaggaggctacgccatgcgaggtcctgacggtacccatggaggtgatgcgtacttctgcatgcagtctacagggcatctgacaccgtaacatgagacgtggcgatgtgagatgatgacttggcagtgtgagacatagggtcactagagacccttctgggtcagaggagagagactgaataggactaaaccgcgtcctcgtgttcccagcacgtaatctcatatagccctcagtcactagagggagtcccccgcaggattggcgaggcacattcccttgggacagaggctacaggtcggagcttacataacccctgcacacaaacagcgccaatccaaacagaccacctgaacaaaaaaactcgggaaacacacaccaaacgagccccacacaaagcaaacaacaccaacgccaagaccacgagcaccacacaccagtggtgatcaaaacgaggaaaaggaagaaggaaaaacccgcgcaacacaacgacacggacaccaacacactggaaaaaccaaccaaggagaatggaaacagagaaacagaaaagaaatcatgaccacaacacagcgaaccaaggagaaagaaacaccaacaaacaagaacagcacacaaaaccaacaacaaggaaccaaaaaggaaagcaaaaaacagcagaacaaggactacagacacacaaccgccacaacagcacgtggcaccacgccaccaccgcagcaaccaagaaccacaaccccacaaacaccactggaccaacacaaaactgaaacaaacaacaccaccaatcagcaacgaaaagacaagacacatacagtaacacgcacgcacaaccaagagagacaaaccacccacaaaagaaaacagcataagaacaaccgcccaac

SEQ ID NO: 671783 - DNA, 883 bp, Homo sapiens
ggaagcctagcagaggactttttagctgctcactggccccgttgttggccgactcatccgcccggaaccctaatcccctctgcctgccccaagatgctgaagccagcctggcccacaccgatcctccctttgtgcctcagctgctgtggggcttggagtagccgcggacgcccgagatgaccacacggatgggtggcgtccaaagatggagctaacacgcgctatcttacggggcgggagccccggtgtggccaccggttcacctcgcaattccccggccaaaacgcctcttcagggtacccagggcccaggtgggttgccatcgtttgattcggtggggccgggtaaaaccttgactggaccgacagactctacgggggtgcatccccaatggtcctaaaaggcgtctggcccttaaaagccctgggctcctggtcaggaccgcggcctggcgggtgctaaaagaaccggtttaccgccgaacagaacatgggaagccactaaaccctggagctaagtgggcgcgaacaccgcgccaggcgatggagcggggagaaagcagtgagagcgtaagagcctgcgccacgggggataaaacccaggaaaattcgggttaccaacacaaccacacaacgcacacacggcgcccgcccaaccaacataccgccacaagaacaccctgtcaatcgcacgccacccacccagaaccacatcaacactagaggtggcgggagcccacatcgaagggagtccagactggcccacgaagcggcgaaagagtggtgcgataccaacatcagcggcacgcgactcaacacggcggggcgcaggacaaagcgcaggtaaataccgcgtgagagacacacgcacgcgcacgggtgag

SEQ ID NO: 671784 - DNA, 164 bp, Homo sapiens
agaggttccaagtatgcacagggtcaaaaccagaagcaatatttggcttatttgggcttcagccattccagtccagtatgggttacattctttaagggagtgtaatcctattcagcaggaatctaatttctagacacccagcaaacccattcctatcagggggg

SEQ ID NO: 671785 - DNA, 472 bp, Homo sapiens
ctgtatgtgtctccctctctctcggtctcgtgtatgtgtctttctctcctctttccgtccgtcgtctctccctgtctctcatctctctctcctctttcctcagtctcgctcctctctctttccaaaaaaaaaaaaataataaactacataccagggctcaaagaaatcagagatgacacagacaaatgaaaaacattccaggatcatggatagggaagaatcaataacaagaaaatgaccatgctggcaggtaaatttacagattcagggcttttcccattaagctaccatggatattcttcacagaactagaaaaaacagttttaaaattcatatggaaccgaaagggagccggaataaatagccagggcaatccttagcacagaaatgggtaaacctatagacaaatcgggacaactggatggtgtaaaacagcataccaaacacacaagaatcaattacggttctagaa

SEQ ID NO: 671786 - DNA, 342 bp, Homo sapiens
ccaagttctgatgataactgctgcatcacagttgcacaaaggctgatgagttgtcactgttcatcatgacatctgctcggcatttgtcaacttcggcacgttttactgtgatcatcgccttctgtatctcagatacgttatttactacaaacacatcatggagtcgcttgacgagctgcgttgctgcatgaccctcatctcttaaatccttgaacacagcttctagtttgtccaaagcagcactctgataggcagcaaatactccatcaattttctcagctggtattacccctggtatgtctgtaatcactttctctgtgatctcctttccagctgttaatc

SEQ ID NO: 671787 - DNA, 613 bp, Homo sapiens
gaaaaaaaaaaaaatgccccaacttaaattacttaccgtattggcccaccattaatttacccccaattacttcctttacacttatttccttcatcacccaacttaaaatttttaaacacaaacttaccaccttagccttcccttcaccaaagccccaaaaaaaaaaaaaaaaaaaaaacaaaaaaaaaagtgtgtgtgtggcgcgcgcgcgcgcgcgcgcgcccgctcggagaaaagcgttttatatgatagacacacctctcgcgtgtgtgggcgcggcgcggcgagaccacacagagggtgaaaaggagaacaactagtgggcacaaaagggtgtgtgtcctcacaggaaagaaaactccgcgggcaacagagacaacaaggcggcgggggagattctccaccacaaaataaaaaaaacacgcccgcgggggggtgaaaaaaccgcgagaggtttttctttgtaaacaatactctcgacaagtggagagaatctcggagagaggaaacaatataagggggggaatcttattataaagcgaggggagatctctcacagagggagaactccgctaaaaatactaaaatttacccccccaatgacggtgtggca

SEQ ID NO: 671788 - DNA, 206 bp, Homo sapiens
cccgcgtcgctgcatttattgcaggtgggtgcactggcgggagggcaggtccggcggcaggtcacactgcctcgtcggtcaccgggatggggttgacctgggacctcccgggtccccccgccgcaccgcagcctcctccatgctgggcttctatgcggcggccgggggccgcggcggggggttgctgggcggctgcttgatggtgc

SEQ ID NO: 671789 - DNA, 522 bp, Homo sapiens
gactagcacgtgtcatcactgctatcgatcataaccagcgtagtaatacaagcatatctagtgctgattataatataatatcgtaatacatatagtagtttgtagggtaaatacccacaacaacagtagtttcttacttagacaagagaatgcttatttaagtcgttagacttccattctggcaaaatcttgccttatcagaagacattggaatagagggataccctttggtgttcggtcttctacttagaaaaacctatagcagttagtaaatcttgtagtattcatctttgtatactgaagatacggttggaattacattgatacacacagaggggaaccgatttgttttatccaatgtgaattataaatgagataatccactgttattcattgtggagttgttgagactattaaagactcattgtctttgtattccgctcttttatagtgtaactttatccccacctctgcttgctttctttccctcccctccagtgatgagacgtagaagggggtacc

SEQ ID NO: 671790 - DNA, 108 bp, Homo sapiens
atccgaatgctgaagcagtaggatcagttgagttcggaagggcggagactgcagtgagctgagattgtactgctgcgctccagcctgtgtgacagagcgagaccctat

SEQ ID NO: 671791 - DNA, 701 bp, Homo sapiens
gcagcgtgccccatctttgttttcacccgcttccagcgcccacctgctatcgtcctagcaacgactgtcccccgagctgcgccccccaactgtgggtgtgagcacccattaatgttatgtaattaagaaggggtccgtggcttttaccaaacattgtatcggttgatacgttgggcgcgttaagttagtgtgggcccacccgggcatccgcggggtcccataattgtgcagagtgtggcgtcgtccatgcgttgaatcgtctgcctacgtagaagatgcaggagaaggccattttgtaacgcacaatatattattggtcactcacactgatgttcctcactaagaaagtattgtcttttttaacaccgacactagattcgtctctcctgatagccatttgtgtgtccaattatttaaggatatttccgtcgtctctctagtgaatacacaaccgtacgcgcatttcctccagcggtctctagtcttacttcccccccacacaggacattttgtctaaggagaagatatgttcccttccacgcggggtaatagcccccctcgagagtgcggcaagagtttctctcacagggttatgtgtcttttcgaaggttgcgccgcacttgtttgcactatgctgtcggactccacattcgctctcaggtgatcttgttgagtcccgccccaccaatgtcgcaagaagt

SEQ ID NO: 671792 - DNA, 109 bp, Homo sapiens
  misc_feature (92)..(92): n is a, c, g, or t
gcacccccatttgttagcacaggccccggtgaaccactctgagcgagggtcgtaatcggcttcgaggctagcctccaccggatctggaccancctgcgggcagacctgg

SEQ ID NO: 671793 - DNA, 177 bp, Homo sapiens
cttccttcatagccaggtaactggttagcacacactcctttgatagacacaactcctctctcttctgcttgaagttgtagcttgatgtgagggtcgctcttctcccggaccccgtcaactcggccgtcgggatggatgcgcaggaagaagcccccgtttttgcagtacagccggaga

SEQ ID NO: 671794 - DNA, 979 bp, Homo sapiens
tccccccaaggggggggttttttaaaaaaaaaaaaaaaagggggggcgggtcccccgccccaaagaggggggggggggggggggggggggtgtttcttggggggtgctcacaagtttgtgcctcccccctcctagaggggggtgttcccgcggtggggcgcccgccgtgtgcgtgccgcgtcttcttggttcgttcttctatggactaccccccccccccccggttgtcgttcttctctcctctcctgacgccgcgcggtggttcgtagaagagcgtctcttcttcctggcgcagcctctccccttctttcgtcccgccgtgtctgccgagtcccctctctctgcgcgggcgagttcgctgcggcgggctgtgtgagacagaaaaaagatcggtgtgagtccccgcgtctgtcggagtcgcgggtgagtcctttctctctccgcgcggcgtgcgaaccagaaagcgtctgtctctctctctgcagcgacgagccctcaccacgccagccgcgccctctcgcccgactgcctcccccaccggccggtgtattggccacgacccgacctcccgttgttgtccaccccccccccgcgacacttggttgggggagtcgctcccccctcgtcgggcggcgcgctcgtctcactcccgtgagtgaagggagagcttaccaccgagagcgctacgctgtgtgcgctaccgagcgacgccctcccctccgaaaaaggaaacagtcccgcacgagaagattacctctctctctcctctctctcgcaggagaacaaatccccaaccaccccccgagcgttatgtgtgtgggtctcccccgcacggggggctcccccaaactagaggttcgtagaacgccgccgacggggggacccccccctcccgcgcagatgtaacctccccccgcttcagcaagagaaccccaccacaacccacagggggtggcgggctgcctctccgctccacccc

SEQ ID NO: 671795 - DNA, 1010 bp, Homo sapiens
gcagcgagacgggaccctctagctgcaggtcaccacgcccgggtcaagagcatcccatcgtggctgtattgcgcctcgactcctggtagggcctgccatgggctagcagggatccacgacttgtgctgctgaccacttcatttggctctctacaactgccatggtgcaccagcggatgctgtgtacctggactcggtaagaggagcgtgtaggagtatgttcctcagccatggagggcgtgttctcctaacagggtgtcggtccacggttcatgtctaagaacagtaccttggaaattattgggtgagttggaatgaatgggagtccctagagcactctgcctgagtacctcttctagactgtcaagcctcaaggttgcctgaagaacggtgcgggcgtctgtgacgtgtctcccgacgcgaatgagccgcgtgtctacgttgggttcgggagggtgagtgggcatggtcaactgcaacgatgaccagggtgtgcttgctgtggacgctggtgacaacaactacggggacggccgtcagccccatgtgcttggatcggcaagcgtggagatcctgcggagctggaagaaccacggctgcagtcgcgtcaagtatgggcagtgctgggtcttcgacgcgtggctgcacagtgcgtgaggtgctggcatcctacccgcggtggacaactacaaatcgccccaggacaggaacaagacaagcttctcatcgaggtacttccgcgaagaagttgggcagatcatgttggcaagagcggagatgcgtgctgggagatccactggtggtggaaccgtagagaacacgcacgcccgggccggggtataaggatggaggacgtgccaagcccccagagacaggaaggcgtcagagtgaacatcgcgaggccaggggaggtgacaacagtatcacagagcagaggacaaacaggaacgacaacaaggaagcgaacaacagccagaaaaagaaagcgcagggaacaacaagagagaagac

SEQ ID NO: 671796 - DNA, 1182 bp, Homo sapiens
agcggagtcattctccgatcagcgcgtgaacgcagctcggcttgccgcgtgtgcaggaaacaattctgcagaaaataatcatactcagacctgcgcgattgtctgcccctaggtctgtcgctcagccgccgtccacactcgctgcagggtggggggtgcacagacatttcaccgcgggagagaacatccctcccaggccagcagattacaatgctgcaagactataggatctcaaatctcggacattcaagttgtatctcactgggaaacttggccagttgtctcctagcgcagtgtttggcatcattagttccgcaagacgcatgggggcacgatctagacgttaggaagagtcacaaatatctctcttttagttgacacaagagggtgcggcaaagcggcaagtaagtggcgcgacaaaagcaattacaccaggaaccagttcatccgtgggagtatcatcgccccacaaatgtgggcaggcacacaaaaggcgttcacaacacccgcgaaaaaaacacgaggacgacgccagggaagatcctacaaagaggagggaccttcatggggcacaacgtggcagtggcatatgctcgccgttccgcgttccacagagcgccggcgttccaaacaccgagatggctatatagtatacaaagcgtggcccgacaagacgaaactcacaggaaagactggaacaaggcccccggcggcacacgttcatcatcacccacgaggcgtggataggcaatcgggggtttatcacaccaagggaggcccgcagaaaagggggaaacatatgagggaagaccggacattaggaacggacttcccaacgaggaagggagacaccaaaccagccggaagacagaaacaagacaagacgatagtgtacgacaagagaacgatccagtaccgaacgacagaggaacaacggagcagaaccacacagtggagatctgacccaaccaggtaaaaacatgtggcgcggcgcaccgaaaacacacgccgcgcgcgaaacgcaagggaggcaaagagagtctatacagcagaggagaaggacaacgaacacacggggagagcacacaaacgagccagatggacccccaggagaggggacacaactaagggagatgggacagtagcaagtggcaagattgcgatcgtaggagacatcacgag

SEQ ID NO: 671797 - DNA, 483 bp, Homo sapiens
  misc_feature (5)..(5): n is a, c, g, or t
  misc_feature (80)..(80): n is a, c, g, or t
ccttnctagtcaatcatcctaaaggaatggttgggtccactttaccctttcagccctcaaacaattagcctaatttagtntcaaagattgcatcccatctctaaaattccagtaaattttcctaatcttggggctacattgctaccacaaaagccttggtgaatagatattatcttccaggcattaagaataccaggttggctgagtacagtggctcatgtctgtaaccccagcactttgggaggctgaggtgggtgaatctcttgaactcaggagttcaagaccagcctaggcaacatggggagaccctgtctctacaaaaaatacaaaataattagctaggcttggtggcatgtgcctgtagtctcagctactcgggatgctgaggagagaagatcacttgagccgaggaggttgaggcagcagtgagccgtgactgtgacactggacttcagcctgggtgacagagccagaccctgtctc

SEQ ID NO: 671798 - DNA, 123 bp, Homo sapiens
tacattcatctgtgtccgcagtgcaggaacgcggggcagacacctggggaggctgcaggtgggatctgccggggcgggattctgacttagaggcgttcagtcataaccccacagagagagcgt

SEQ ID NO: 671799 - DNA, 158 bp, Homo sapiens
gtccttggctcagtcttcaccaccgtgctcgccatgacctctgagtccagcggccacccgagttccgccgctgcggtccccaccaggtgggtcccgacgcgacaggcgatggtctggcttttgatccgcggcaggcgcgagccctcttccccagccag

SEQ ID NO: 671800 - DNA, 354 bp, Homo sapiens
cacgaggagctttttgacagcaactctcgcccagtgcctgtcttataaccatacagtacctgtgatactcctccccctctcaacaatcttaccccttacagggacgatggaaaagaggcatgtcatcttctacatagacccttcacacttctttgatctttggaaggagaagatgctgcaggacagtattgatatcatgattgatatgagatagcataagaattgaaagtgagataatccaaatcgagggaatgtaaacccacgtaaactcaagacacgttcggaagagtgggagaaactgaatatggggtaagaatttgtggagtccagagaaaagctggggacgtctgggta

SEQ ID NO: 671801 - DNA, 175 bp, Homo sapiens
atggtggtcgtctgacggtccggaagacgaggaggccgggcgacgggctggattggctgtcccgaagctcaagggggtacgctggggctctcagaatggaggtaatgtccctgcgtcccaccactcggccctcagcacccattcccctcctatggctgtccacctcctctgtgct

SEQ ID NO: 671802 - DNA, 189 bp, Homo sapiens
acgacgcggagagtccggcgtcccgcagccaggccgggtgaggctggcgggcggggcgatcaaggtcagccagcgggcgtcctgatcttcgctcaattcgcacaggataggtgccagcaggttcaggcagctctcagccgcaccgcgcaacgacaattcactgaacgcctcaggttcgccgccccaggt

SEQ ID NO: 671803 - DNA, 151 bp, Homo sapiens
attccgagcttggcctttccgtatgagatagagtagggttgtggtgctggagtttatgttgagtagtaggaatgcggtagtagttaggagtaatataaatagttaaattaagaatggctatgttagggtcatacggaaagaaccatgctac

SEQ ID NO: 671804 - DNA, 343 bp, Homo sapiens
  misc_feature (64)..(64): n is a, c, g, or t
aaaaagtgcgatatgcctttgacacaggggcagggcactctgccttaaaaaggcacctcaggcncgggcgcagtggctcacgcctgtaatcccggcactttgggaggccgaggcgggcggatcacaaggtcagaagatcgagaccatcctggctaacacggtgaaaccccgtctctactaaaactacaaaaaattagctgggcgtggtggcgggcgcctgtagtcccagctactcaggaggctgaggcaggagaatggcctgaacccaggaggtggaggttgcagtgagccgaaatcacgccactgcactccagcctgggcgacagagcaagactccatctca

SEQ ID NO: 671805 - DNA, 252 bp, Homo sapiens
atccctcattaacttagagcaaatcattctctcaaaatactagcaaactgaatccagcatcatataaaaaaaggttattttattaactactccatagggttgctgtgataagcgagttagtatgtgcactgggtgctgcacatagcatgtgttccattattgttcatttcttcttcctgttttctcatgaatggatttgccaggatgttctatgttcaccattatccggattctctcttttatgtatagttt

SEQ ID NO: 671806 - DNA, 198 bp, Homo sapiens
gaatcagacaccaaaataacagctaataccaaggatgaaccacaccacacaaaccatcaaaggagcacagcagtcaagccatcatccaagccacccaaccaactagccagctcccaagagattctcctacccagcccactactgggtccttctgcccaggaactgttactctcagatctgacttggagagtcattcaa

SEQ ID NO: 671807 - DNA, 194 bp, Homo sapiens
gccgctcattaaaggtcagtttgttcaacgacttaaagctcctatatgcatctgagttcaaaccggcaataatccaggtcggtttctgtctacttcaaattcctccctgtacgacaggaccagagaaataaggcctacttcacaaagcgccttcccccgataaagtgatatcactctcgttctcattctcttgt

SEQ ID NO: 671808 - DNA, 366 bp, Homo sapiens
  misc_feature (52)..(52): n is a, c, g, or t
  misc_feature (132)..(132): n is a, c, g, or t
  misc_feature (135)..(135): n is a, c, g, or t
agttgcttcaagggccctttttattttattttaaaaaaagcagtttttggantgagcccagcatgagttccccccagccccagttgggtgaacttttaggcccagtggggcaaactttttcctccccactgntgntgggggaatggggttggtaacgtcctgtcctgcccctgtcctccacaggcatttttgggttcctggcctttggctttgtgctcattaccttcaggtgccccttttacgattttttcaaccaggctgagtgggagggcagcttccgggatttttttctgtgagttaggggcatggaggcggcagtgttgggagctggagccaaggccataaaaacccccatgctccccccga

SEQ ID NO: 671809 - DNA, 1241 bp, Homo sapiens
  misc_feature (35)..(35): n is a, c, g, or t
  misc_feature (255)..(255): n is a, c, g, or t
  misc_feature (261)..(261): n is a, c, g, or t
  misc_feature (267)..(267): n is a, c, g, or t
  misc_feature (300)..(301): n is a, c, g, or t
  misc_feature (350)..(350): n is a, c, g, or t
  misc_feature (361)..(361): n is a, c, g, or t
  misc_feature (386)..(386): n is a, c, g, or t
  misc_feature (400)..(400): n is a, c, g, or t
  misc_feature (412)..(412): n is a, c, g, or t
  misc_feature (416)..(416): n is a, c, g, or t
  misc_feature (442)..(442): n is a, c, g, or t
  misc_feature (447)..(447): n is a, c, g, or t
  misc_feature (467)..(467): n is a, c, g, or t
  misc_feature (475)..(475): n is a, c, g, or t
  misc_feature (502)..(502): n is a, c, g, or t
  misc_feature (522)..(522): n is a, c, g, or t
  misc_feature (526)..(526): n is a, c, g, or t
  misc_feature (528)..(528): n is a, c, g, or t
  misc_feature (532)..(532): n is a, c, g, or t
  misc_feature (544)..(544): n is a, c, g, or t
  misc_feature (547)..(547): n is a, c, g, or t
  misc_feature (557)..(557): n is a, c, g, or t
  misc_feature (562)..(562): n is a, c, g, or t
  misc_feature (574)..(574): n is a, c, g, or t
  misc_feature (658)..(658): n is a, c, g, or t
  misc_feature (807)..(807): n is a, c, g, or t
  misc_feature (993)..(995): n is a, c, g, or t
  misc_feature (1002)..(1003): n is a, c, g, or t
ccaagaggagagctgctattcacagagggggcacnttgggaccaccaagagctctagggtggcagaggggtcctctcaacagcagagaggccgtgttcccgtggatctcggggcaatcggtggggcaatgtaggaggcaagagaaaggcagatgggtacaaccagcctgatatccaagcgtcgtcagaccaacaaccaacagaactgggttcccaacccatcgctcagcagccgcttcagcaaggtggtgactantctggnaactanggttacaataatgacaaccaggaattttttttnnatacttatgggcaacagtggaagtagacaagtaagggcttgaaaatganactggcaaganacgatggctctagatctacattctncaaaaaaaaaaatnggcttaactgtntcanctttaagtagcatttggctgccattngtatngggctgaagaaatcactatngtgtatanactcaagtctttttatttttcctcttntcataaatgctcttggacantatngngctngcagagttcccntantctggggatnacaangcctttaccgtntcaggcttcattttagcttcaaaacaagctgggcacactgttaaatcatgatttggcagaacccttggtttcggacagtttcanttttttggatttgggatagattacataggagtatggagtatgctgtaaataaaaatacaagctagtgctttgtcttagtagttttaagaaattaaagcaaacaaatttaagttttcttgtattgaaaataacctatgattgtatgtttngcattcctagaagtaggttaactgtgtttttaaattgttataacttcacacctttttgaaatctgcctacaaaatttgttgtggttaaacgtcaaaagccgtgacaattgtgtgcttggatgtgatggtattccaatttctggtccatgtagattcaataaaacttaaaaatctattcaaaacctnnnaacaaanngggagaagaaagcgacgaagaacagagacgagggaagcgacagaaacagagagagagagagagggggacgaagagagagggaggaccgagtgcaggatcagccagagggacgagcgcaagcagcaaggggatgcacagaggacagggggaagaggacacgagagagagcaacaagcgcagcacgaccgagtgcgagcgacgagacatagagaaggaaaagagaggctgcgcggagcgt

SEQ ID NO: 671810 - DNA, 991 bp, Homo sapiens
  misc_feature (408)..(408): n is a, c, g, or t
  misc_feature (557)..(557): n is a, c, g, or t
  misc_feature (743)..(745): n is a, c, g, or t
  misc_feature (752)..(753): n is a, c, g, or t
gcagctaagtaagactttggctcaagattccaccagtgtttacacgtcatgtcccttattgtgtcccaggatcctgggatgttcaggacaccacggtggtatgtagctagtttgcctccttagatctcaatgtcatgttagtgatatctgatgtgtgtgctcatctgtcactgtgtccacgggatttattgtgtgaaaagcagtcatcaattcatccatccactctcctatcgcatggtacatttaggctgtgtgtcaatatttggcgattagaaaatgctgccagtggtacagggagaataacaaatgcttaaatcgatatacaggaccttcattttagcttcaaaacaagctgggcacactgttaaatcatgatttggcagaacccttggtttcggacagtttcanttttttggatttgggatagattacataggagtatggagtatgctgtaaataaaaatacaagctagtgctttgtcttagtagttttaagaaattaaagcaaacaaatttaagttttcttgtattgaaaataacctatgattgtatgtttngcattcctagaagtaggttaactgtgtttttaaattgttataacttcacacctttttgaaatctgcctacaaaatttgttgtggttaaacgtcaaaagccgtgacaattgtgtgcttggatgtgatggtattccaatttctggtccatgtagattcaataaaacttaaaaatctattcaaaacctnnnaacaaanngggagaagaaagcgacgaagaacagagacgagggaagcgacagaaacagagagagagagagagggggacgaagagagagggaggaccgagtgcaggatcagccagagggacgagcgcaagcagcaaggggatgcacagaggacagggggaagaggacacgagagagagcaacaagcgcagcacgaccgagtgcgagcgacgagacatagagaaggaaaagagaggctgcgcggagcgt

SEQ ID NO: 671811 - DNA, 234 bp, Homo sapiens
gaagaggggatgtgtctatgcggccgcatgattaaaatttacggagtaaggcataaatgttttggtcaagtgttgcggctgaaatagctaggtcttgtgttacagtccatcaccaagcccatgatgccggatacaataaaattgatttcaatcgtatcggggctattgttggggtaaagtagcttcgagcgcgacaagcttttttgcattaagggcgactttcgattagctgga

SEQ ID NO: 671812 - DNA, 141 bp, Homo sapiens
  misc_feature (17)..(18): n is a, c, g, or t
  misc_feature (63)..(63): n is a, c, g, or t
acattttaaatattggnncctatttgcttataaaaaatgtctctcctaacttaggtattttantttattttattttattttattttattttattttattcattttttgagactccatctcaaaaaaaaaacacctaccaca

SEQ ID NO: 671813 - DNA, 150 bp, Homo sapiens
ggattggaacccagtgtgtatctcgcatgtggaatgtcagcagtgatagtccacgtgggaagtgaagacccgaaggctcaaggtgacacaggtggctgacagtggtcaaaggctagtggggcaggattcaggcagaggagctctagtggg

SEQ ID NO: 671814 - DNA, 180 bp, Homo sapiens
tttgctgaggatggtgttacatccaaatatgtacatgcctttagattacatgccatattgcgatgggaagaacgtatgtactgctgtttctgagtcgagagctctgcagaggtatatcacatccatttgctccaatgtggaggtcagctcccgagcatctatgtcaatcttctgcctcaa

SEQ ID NO: 671815 - DNA, 122 bp, Homo sapiens
  misc_feature (14)..(14): n is a, c, g, or t
actctagaggaccncatccccggttctgggtagtaaaaattttgagatatattgagtatagaatatcatatctgtgcatattcaaatctaaatagtgaataagttggttgagtatgtgctct

SEQ ID NO: 671816 - DNA, 209 bp, Homo sapiens
ggtccctggtgcctgcacagtgatatggagtgcgcactcatgatatgtatttacacatacatggttcaatggatgatactggctcttcacttgtgtaataactggtaaatgtgtgtcgttagccatatctcactttagatggattgcatctggtcatgttgaagtgtttcaacgttttaaagcagtacataatgtcttatcatgcgcta

SEQ ID NO: 671817 - DNA, 814 bp, Homo sapiens
tttgaagaaggaaagtggtttttcaccacacatagtctgggcgatctaggccaggcacaatgctcacatctgtaatcctagcactttgggaggccgaggtgggtggatcgcttgagcccaagagtttgagaccagcctgggcaacatggtgaaaccccgtctctgaaaaaagaaatacaaaataatttgcccggtgtggtggccacatacgtgtagtcccagctactcaggaagctgaggtgggaggatctcttgagcccaggaggccgaggtccacagtgagctgtgattgcaccactgcactccagtctgggtgacaagagtgagaccccatctcaaaaataaaaaaaaaagaagcgatactcggggaaactcctgcccaatggaggttcgtcatatgttattcaataaaggtgtccctatttataacggacccgtttgggtaatcataaggttatatccctttttaacccaaagggctctttatgaggggcagagcccagtgttggggtgcggccgggacccgatcttcgagaatcccaaaagcacggttgtctccgttcattttaagaccccttagttcaggcagtatatgagccggaacagcatttaggggcacctttgaccattcttgccttggggtgtgggcactcgttggctcacttctccatgtcgcatttagtgtctcatataaacaatttcctggggaactggtctatttacagcccaaaaaaatttcttgcgaatgccggcgacacacaccgtctgaacaacagggttttttccacgcaacggtgtttcaaaatgtcccgat

SEQ ID NO: 671818 - DNA, 1166 bp, Homo sapiens
  misc_feature (384)..(384): n is a, c, g, or t
gtggcacagaggcggcggagagatggccttcagcggttcccagtgctccctacctgagttccagtctgtctcctctttactggtgattattcaaggaggtcatccaggacggacgttcatgatcagcgtgatcgacattggtgaccgtactcagactccaggtggaagcctagtgctttgcgtgtgaacttttcaggacctggctactagttgcgaaaatgactagtagtccattcgcatcttcgaatcgccatcgagtttgaaagaatggaagggtactgtggatgttgctagactacagagtgcagaatacggaatgcttgggaggcaccgagggagaggcaagatacaacaatgtcctgtaccaagtacaggggcatgccnctttgaccatcttgcgttcctgtgatgcaatgcagcgtcaggatgatcaataggttgagtggatgtagagcgcggatccatcattcgctgcgagatacattcctaccggtcgatggaccacttttcccagccagggaggtagagatcgaactcagttactctcgtgcaattggctcttgtagtcaagcctgttccgaaactaatgcatgttctttaacacacgaccatacgcgcgggacgtcgtggaccttgtccaaagcccacggacttccccaagtataacctcggataaccatggttcgagttccgaggcacaggtgaacagaaagacggccccgcctgtgtgcatgaggattgtttacctgcgtcaacttcacccgggaaccaatactctgcgaacgcatattgtgagtagcatgacccacagcccaatggcatcgtgaccttattccgcggaaattgcatcctttatcaaaatgcacaccccaagcccacatgtaacttgtgcgaaggtgagacaaataggttggatcacaatagtcaccaagagggtttccaaagtcgccgatctcaatggaatcaaggtgtgaatccaggggccccattggacgcggaaggctggccgtcaaggaaggggtttccctagccaatcaaagaacattggttgacatcctaggagagaaaaccacgagaaagatgtcgaaacaatgtacaccaatccagttggaatagcacacacggaattatgtggacattggacgaacaatagcgtcgggtttaga

SEQ ID NO: 671819 - DNA, 126 bp, Homo sapiens
ggggctgtggtgtacccagccctgacatgtctccagcagaacagctcaaacagatggctgcacagcagcaccaaagggccaaactcatgcagcagaagcagcaacaggaacagaagcagcagcagc

SEQ ID NO: 671820 - DNA, 465 bp, Homo sapiens
gccagggtattgaattctccctggttttatagactccgctgctttagaaggaagattttttcctctcccaaaaaaggctggagaaagtttgcgccccccttttcccccagttgtcccaaagtgcaggaggcattccaggaggaaagcctgggggtttttctggggggggagctcccccctttgggggggtttccccagggccccccctttaaagggtttatttaccccccccagggtaaatggagcctttttcccccccttttaaacattttaaggccccaaatttggagccaatttttgggccgtttttaaaagttaagctgctaaagtaagtttttgggccttttccaaactttaatttgggacaaatgccccggggaaggaaataacctttccctttttaaacccttttttttaagtggaaaaaccaatttttttaataaaaattttttaaattggccccca

SEQ ID NO: 671821 - DNA, 2073 bp, Homo sapiens
ggctttgtctcaccgtatgcgtttggttggtatgtatccattctctctgtgtgggagtttgtcacatgctgcgtacagtgtgtgttccgcttgtgatccattctggtggtggcccacctcatcgtgtgtgagctgacagaagctcattgagacccccacaagggtggtgttgtgtgggttgcgcccgcttgttcttccccgtcgctttattagtggtgtctgttgttgtctcgccctcgtccgtgcgctctggttattgggtgcctgctggccgcgaccatgagtggttggtttgttgtaaattgttgttcacgtggggggcgtctcgcccgtgttgttaacgagaacttttgtgtgtgtgtctcccttgatgcgcagatggtgtgcctccttcgctggattgttgtcgttctcctcccctcgggtccagctgggttattaggtgcgacgttgcctcccctcggttggtgtcaacaggagtggatgtatattggcgcgctagaggtaaaaaggtgagttggcgcctttggtgaggttggtgggtacgctcaaaacacagtctgtgtagcaaagcgcggccgctataagttgtgggaggaccatagatgttctagagggtacctactttgagtgtgtggacgcaccaaccactgtggtgcgccccgtacgttgtcctgcctcgcaccgaatgtaaatgatgcggttgggtggggcgagttttttctgtgtggtgtgagcgtcatctctttacatctacacatctaaccgggggggtctacaccataatagggcctctgtgatcatatcattcgtcgccgctttatagattctcgtccgtcgtacgtagaagcattaatgttgttttaatttatgagccgcattcgctccacaggacggttgcttcatcctcgggcctcccggagttatttagtaacgatcagttcgtcatagtgcccagcatgggcgcaacaccaacattatcttcgtggtgtgcttcctctctaccatcaccggcaggtgttcgtcggaggaaaagaacgtcccgtcgccgtctctgtttggggacgagaggagatgtgcacaacgaggagtggtgcacggcggtccgctgcttttactaccccacgtataatagatgaggatgttataatgataatgacgcgccaccgacggtcgggactcccacctccgccggcggtgagcccaatgttgagcaacacccggtgtggtgataatactctactgcggcgctgcgcgacgaggtggtggtgctattattttatacttctaactatgttgtcggccaccgctcaagtagtacgtgctcgtattacggacgaccccacacccactatttattattcgttgtggtgaagacatcataatagaaggggcggcttcatatagcagagtgtgtgcgcgggtaacaccacgtcgagagagcatcgatctgctcttgtggagagcgcgctcgacacaaacaaaggccccatcattggttttatacacccaacagctgtttcacagtgggtcgtcattgcgacatgtatatgatagatatatgagggtgtgtctgtctctgtgctgtgtcttcacctcgtctctcacagccctcgtgggtgcacagtcgcgagcacgagacactcctctgtgtcacacggtacacagagtgtcgtcgcgattactttgtgtagggtgggttgagacatctgtgtactctctgtctatgcgctttgtcgcgcctctcttagactcactctctctagacgtcaccactcaccctgcgtgaatctaactatatgttttgtgaggatcacacaatgtgtgacacttctacacgtatgtgtggggggaggtagatatgtgtgagatacaccaagtgagatgggagactctagttctcatacattattgtatatatgtctgtagatagaatatatacacaagcgccaacgagagtgtgtataaccaataataatatgagcgtgcgcggtggacaatatgtatctcacacgcgtctatcttctgtattggagccaatctgtcccaacagtctttctaagtaatgtttta

SEQ ID NO: 671822 - DNA, 932 bp, Homo sapiens
acatattgcatagctggttggtggagaatacataacagtttgccgttgtgtcacctgtcttaagctccctgtgtcccccaaagttgctgtcgtaagaggggacgcggacaacggtgagagaaccccggtgagaacaaattgcgcggattttttccgtcggttcatttgcctggggttcggttcgccaccatttggcttttaatcgcgcgtgtttgagcttttaccattggtcactgatacaggcgcctgtgttggtatgccccgcgcccccgaaggacttggtggccccgccccgcctatatggaattttgagttcccccctcggggcccgccggtggtcgggaaaccaacgttggccctgccccaggaagacaaatagcccggccccaccgaagcggctggcccccccccctgttcgatatgtgggtgacacaaattggggtcgccaaatgtacaacgactctcttttaaagaaagaatgtgttggagacacaccaggcaagttggtccgggcatagaaattcccacaccattgagtgacaccccccgataatgagcccccaaagtggaggacgcccccttatttctggggaccccaacataagatatctagtccccggcgccacatagagtggacaattaatggcgcgcaaccaccacagtagccattccaagcaacttgtccaactggaacgtaggacccagttgaacacggactcgagtaacgactgacatggacaaacaaacgaacaaatacaggggcgaggatctgagcaccagtaaccgaccatggtggcaggaggcatagtggtggcgcaaccccaaaaaacacccggacacctcttcgggcaaggccacaaggcccgctgggaacaacggatgttgggcccgcccccgcccccaagcacacccatccctcgccccacaagaca

SEQ ID NO: 671823 - DNA, 620 bp, Homo sapiens
tagttctagatcgcgagcggccgccctcaaacctaaaaaaaaaaaaaaaaaaaaaaaaaaaaaaaaaaaaaaaaaaaaaaaaaaaaaaaaaaaaaaaaaaaaagggggcggcgcgcgcgcttatcaaaattctctctctcctcaacggggcacccaatattccgccgccgacccagcgtatttatgtttgtaacaaggggtgcccctcaataagagggaggttgttattattataagccgaatggagcgcggcgggcccgcgattgttatataagaaagagagagctgtgaaagaggggagataacaagggcgtgcgacaccactctgggagcgaactctcttgtggaggagaagggaacacctcctcatttctgtgcggggggaggaccacaaatagtgtgcggagaaacacctcactatctataaggagacatatgtatataagagggcctctacagggggagcaaattatatataaaaacttcttcaacaggcgtgtatatataagtggggcgcgtcaaaaccacaaacgcgcggcaattatgtagcgcgcgtggcgaggcggaagagacacaacgtttgcgcgcgcctccgcgggcggagatattgatgtcatctt

SEQ ID NO: 671824 - DNA, 1004 bp, Homo sapiens
  misc_feature (450)..(450): n is a, c, g, or t
agcgtggaggttcgggctccgttggccgagggggccgtacggacggtgcgcagctgtgggagagaggcgtgctgtggatagagccgagtgagctcatagtcccgggatccaatccctctacgattccgaggccgatgacccgtgaccctgcagacgctacctgggaagctgaaaccaggtcgggatgggctccagtcgtgagcccggaaatcgggcaacttgtgatggtagctccacctggaagacgtgagatctagagatgtttccggtcgttcatgaggtgactgtggatgcctgtagcgtatccacagtgcttacccttgaatgggaatcgcacttttggctatatacagcacggtgcaagacgatgagttgaggactcgttcattagcttagatctagggttagcggcttactggcattagtaagacccactctatccctccaagncgactcatcacgcattgtgtcgaatccatgcgcatggggaagctcagtgactcattggctcaaggcgctgcactgtgtactcgtccaagcacgcgacgtggaaagggcattgatcttctcgcacccattatgtgtggaattggcctagagagtagattgctccgggggtggggttttctcactggtgcaaccattgtaattggggggtacttgatttgtacatttgcacccactagtaatttcgcgtataacatctactagggtaaatcaacccaattgtaacaatgactttgtgtaaggggctagaagttttggcaccgaggaagcaccgtctcctttccaattcattttcaccagcatgtggttccaatctttgcgcttgaaccttgtgcaaacgttagcagtcgccgttagaattgggaggttgcgctccgcccaaaagggggttccttaacccctatataggacggaccaaattcctagggaagcaatttggcgtgcttctggtggctaccccagaggggcggggagaatccccgggggagggcacactc

SEQ ID NO: 671825 - DNA, 127 bp, Homo sapiens
tctacacggatccccctcagaggttactagagaacacggtggttttaagggttatcttagatgttacacactcggaaggtttttaaacactaaagatatagtatttatagattaagagctaaaaagt

SEQ ID NO: 671826 - DNA, 759 bp, Homo sapiens
gctcagcactcctgagctgcacactctaactcaggcttatggcattgttttctggcccttcaaggtaaagcatctactgtgctggaggggctgagatgttcccagttggctggcaacaatactccaatggtggctggaggggccatgggagagtgtgttgtagttaacggctgcaggtgagtatgcattggtggggaagcagggtggggccatgcaccccctgaccttgagcttccaccaggcactgagtacaaggcaggtataatgatggaggcatctgggacccaaatgttgagttctgattctatcaataacagattactcaaactgagcttccatttcctcatctgtgaaatagaggcaataatacttattctatagggagttcatggggatttgaagtattgtgcacagaaattcatgacattctattttcccttggctaaaaatttcagtggaaagagtggctaaaatcgttctggcatgtaagttaccttaagtgataccatgtactgataaaacctaaaccttgatttcactttcaaacagaataatttcctggtcggatcgtctacatctatgagcatttttcttaggagaagcagaaagctataacaggacgtcaactttatcagaaatccacctttgtacaacctcccatcccctcctgctctggaaagtgaaggcatactgggaagagggttggttgtaccagtgtcatcactggcccaacattgaaagcactgtgcccgatatctg

SEQ ID NO: 671827 - DNA, 487 bp, Homo sapiens
cgtgcggctgaatgcaaatggcaccgtacagactgcctaggtgcccaagcccgatgctgcagcaggatacgcacagctctgtcaccatcacaccccagagaagacccacaggagccgtggaggtccaagtccctagaggacccggtggtggccctaagtgggcaccgatgtcaccctgcgctagctccttactcccccgagcctgagattcagcctggcacagctcaacctcatactggcagactgacagacaccaaacagctggtgcacagtttcagcgaaggccgggaccagggcatgctgcctatgccaaccggcaggtccctctacccggacctgcatggcacaaaggcaatgcaatccctgaggctgcagcgcgttgcgtgtggctggacgagggcagctttagctggtcgtgagcatccgggatttacaggcagctgctgcggtcaagctgcaggtgtgccgaccctactcgaaaccagca

SEQ ID NO: 671828 - DNA, 166 bp, Homo sapiens
atcctgatggcgctgattcacctgcatgtgagatcaccgtgtctcctctgcggcgaacgcaacgcgcgacgaagcgcagcatccggttgcgctgcctctatggcgcgccgcttgcggcgctccctgaagatctctatattccgccgcaggctttgcgcctattgct

SEQ ID NO: 671829 - DNA, 127 bp, Homo sapiens
  misc_feature (39)..(39): n is a, c, g, or t
agcaacgtgatgctgccctggtagatgttgatagctgtncacgcggttggcactgagggctgtcttggtcagcgtctcaatcacgtggtcactctgcagcaccacatctcccttttactcattgtct

SEQ ID NO: 671830 - DNA, 226 bp, Homo sapiens
aatacccacgatcacgccacagagaactccctcctacaaatggggagactgaggaccgagttaatgagggtgctggcaggcgtatcagagcacattagtgatgcccttcaccccagggaggtgtctgttcccaactagtttatgttgcactgagacatccatccctgaccaaggatgctgcgaaacaggatcaatgtactacggccgtctaattctacatagtcgc

SEQ ID NO: 671831 - DNA, 348 bp, Homo sapiens
agcatcgcgatagatccacactctggatggaacaccgtgttgccggtgcttggcaggacacttgtccatggcctcgaccgggatcggctgaatcgcgatccactccggcgttgcgttcttggtcggtgcgcttttggttgtcgctgaacctgcggaaacgctgagcagatccgccagttttttgcacgcctcaacgtccgtaccgccgtcgatgtagcgcactagatcgatcaggtcgccgcccttatcgccagtggcaaaatccgcccaggtgcctttgctcaaattcaccttgagtgagcctgcgcgtttgtccgtgcgcgtcgggtttggtagtctcacggaagc

SEQ ID NO: 671832 - DNA, 221 bp, Homo sapiens
taccccaagaggagataactagaaataagatttacaaacaaaacataaaaaatcacttgactatttcagactgatacaggaaacaccgttaagtctgtcagtagaattcagagcactgaaatgggtgaaattggggtatgtggtttgatggatacacagttacctctcagtatctggtgtcactgagaagctatacaatggatgcttgtgaaacaagtatc

SEQ ID NO: 671833 - DNA, 158 bp, Homo sapiens
tacaagatggccgaggttagtaaatatgtgagcgtgcttcttgagaattatttatagtctgcgagttgaatgggagagcgcaggtagaacacatctgaaggtggatgggtgtatctcccagaactggaccgggttgctgaaaaggggtaccgaggctc

SEQ ID NO: 671834 - DNA, 376 bp, Homo sapiens
tctccctactgtatcctactttatttacatctttcattattctggaaatatgggggatataataagaatgaatgaatacccaaatcagggactggattcattagttctttttccatttctttttttttttttttttttggggaaaaaagatcccttttgcccccccacttggggggaggaggcgcattttggttttatcgaaccccccccccccggggtcaagggttttccccccccccaccccttaggggggggggaatacaagggcccccccccccccccggccttttttttttttttttgggaagagggggtttccccctttttgtgaaggcggccttgggcccccaacctggggaacccccttcctggggcc

SEQ ID NO: 671835 - DNA, 852 bp, Homo sapiens
tgtcatgaagcatgggtttattgctgacaatcaaatgaatcatgcctgtatgctgtttgtagaaaataatggacagaaactaattaagaagaatttatgtcgaaagcttcatgcttcatctagtcagcatgcatgacttgaatcttattagacataatgtcaatagatagagagctgttgaccatagactccgtgaaatgcagcaagacataattcaacgaattcagggggaatctgcttcccctgcgaaacgaagaagataactgaagaacaacatgggacagcaaatggatttagtgaatattatactcaaagaaagagaacacgctttggaaagcagatagtgtctcaggggtttcaaaacagagacacaaaacaaaaactctgaaaagctctaagcgcccatgttatggacaaacactgaaattacatttgagggaattcatcctctaagaattatgttatcggtgatttaatcatatgttgccaaacaggcactgttagatgaagtaaactgatttcgaacaaggatatttgtatcagggttgctacttcaccttcattatgcagcattacatgtatatcactgtttattgatgtcattaaaacattctgtactttaagcatggaaaagcaatattgtcaaagtatttttaacattcaagaaaatgtagtcaaatatgttgaattgatctagaaattatttcatatataattcagaattttttgcatttatgaacggtgtttctacttggtatggtggagacatttctgggagggacatggactggtcctttttaaaattgaagtggcttcaattcatacgaaggacaatgaaatggggttctgatt

SEQ ID NO: 671836 - DNA, 240 bp, Homo sapiens
atttcactccattcgttcccattccattcaattccattccattcaattccattccatttgtttccattctcttcgattccatttctttatattccatgccattcgattccattctattggattgcattacattcgtgttcattccattccagaccattccatttgactccattcctttcgagccctttcaatttgagtccattcttttccagtccatttcactccagtccatgtcgacgc

SEQ ID NO: 671837 - DNA, 641 bp, Homo sapiens
  misc_feature (188)..(188): n is a, c, g, or t
ctaaatgtgcaatagcattatgtctaacaaatatacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaaaacagtattcacaaagncatagtagaagtgagggtatgccgtgttatgtggctctttttcgtgacaggtggtgtgatataaaccactctctaagaaagtgtttctaccggtaaagatttccccagtacagtcagcctctcgtggtaactggtggtctccacattttagatccaaccagcctgggataggaaatattggaaaaaagaaatgggcatgggtactgaacacgtacagaccgtttttttctggccattattccctaaacaatatggtgtagcatatttacatagcattttatatggtaatgggtattataagaaatctagagatgatttaacattatacaggacaggtgtcgcgtcaggttaacgttgcaaacggctatgccattggcccatcagggacctggagcatcctcagatgtcgggagtctgagggttgacggttgcagtccgggaaccatcccccag

SEQ ID NO: 671838 - DNA, 1068 bp, Homo sapiens
  misc_feature (146)..(146): n is a, c, g, or t
  misc_feature (270)..(270): n is a, c, g, or t
  misc_feature (288)..(288): n is a, c, g, or t
ggccggcagtccccccgaagccgacccggaggagcatccaaggggccccgtgcacctgactgccagcggccgggaaatgaagccgtgagagagtgctcgtgggaggccgtgggactccggggctgccagagctagtagaggcaccnggcatgcagggggccccatgtacaacacggaccaacatgagacaactaggaggccgaaggactgtcctagcttgcgcctcaaaataggagccatgaaaaaaattcagacgcaagcgaatgtggncttccgtggggaaccagncactagagtgcatgatatgtcattccagtatcctatctctcgcgcatccttcgcaacagaccaacgcttaatccggggaccgtacagacatatcgaatgacagattccaggccgctgccgtgtcgcggagaaaggaggtagcgttggacgaaaggagccgctggatagggtcgtcaagagaccaggagacgagcggcatggaggacagggacggacaggaggcggcatgggcgtgaggagtcgccagtgcaggcgaaggcccgaagagagcgcaacggagcgaagtgtgcgcatgcgaagccgagagggcccgagggggagggcctccaaatggacgcgggagagcctgcagtcagagccagtcacttgggaagaccacgcccagtcatgcctaagctaagacgaccctagggaagccaaaaacgagggcgaaggacgaggccgaggcaaaaacaagggcatagtcccaagacctggcgggggtgtggcctgacgccggcacgaaagcgagtacacccaacaagggtctctcagtgagggcattccacacaggtgccaccgcgacggttctcaaattgactgtggggaaccccaagggctaaggaacgaggggcaaggtatgagggccccgtgggacaacggccgggggaagaccaaggagaaggccggcacaggaacaggccgcggggggacaaggcccatgtggggacaaaggcattacgccaaatttggacgcggtggaaagttatacacacagaaggttgaatcatagatgaggta

SEQ ID NO: 671839 - DNA, 1290 bp, Homo sapiens
  misc_feature (1290)..(1290): n is a, c, g, or t
taaacctttccttatgagcatgccggggtggggttgacagtggagggtaataatggactggtgggttggattggtagattatggggctggttaatggtcagttcagtggtttaaatctggacgcaggcttatgcggaggagaatggtttcatgttacttatactaaccattagtttcttctatagggtggataagattgggtccaattggggtggtggagagagttcagttatattgttggggatttttaagggtagggggttgttggagcttgaaggcttatcttaagtgggggggcgtgcttttagaggccatactagtggggtggttacaattttaaacctctctcttacaggggtttttcccataggtgctccaaagaagcgtggtcccctcttgggaactacacgagttaacatttaccagggggcattcagacgggtccggggggcgcaaattcaacgcttgaaccataaagatccctatctggggacaacccaaggctattcaccaggctcgcgccaggttgggaccgccctctaccttaataaactcgtcccacacagaaataacacggaccccactaagaaaggggggagatgaccacacgaaaagcacgggccataaagcgacacccacagccacaggagaacacgggcgggaccaaacagacctagggggattcctaccaccggacaacacgacaaaccaacaagccaccaccaccacacgactgcgccaccaagcggacaatacgagggggggcgaaggcccccctgtcgcaagagaatacgtgcgccggggcaaatacatagtctcaacactgatcgaccgctgcggcggaaagcaacaactagaaatagcagcccaggatacacaacaaacccaagcacgcccaaataacctaccacggggggaaaacgggtcagagccaaagaggacggcgaggagaaacaaacggcgcgacagatgagaaattggcgcgaaccgagactcagccaaagaacgatcacgccctcgaccggacacagaccccaagagtgaaactgtgcgaccagatgacaaggtggaaagcacacgtcaaccccgccgaagagccccaggagggcacgcggcccgccacagaacaccacccagaccgggtacatccacgcgaaacggcctacaagcgatgcaaagaaagtagtccacggagcgcacgctaccgcaccccctaccacgacgcagccgacatacacagtcgagagagtaacaaaccgtggatagcacacctcaccccccatcttcggn

SEQ ID NO: 671840 - DNA, 1227 bp, Homo sapiens
gataattgactgcctctacaacggaagttatcttgtctctcaaattctagataacgaggagatctatcccttctatggtggatggttatgaaaccgaggtcacgagaaagcgtgtggttgtacttggtatagaacggagtgacaagcgagaagtagtggttgtccaatttagctggatcagtggcatgggaatgtcgtgcgttatcatcatggtgagatgtcaggtaatgatgaccagttatcaagtgtgtggctcagaatgttagtgggtaggaataatctaaacctcattgcagcccattaggtcagtagaggtagacaggctacatggtggcacaggattctgctagtccaggatacatactttagaaggctcagctctttaggctcgatccgtaattatccaccaaaagatgatgcaacacgttgaagctgtgtatatgactgacaagcagagtgttgcagcctgaatggtaccaatgcctattattcccatggtgctgctaaatggtgctgaaggaatcggtcactgggttggtacctgcaaaatccccaagcttgtgaatgtggggtgaaattggtaaataagcagtcagggcgctttgcatgggagtggcagtaaagaaacctgtgtgccagatggtttccgaaagattacacaaagcaagtttcaaggcgtactaatatgacataaacctggattacgaaagtcaataatgtgaaaacagatgggttgaaagtcagacgtaataccttaacatatcatagcaaaaggcaaaatgggaaaaatagtacaaacacgcataatacccggtcacggaaaaacatggaaccccagcaacatccgtaatcacacaaggttactcagcaacccccaatgatagaaaatgggcaaccctgagagaatgaagcacctctcctgtcaatacaagtcaaaccaacgcaccgctagtaaagggacgcctaacgcccacaaaacgggatatacacgaggcctaggaggaaacacactgggaaggcagacacacgaccgcactgacgaagcacacaaaccctgggccagaaagggcacacaccaaaaacgagtaggggcaaacacaccagcaacacaggaacagtccagacacacacacgaagaggaaacaacactatcgcaacgtgccaccgccagaagtagggcgcatcatgaggacaacggcatatagacagggttcagacgagaagctt

SEQ ID NO: 671841 - DNA, 501 bp, Homo sapiens
gggtgttctagaggatccctgatatgcgtctcaaaaaaaagaaaaagaaaaaagaaatacgtactcacggagtaagaggcagtgtgctttaaagcctataaaacatgcctgtgggcacaagctggtttggtgggatatataacttctgtgactacactttcatcagtgtgtggtttgggaggttttttctgagacagggtctggctctgtttcccaggctagagtgcagtggtgcaatcatagcttctgttaccttgaacttctgttaccttgaactcccatgtcagccctccgagtagctggaactacaggcacacaccaccatgcctggctaactttggtatgttgggtagagatggggcttcgccatgctgcccaggctggtcttgaagtcctgacctcaaagcgatcggcgcacctcagccttgcaaagtgctgggattacaggcatgaaccaccacgcccagctcatgagtacgtatttcagtgcactcaaatgac

SEQ ID NO: 671842 - DNA, 107 bp, Homo sapiens
tcagtctatcagcagctcctgcttagcttcaagtgctccctccgctgcgttcagctcatcatctttatagcagaaaactgagcacagggatggaagtgacttgcctg

SEQ ID NO: 671843 - DNA, 1383 bp, Homo sapiens
  misc_feature (403)..(403): n is a, c, g, or t
  misc_feature (1163)..(1163): n is a, c, g, or t
tggaagtacacaggatcacggaagcatatatgcctagaactggacattgagattgagcagcgatgaagagaggagcgtatcaacccgagacttcatccaggaatggacggaagaggaggtaccaatcgcgagctagggctcgtggtgaagagagcgactcagtcggcaatcgtgtaacagcccgcagtgttgtgtcagtcacctgtataaaggggcatcgtcgagaggtttagactcagccatcgtagcgcttatgacggggaccagataatgctacgaggtcacatcaccgagcagtagttaccggcatagggaactagacatcggaatataaggcggcatttcggcttaagtagaatcctaggtgcgaggtggcccggaaaataaggattgcagtgcgcgnagccgagagagatatagctcgaacgaaacgcacatgaattgtactagattatgtgggcacaacgaggggaaagagcatgagtgcgtaggttctcgtgtagaggatttccaaagggcaaagaaactattgtgcaggagtagcagagttagcgtgtgtgaaacttttcccagctgcgaaacgtggcaagcgttagtccaaaaaggggagctcctcgggggaaaggcacactatagtcaattcggcacaatctccgtcacagtgcgccagggtgtgggccgcttgggagctcaccagaggcaggcaatttcagtcgtccgggcaccaggattaggaaaaggggccaaaaccttgtccctgaggggtcattggtcgcccagtgacatagagagggctggtttggtttcagcataagaggtgggatagagcccttcccccacttggtggaatcaaccacccttcctaatgacgttttgcgagttagcccccaaaagatggcgacagtattatagtgaggccgagacgcaccctttccgcacggaatcgtgaaaatgtggagcgaatacggtttcggaggctcggccaaatttggcacccgttgttggtacccgacatgaaaaggaaaaaaatatcccccaaaaataggggcgcgccaaattggaaccctttagggggtatcgatatgggcaaaaacacaacaatattgggcggcccaaatttagtcgaagggggggcgccctcgggtgtggccccaaccaaaggnggactcaccccttcacagaaaggggtgttgcagttgtccccccttaccggttatatccccccgttgtgattttcccaacgacaatacgttggcttggtcgtgggggcaccacaggtcaagctgcaaaggtccccgggttcattaatcgttttaagagacgttccccgccatattacggggggagcccaaaagggcgaacaaaccccgcacagggggaagg

SEQ ID NO: 671844 - DNA, 158 bp, Homo sapiens
  misc_feature (158)..(158): n is a, c, g, or t
cagtgaagcgacacatacgcatgatcatactgacacgacagtacctaggatacgcgatctttcagagtctatcacataggtgacactcatttgatcgacatccatgtgcgcaaagaagaacattcaacagaagtacactatctgtgacgggaacggtn

SEQ ID NO: 671845 - DNA, 426 bp, Homo sapiens
accccgggctgcaggaattcggcacgagagatatctattattaggctagatgtatagactctactcccccagatttttgctcttgaccctgcactgtgagtggcccttctattaacagccaaggaaaagggaaacatgagcttatacacaacggtggcagagtctccttggcaatcaaccaacggtgcgtatgaaatatgcctcacactgtgtagctcattattagacggcagggttggtgagaaaaagtgggccagacatgattaatgaatcagaatcctgtttcattggtgacttggataaagactttttaattttaactttggtctaagacaggttggcatgaattcaaattagttatataattgcatctcaataaagaggtgagattttactaggtttccacgtgcacatactgacttacgg

SEQ ID NO: 671846 - DNA, 450 bp, Homo sapiens
cctgggggcgttcgacattcacccatcaacatccggtgaggggacagtgtttatgatcccggcttaaaaccactgaccatctcttatgacccagccacctgcctccacgtctggaataatgggtactctttcctcgtggaatttgaagattctacagataaatcagctgcacttagtgcattggaacgcagtcaaatttgaaaactttgaggatgcagcactggaagaaaatggtttggctgtgataggagtatttttaacggaaacttctcagtctcccttgaagaagtgaagcctccttctttatgcactggccactgtctaatacctcccagcaatactcagaggagactacctgctggaacctcactagaattgagagatcaaatggttttggctgttttcccactggagattataaaaaatccacagttaattttaaaaaaaaaa

SEQ ID NO: 671847 - DNA, 470 bp, Homo sapiens
ggtggagcacgttgtggctggatgctggggctttcctgcggctatgcggtctctgcaggacatcgcgagaagaacatttacaccatccgggaggtggtcactgacattcgggacaaggccactacgcaggctggctcgctgtcctgaccctacgagcatgctggttcaaggagtcccttaccaggaatactgtgctggctggtgacgtgagttgtacacacagaagaacagggagacgtaccccacgcctcgtctgccacggacatcctaagtgcgttgtactcacatagccagtttggaagcagacgtccgttaggcggtgtctcaccgtaaaacagagatccacagagaggttaagtgtgagtctcatcggattcagagacccgagaagacacgctctgcacgatttctgagtttcccatctgccctacacagcctaaaccacccacaagcagacagacaagaggaca

SEQ ID NO: 671848 - DNA, 382 bp, Homo sapiens
  misc_feature (15)..(15): n is a, c, g, or t
  misc_feature (33)..(33): n is a, c, g, or t
  misc_feature (70)..(70): n is a, c, g, or t
  misc_feature (112)..(112): n is a, c, g, or t
  misc_feature (120)..(120): n is a, c, g, or t
  misc_feature (133)..(133): n is a, c, g, or t
  misc_feature (184)..(184): n is a, c, g, or t
  misc_feature (236)..(236): n is a, c, g, or t
  misc_feature (246)..(246): n is a, c, g, or t
  misc_feature (274)..(274): n is a, c, g, or t
  misc_feature (356)..(356): n is a, c, g, or t
aatgcacattatagnaggccacatatattattntggcaactgtcccagtacacagggttcctcatttgtnacaatccaaatggccacatctgatagctgttccttccagacntttcattncttcagctccagnaacaactgagcagtaataagtgtcaaggtctaaatagaggagagcaggttncccttttcatcagcaccagaacaacaaatgaagtatcatccaatagcatagnaactgagacnaaacatagtatatgaagaagaaccagtntgaacatcaaatcttctacagtatgcaatcaacagcctggtacaataatgctccaaaacccaatattgaaacaggcatgagnacacactcattactgagaaatagatc

SEQ ID NO: 671849 - DNA, 654 bp, Homo sapiens
atcagctgccagcacagctagaatatagcaggcagaagaaggtggcaggagcagacttgagtgagtcttcatggccttcgtcttcctttcgtgctggagcttcctgccctcgaacatcagactccaagttcttcaggttttgaactcattggacattacaccagcggcttgccagcatggtctcaggccttcaactacagactgaaggataccctgttggcttccctacttttgcggatttggggactcagactggcttccttgctcctcagtttgcagattggccgtatcgtgggacttcacgcttgtgatcatgacatctccaatgaacttcgttcactgaagtcttaaacccctcacagtgacccatgaggattggaatcagcttcttgcaaactcttactattgtgatatgaggatcgcgttcctatgaatcgtgaatattatgaatgacatctaaaatgtgactcctggcacgggcacagatggttcacgcctataatcccagcaccttggtaggtcaaggcgagaggatcatttgaggttagaagttagagagcaaccttgagcaaaatggtgaaaacctgtctctactagaaatagtaaaaattagctgggcgtggtggagaatggcctgtaatgtgagctatatgg

SEQ ID NO: 671850 - DNA, 273 bp, Homo sapiens
tctgtggtgatctacaggatcctctgcaacggttggcaagaccggtcaagtttttacgtgaatgggctgacacttgtggggccagacaatgttcggtgatccggtgcactcactagctgcagtgatgggtgcatttatgcatgtgatcttcgtaccaatgagcacctggtggggccccctaccttcaattgtcacgtgtcaccaatgacttgacaatgacgctagtcctagctgactgggcaaaagaacggtgtccacagagtggtatttgat

SEQ ID NO: 671851 - DNA, 135 bp, Homo sapiens
aatcaaatccctaccttagaaggcgatctccagagaaaattggtcaggcagatcttctactgatgattagggttaaattggagattaaagtaatccaaagatagggaaaaattccccatttttaattgacagtag

SEQ ID NO: 671852 - DNA, 329 bp, Homo sapiens
  misc_feature (58)..(58): n is a, c, g, or t
  misc_feature (107)..(107): n is a, c, g, or t
  misc_feature (111)..(111): n is a, c, g, or t
  misc_feature (183)..(183): n is a, c, g, or t
  misc_feature (225)..(225): n is a, c, g, or t
tttggaaaaagccctttttaaagggggaaactgttaattaaaaacaagctgttcaccnaaatatgttagcccctgtcaaatgacatttacaaaagtttgaagaaaanaaanttgggaaagttaataattcgcctttcctatccttcaaggattcaaattgcccgttttctctcctttttttgnctttcaacttactgtaattatgccccaatagttcgggtgcangtgcacgcctataatcccagcactttgagaggctgaggtgggaggattgtttgagtccaggagtttgagaccagcctgggcctcatagcaagatccctgtctta

SEQ ID NO: 671853 - DNA, 1484 bp, Homo sapiens
  misc_feature (1132)..(1132): n is a, c, g, or t
  misc_feature (1333)..(1333): n is a, c, g, or t
  misc_feature (1464)..(1464): n is a, c, g, or t
taacgggaggacttaccctataaaggctgttgctatatttgcaaccaggaggataatgccgatgtgttttcaggtttctctgagttagagaaattgatctccgtaattataggcctcgcccgattgttgtaggaagaggcacgataaagaattattgaggcgccatgggcgttgaaggttagcggattgattcagccattaattatacgttctcgagtgtgatattttgggccgacatgtgatatgaacaacaggcgcggtgtgaaaggccgcttcgcggtgaagttcacctgcctatgtgtctaagcgacatatcagctcctctgatggcctgaaatctctgtgaaggctatccaggtccaagccgcccaaagggaatttgaaacccccaaaaaattttacattccatgtgccgagacaaaaatttgtttgtgacagctgcgcgcgtttgcgagcaaagcagtctccgcaaactgacgacctaccacgtttgatgctacaaatctcaaacaggtttctctactttacaggcgcgctttataccaatctccatgcagacgaggcacaactttactcccacaatattcagggtacaactatctgtcctccgcacaacccaccacctgtttgtcccaacgaaagcaccgtgggtatggaacgaccacaaaacccccagtagaagtattaaaccccggtgtggaaagcaccaagctccccaaacagtgtcccatattcacggaccatttccaacagggagaacgcgaaacaaactggcgcacccttttgcgaccgccccattctgtggaacaaccataatagggaacagttgataattggccccacgggcccaataacccattacttctcaaccatttaccaacgtattactccccaccaaaccccaatatatacaaatgccttacttattaacacgaccatacgttgtactccccccccctatacaacatagtgtccaccacaaacaaataccacacaaagaagtactagcacctaaaaagacaggcgtccctaatcatattccgcgaaagaaataattctccaacatttcctctcccccacacgaatgtttgtactactgacgcaaaagcgcaggtgttgtctgtttgagcanacacaacaacatgattcatccacacctacaatattcgagctggtgcaagagcaacacatccaaatgaattgatcagatcgagtcacagctcacaaatcatttctatctaccattgtcagcaagcagagccccgacatatcttgcatgcttgtcctctcacatcaaattgaacagaggtggtgtatccacccacccacacangcatcgaaacgagtggtctgttgtcacagaatcatacaaagaccgcgcacctatcaaagagcgttgttatcataagaacaactgagttgaggaaattctcgcgacgggcagctatcagatgatgtctatanaatcaaggggacaaaaccca

SEQ ID NO: 671854 - DNA, 1340 bp, Homo sapiens
gcgatcggtagacccgacaaggaagaacagacctgtctcatgagtcggattcctggacgacgtctgacgtttcagatgacctatgtaccagatagaacggcatatattaacttgtatcacaatgcatggcatctgaagtgttctgaccactagcaacgtgatgaagacaaagacatgcctcaacgaacatggcatgcctaacagcatgtggaattgatgagagataatcgtggcagtgttggtcagacactttcaatgcccttcttggaggagactcgtgaggcatatcagcgcaagcaccatatatgtgccatatggtgctaggaccaataagttaataggttggatccatatggtcacagtggtacgatgttcacggacacgaccgaagtcacgactgatggaatggcagttcaccgtatagaaatcgagcgtatcgatagcatttacatccagtgggcacgtcacgtggcttgactggcgattatgcgtatggatgcccgatgatgtacctacaacattgatttcagtttgcctccaagtaatgcaacattgggtgtagctgtcaggctgctgatattgacaacgacttagatcattctacattcagcatcttgcagagatcaaaagatgaactcactaaggttgtcaagacgggccatacccgattattccttgaataggtaggcgtcgtcttggagtcccacaagaagtgaccaggaagattggcaagtgtgaagtgcacgatcagcacctgcagggactttgcgaacctctggcaggagtgcaaacacgctcactattgttccaacattctcctgggcattgacggtgtgcttcgtgggcaatcctgtacggagcacttcatgacggccaatgggatggccagagacagaactgggaccaacccggggacgcaccgaagcatcggggaccaacacggcgaaaagacgacccgtgcactccaaaccagaggtccataatgtgccgaccagcgatgctaaaacaaccactctagcaggtgggcccaggtgcagaacacactcgggtgaaacagggggagatacccagggcgaacaaccccagcaagcgagaaagaccacagagcagaggaacagcgcaaaagggggagacacaaaagcgaaaagagtagagaaacgcaaggatcggccgagaacgccagacgtagcctgagggaagcgcagctgcacgtcagacggacacgagcgagcgacaagcataggacacgacaagtgaagtagaacaacgacacgaacgacatagaagtctagttttaccagcagctccactgatgagcagaaacagagagcgagagcacg

SEQ ID NO: 671855 - DNA, 797 bp, Homo sapiens
ttgctatatttctatgttctttccggaattactgagaagcatgtcggttagcttgttagtcggtgggggacatgtcggtatcaaaagatcgaagtcttattcatattgatgtaggccatgaatcaatcacataactggtgctggaaagcttgataccatccactggggtgctattggagaaggattatatgggctatctttatagtctgcaattagttgatgattgctttcctagattctatcaactgcatttatatttcgcttttctgttacatggaaaatcctttatttgctggcggttcatcttgttggttagtatgttttgtcccacttacagcgaagtagaaagtggtctgaggttatccttgcttttcttcgcggtttgccatgtgtgacaagtagatttcctgctattgatatattctcattatacgacagaatagtggagaacagtgtttgccactggacaaaatccagtgtggtccactctggggaagcattcggacctgtggtgcttctaacaacttacaagtctagatggtccttgacactggtccccacagccatagcggcatactacttttgtgcattctacattagctgtcatctaatgcaaggatggctcctgtcccgtgataactcagggcgatccattactgcttcactcttccattccctattctgtagacaacccaagcagatcaatttccccttatgtccagggccaacccaaagggccttgggcgcacgcttctcggggacactcctcaattggagcacctcggctgagaacctgt

SEQ ID NO: 671856 - DNA, 138 bp, Homo sapiens
  misc_feature (54)..(54): n is a, c, g, or t
gatccgtgtcactcatcattgctaactgcaggtccatgcccaactcagaatctnctgcctgccatctgaattctcatctgcttggcacacgctgtctaaaacctcctgatcaccttctgcagcaatggatgagtggaa

SEQ ID NO: 671857 - DNA, 315 bp, Homo sapiens
gaccagagatcctatgagaagagtgtgccatctttaaaagtacatttagggaccaggcacggtggctcacgcctgtcatcccagcacggtggctcacgcctgtcatcccaggcacggtggctcacgcctgtcatcccagcactttgggagaccaaggcgggcagatcaccagctcaggagttcaagaccatcctggccaacatggtgaaaccccatctctactaaaaatacaaaattagccaggcatgggggagtgcacctgtaatcccagctactgaggaggctgaggcaggagaatcgcttgaacccaggagg

SEQ ID NO: 671858 - DNA, 492 bp, Homo sapiens
gagatttactgaccttaagcactatagtgatgaactgcagtctgtcatctcacatcttcttcgagtcagagctagagtagcagatcgactctatggtgtatataaagtacatgggaattatggtcgagttttcagtgaatggagtgccatagaaaaagaaatgggtgatggactgcagagtgctggtcatcatatggatgtgtatgcatcttctattgatgatattttggaagatgaagaacattatgcagatcagttaaaagagtatcttttttatgcagaagcattgcgcgctgtgtgcaggaaacatgaacttatgcagtatgacttggagatggctgctcaggacttagcatccaagaagcagcagtgtgaggaactggtaactgggactgtgagaacattctctttgaagggaatgactaccaagctctttggtcaagaaactccagagcagagagaagccagaataaaggtgctagaagaacaaat

SEQ ID NO: 671859 - DNA, 275 bp, Homo sapiens
cgtccggctattttaatgttttgaaataaacccttttaaaatataaatcccgtggtttaaaaggaagaaatggtgggaaggaaaagtagagaaaaaaatccccattcccggcccaagcgttatttgcccagtttttttagaatgaattttccccatgtatgggttcttgttacccgaatggggaccggaaaaactgaaaaacttttgcttaaaggggccttattgactgctgatgtgatgctcctgtaatcccataaattttttaattgttgcca

SEQ ID NO: 671860 - DNA, 261 bp, Homo sapiens
  misc_feature (51)..(51): n is a, c, g, or t
  misc_feature (172)..(172): n is a, c, g, or t
  misc_feature (180)..(180): n is a, c, g, or t
  misc_feature (212)..(212): n is a, c, g, or t
  misc_feature (222)..(222): n is a, c, g, or t
gagaaatgaccaagtggaggccagtatgccttgaggagctgtttggcagtnccatctacccagcacattgatgaagctcaaatgcgtcctcttcatgctaatgcctgtagcactgtgggtgggggaggcagagttgagaaaacacatggaagtctgtatcctggggaaattnccaaacgnctgttttctctccttgtaccttgtgccacctncctcttctcngcgcactttgatagatgacctattttaatgctggcaaag

SEQ ID NO: 671861 - DNA, 133 bp, Homo sapiens
agcattcgggccgagatgtctcgctccgtggggcctcacgcgccccccggggctactcctcctcttttccttggcctcggaagggtaatccagggggaacttccaaaggttcaaggtttactcacggcatcca

SEQ ID NO: 671862 - DNA, 898 bp, Homo sapiens
  misc_feature (19)..(19): n is a, c, g, or t
  misc_feature (578)..(578): n is a, c, g, or t
  misc_feature (592)..(592): n is a, c, g, or t
cgtcagggtgttcgggaanttttgatggtaaaaaggtgaagcaaaatgtggtaaacaggaatgaaaagccagaatgaataaaggaagccttcattgttctgagtgagttccccagcctgagagattcacagagacctggcaaatgatattgctgaaccatgggcagtgaatgcagagaacagaaaagggcatacacctttggatctctgagccatcatgtaagaagttcagctaccctgaagccaccatgttggatttgccacttagagacagagatatttgaggaaccccaactgttctgggctccagctgtttgagtctttccagtccaggtcttccaagtttataagaagaatcagatttccaagagcaatttacccctttcttcattctgttaggcattatttggaatggcttttcttcgatgaattcaattaacaggctggagtgcagcggcgtgatctcggctcactacaacctccacctcccgggttataagcgattcttctgcttcagccttctcctgagcagctgggattacaagtgcgcaccatcatgcctggctaatttttggattnttaatagagacggngtttcttcatgttggccaggctcgtctcaactcctgacctaaggtgatctgccaccctggcctcccgaatgttggattacaggtggagccctgaacccacctaaaaggatatttctaattaaaatctatagcttagaaagattcatgaagggataaaatttaaaatataactcaaccggactttgaaaaattgagcaatttattaatttacaagaatggtatacatgtttagaataattactgtaaaagataagttatattttcccgatattttcggttgaatttatttgaaacatttaaagtggt

SEQ ID NO: 671863 - DNA, 161 bp, Homo sapiens
acagaaatgcaatatgttcacagtggtttctgcccaaggaagctagcttaagactcacgctggggggccagtacggggatgggcactctgcttgaccagccagccacaattaggcacataaggcactctgtttgcacaaccagccaaaattaccagaatcc

SEQ ID NO: 671864 - DNA, 342 bp, Homo sapiens
  misc_feature (26)..(27): n is a, c, g, or t
  misc_feature (36)..(36): n is a, c, g, or t
  misc_feature (48)..(48): n is a, c, g, or t
gttcctagtagagatgggctttcaanntgttgcccnaagctggtcttnaattccagggctcaagcgatccagccgtattggcctcccaaggtgctgggattacagccatgagccaccatgaccaacgtgtttcttaatttaaaaaaaaaaaatagaccaggtgctctggctcatgcctgtaatcccagcactttgggaggccaaggtgggcagatcacctgagatcaagtatttgagaacagcctggctaacatggcgaatcctcgttttgaccaaaatatagaaattagcctggtgtggtggcgagtgcctgtaatcaagctttattcaggaagggtgagg

SEQ ID NO: 671865 - DNA, 134 bp, Homo sapiens
cacggcatatcgccgatacggtatgtataggattgcttgaatggtagctgtgctggtctactgcttccaccctcccatgtcattagtatcagctagtgttacaggaggccttatgcttagcatcaaaagcacac

SEQ ID NO: 671866 - DNA, 160 bp, Homo sapiens
atgtttattacccttctagaggaccctgttctgtattcaatgaaccccgatcaacctaaccacctctggctcagcctatataccgccatctccagcaaaccctgatgaaggcaacaaagtaggcgcaagtccccacgttagagacgttaggtctacctgg

SEQ ID NO: 671867 - DNA, 881 bp, Homo sapiens
  misc_feature (880)..(880): n is a, c, g, or t
gtcgggtccgctgcctggcgctgcgggcggcgtgccactggtggtttggattgagccgggcccgtgcccggggcgccgtagtcggcgggcgtggcagctcagcggcgtgccgagtgctacggggctcggtttggctgactggggagtcggcaggcggcaggtcttttgtgtgggatgagccagggtgcaagggagacgtacaattactccagttaccgaattgaaaccatccctgctagtggagcagcctcctccagtattctgtcgggtttagagctacctgttaaataagtcagtgggattgtccagggccgaccgccctcccttggctgcctcagggcgaaaatcaggacaccattgcgaggccagccggagccatgcttgcctgtggcccagtccccgcgctcgtgccgtccgagcttcgctatctgcgtgcatggcgttgactagcgcgcctgccatgtacctactctctaactgccgtgggttcttagttaacagcggcttggcagctaactgggcacaggctcttgccttgctggctccccttgcttcttacgaagctccttttggagagggcaggatgagcgaccgtcttgttcgcattgctttgccttcttgatgctctgtggctactggtctgcgtatcacatacgctgatcctgctgtgtcctggaccgtggtgtgccgtggctccgtggctgcatcgttgctgtacagtgctccgatttgtacgcttagtcgcgctaccgtgctgtgtccttgcctcgtcattcctccggagcctacgtcagtgcctacgactcttgcttggcatctgcttcctattagccactgggaatcttgatcgctgatttgtgcttcgcactatctacccatng

SEQ ID NO: 671868 - DNA, 243 bp, Homo sapiens
  misc_feature (5)..(5): n is a, c, g, or t
  misc_feature (8)..(8): n is a, c, g, or t
  misc_feature (13)..(13): n is a, c, g, or t
  misc_feature (22)..(22): n is a, c, g, or t
  misc_feature (143)..(143): n is a, c, g, or t
ggcantgntgggnatttaatgnaatttgtctgaaaaacatgataagcataccagcaaatctgggtaaggccataatatagctgattatattgatccagccatcatgaagaagaaaaagtggcagaagaagaagtaaacatctntgtaagcaagtaagaagtaaaaggggtaaaaagaaacacattaaggaagaaccactttctaaggaagaaccatgtaccagcacagcaattgctagtccag

SEQ ID NO: 671869 - DNA, 229 bp, Homo sapiens
tgaagaggcacaggaggtggtgcccgatggggaggggtaatggctatgtccaagtaatctcctatctggaacttctggcgacggcagggtcatggaatcatcagtcccctttctgccagacatggtggctgccaatctccttaactcagatagccaggtcttttaagcatctggtaaagaacggatggcaaaatgggaagtggagtgccctttctttctaagcttctgg

SEQ ID NO: 671870 - DNA, 99 bp, Homo sapiens
  misc_feature (1)..(2): n is a, c, g, or t
nnactgatagaattcaagcttctaaaaaagaacggggacatgttcatgccctgattttataaacttgtatctatcaataaacattgtgagacttgaaaa

SEQ ID NO: 671871 - DNA, 679 bp, Homo sapiens
ctttgctttccaccatcgatgtgaggcctcctcagccacagagaactgtgagttcattaaacctctttcctttataaattacgcagtctcgtgtatgtctttattagcagcgcgagaacaaactaatacaggtaaattggtaccggtagagtggggctgtgaaagatacccaaacaatgtggaagtgacttaggaactgggtaacaggcagaggttggaacagtttggagggctcagaagaagacaggaaaatgggggaaagtttggaacttcctagagacttgttgaatggctttgagcgcaaaatgctgataatgatgtggtcaagtgaaatccaggctgaggtggtctcagatggagatgaggaacttgttgggaactgaagtaaaggtgattcttgctatgttttagcaaagagactggcagaattttgcccctgccctagagatttgtgaaactttgaacttgagggagatgattttgggtacctggcagaagaaatttctaagcaacaaagcatcaagaggtgacttgggtgctgttaagaccattcagttttaaaaggaaaacagagcataaaaattcagaacaatttgcagcctgacaatgatgaccggaaagaaaacccattctctggaggaaaattcacgccagcggcgaaatttgcctaagtcaccag

SEQ ID NO: 671872 - DNA, 786 bp, Homo sapiens
  misc_feature (23)..(23): n is a, c, g, or t
  misc_feature (97)..(97): n is a, c, g, or t
  misc_feature (101)..(101): n is a, c, g, or t
  misc_feature (109)..(109): n is a, c, g, or t
  misc_feature (113)..(113): n is a, c, g, or t
  misc_feature (213)..(213): n is a, c, g, or t
  misc_feature (217)..(217): n is a, c, g, or t
  misc_feature (220)..(222): n is a, c, g, or t
  misc_feature (224)..(224): n is a, c, g, or t
  misc_feature (226)..(226): n is a, c, g, or t
  misc_feature (228)..(228): n is a, c, g, or t
  misc_feature (230)..(235): n is a, c, g, or t
  misc_feature (452)..(452): n is a, c, g, or t
ggaaggcggcggcggcggtggcntttggggcgaagtgggcgtgcggctcgcgctgttcgcggccttcctggtgacggagctgctccccccgttccanagantcatccanccgnaggagatgtggctctaccggaacccctacgtggaggcggagtatttccccaccaagccgatgtttgttattgcatttctctctccactgtctctgatctncctngcnnnantncncnnnnnngcagacacaagagacagcagacaagcctgcctggctgccagccttgcctgctgtctctgatcttcctggccaaatttctcaagaaggcagacacaagagacagcagacaagcctgcctggctgccagccttgccctggctctgaatggcgtctttaccaacacaataaaactgatcgtagggaggccacgcccagatttcttctaccgctgcttccntgatgggctagcccattctgacttgatgtgtacaggggataaggacgtggtgaatgagggccgcatagagcttcacccagtaggacattcttccgtgtatgaatatacatatggatctctaccctatgccgttgtctttcacatcatcgaatttaacctagagagagactagttcaggcatgggacaatctgactactcttgtttctagcaatctggaagaatccccccttcggttcgtaactccacagtttaacaagtctgagccattgactactcttgggtaaatattacgagtacagaaaggtagtttaccttcatgagattgttactccc

SEQ ID NO: 671873 - DNA, 714 bp, Homo sapiens
  misc_feature (248)..(248): n is a, c, g, or t
gggactcccccccgaaattcttccacgttgtgggcgggggggccctgatctcccggggtttcaccgtttttctgttacccaggtttttttcccttctttgggggggtgtttttgtgacccggcgtccttcaggcatttaaggcgttgggagggggtggggggaaccttccccgtggggcgttttgccctggcccttgttccacgggcccgcttccgctttaaaaaaaacccgggggggcccgggtgtntgttcctggtgcccccttcggcccccccgggttggaaattttacccctttcctcccccggaggatttttggacgggggccgtgggcccttttttaccttccggggccccccccaaggggggtgcccccccccccctgttttttagccccggccccggtttccggtttggtttccctttaacccccttttttaaaccagggggccaaccccccccccggggggtttcctttggggtttcccccaaaagggttgaaagggggggtttcccccctttttttttttcccccttggggccaaagggggggttttcccgtaagggaatttccggggtttttttttttgggggaaggggggcccaacccaaattttccccccctggggggggggtttcttttcccaattttacccccccttggtcttttttttttgggcccccggccccgaataaaaccccctttttttttta

SEQ ID NO: 671874 - DNA, 351 bp, Homo sapiens
acagaattaacaaaatataagttgtggccaggattatttaaagaaaatttacgttatgtagaaaacaaaaaaaaaagtgcctatggtaatattcaggctgctctgctaggtggtggcgggggtagatgtggatcttaccttagaagatcttatggtctaataagatatgagtccagagctatggtgttataagcacactgcagagagtgacaagtgacttaatcactgatcaccagttgttttttgagaattcagtagccgtcgttataaacatctcggggtggggcccgcgtcccaattccccctatagtgagctttattacgctcgctctttggcagttgttgtacaac

SEQ ID NO: 671875 - DNA, 216 bp, Homo sapiens
aaccaaccatgctgtggctcctaggtgatagaggactcacctcggaggtatccgagctggacacagcccctggcaccgtgatccagacagctggccgtcccccaagcagcctgtcaccttcagcgagacccatatcctccccatccccagagacctctagaagtacctagccacatagctaccaggaattaagtgcgcctggaaaacaaatcgaat

SEQ ID NO: 671876 - DNA, 165 bp, Homo sapiens
acagtacttgggcttgggtacaagaggaccccatggtctgtggccgtgagataatgcacacctggaattcgctttctaaaggaaatcaaatgaattggaggaactttccaaacaccacttactggtgtatatagccaatataactatctctactaaaggtgctga

SEQ ID NO: 671877 - DNA, 130 bp, Homo sapiens
gaggagtaaatgaatgacaaaggtgggagcatttcttttctatgtaatgatgaaatgagaggcaggagcagcaggtagtagcaaataaatgtcgagggatcattccagtgtgaaaaagtctgtttggtcc

SEQ ID NO: 671878 - DNA, 330 bp, Homo sapiens
gacgcactgcttgcctcccctggaggccgcaagaaagccatcctagcccgcgacacactctttcttggccttggcggcgcatgcgtgcacctcctcaccctggccactgcccttatagtccacccacagctctgacttctccaccatggtccgcagccgatccagctccgactagatcaccttgtagtactgcacgagccgcgctgagatcagcagcagaaccagcttgaaggtgcgcatagactcctgccgctggctgaagtgcttgaagagcagcttgcaggcacccgagaccagcggcgcatagtcgtgcatggtgaggtggatgag

SEQ ID NO: 671879 - DNA, 536 bp, Homo sapiens
agcggaggtgagtcacacagcctcacatgcgcacagtcagaaaggtcgactctacctcttctgtcctccagaccctgtcaagtaagcctcaagacctgagacgtgcagcgaggtggcccaagcgttgcctgcaggttgatggcaggggcacgtcaaggcgtaaccctggatctgcgcattgctggacctatgggccactagccgtggagaaccgtgctcctgtgattaatgctgtgagcaacaggcatggtggccagtgcctgtgctcgaaccgtgacaatcacacatacggacagtccctcagccatggagggtactgcggtgccccgagggacaggtcgtctcactgatgcagcgcacttcgagccaagtcatcaaccactgacagcataggacacctgatgaagcactcgaacgcacagtcgtggagctgtacgagtcgtgcttgaggacgcgccgtaagaagatttccttcgacgttggtagagacggctagagaggccaacaatacacagagcgctctcttggtggaaccc

SEQ ID NO: 671880 - DNA, 1653 bp, Homo sapiens
  misc_feature (1653)..(1653): n is a, c, g, or t
agtgacttgggaggctgaggcaggagaatcgcttgaacccgggaggcggaggttgcagtgagctaagatcgcgccactgtactccagcctgggcaacagcgagactccatctcaacaaccacaaccacggacatgctgtctcaagaacatgattatccagggcgtatctcctaattcagatcatcaaactgattatatagcaagagttggctttaaaatgtttgcaaatgtcttttttctctctctctacactacatggcaacaaaacaaactatctctgctctgctgttcctcactacagatcgacttaggaactgatcattatcacaagaagacatatattcacaccaaacaactgaacacccttgaaacaacaatacaaaaaacaaaacaaaacaaaacacaatgaaaataaaagaaaaaaataaaaagaaaaagataataacaaaggacacaagggaacaataagaagagaaagaagagataagaaataagagaagagcggcaggacaccgagcaaagagaggaagaaaagaaatggaggagagggcacacagcacacaacgaaagcagaaaggaagagggggggaagggaaggcagcaaaagagcgcgaagagaggggaagaggggagaagggaggaggctagaaagcagacaaaggcgacgaaccgcacgagtacggctagagctacgagagaagaggagagacgaagacaacgaacacacgacataaacatcaaagcaaagactagagcgcaaacaaacacaaacaaaagaaaccacacagacacataacacaactatgacaagaaataaagaattactaatatacgagcgccacacacaacaaaatcaaacaacatgaagacatttctaatataacgaacaatcaagatacacctgatacaacacaactcacaacccaccaacacagagaagaattcacattattagaagagggagggaagagggaggaggagagagaatgagagagggaaggaagcagagagagggaggagcgaggagcgcagcaggaatgcgatgcgaggagaggggagcggatagagaagagcgtagagaataggtggcggcggcggccggcgggcccgacggcgagagaagaggacgcagacagaggagcgcagcaggcgaggagggcagaggaggagaggagagcggcgcgtgagagggcgacgcggagagagcgcggagagaaggataggagggagagaaggaagagagacagagacgggcagccggagagacgaaaagccacacaggacccagacagtgacagactgatggaaaaagacaagacgagcatccaaccacacatccgaagcaggcacagctaagcctgctaccaccagaacacgcctccgtaccagcagtacacagcaacgtcgcagcagcaaggaacacacgaagagacaccgagctgcagcaactacgagtacacacaatgcacacatcacagagacacaaagacatgcgagccagtacacgaacgtagtaagagatactacactaaaacacaacgtatcatgcatagagctgagcatctactaagtaagcaacatctacgacacctaacaccaaatataatgaacacaaagagtcagacaaatcacaacagcaaatacttaagctcn

SEQ ID NO: 671881 - DNA, 282 bp, Homo sapiens
tcgacagcccctttccagaggctcaaagaagtaaaacactgaggccgggtgcagtggctcacgcctgtcatcccagcactttgggaggccaaggcgggtggatcactggaggtcaagagttcgagaccagcctggccaacatggcgaaactccgtctctcctaaaaatacaaaaattagctgggtgtggaggttatggtgagccgagattgtgccactgcagtccagcctgggtgacagagtgagactctgtctcaaagaaaaaagaaagtcgacgcggccg

SEQ ID NO: 671882 - DNA, 119 bp, Homo sapiens
atcccccacgtgtagtctctgctacagccgatggcgcttgggcccgtggcttgccccttgctccctgcctgcctccgctggacctgaaagcccttgaaatagacatatgctgcttgtct

SEQ ID NO: 671883 - DNA, 320 bp, Homo sapiens
gagatggagtcttgctctgtcgcccaggctggagtccagtggcgcaatctcagctcactgcaacctctcggattcaagtgattctcctgcctcagcctcctgagtagctggaattacaggtgcacaccaccatgcctgactaatttttgtatttttagtggagatgagctttcaccatgttggccaggctggtctcgaactcctggcctcaagtgatccacctgcctctgccccgcaaagtgctgggattataggcgtgagccactgcgcccagccacaatgttgcattcttgacccttctgtcgtcctctcgcagccgt

SEQ ID NO: 671884 - DNA, 104 bp, Homo sapiens
tcttcatttcaccgctgcaaatggaaagctggcatcacttgtgttaaatcatggtaaccatgaaaataagtagaatgaaaataaaataatgttgtcacactctg

SEQ ID NO: 671885 - DNA, 3088 bp, Homo sapiens
  misc_feature (859)..(859): n is a, c, g, or t
ctcgctgaataacccttgtaagcagagcctagaaaagagttacatcacttggatttttagtgcagagatatgtcacaattccattgtaggcagaccctaggacaagtgttacatgacctaggtgatcagtgcagagatacatggcaatgccctgtaggcagagcttgacaagtggtagaacatctgggtgatcattgcaggaatatttcacaaagcaccttgtaggcagatcctagaaagagttacatcacctggctgatcactgtagagatagtcacatgccccataggcagagctagacgaatgtccatcactggtatcagtgcagagatatgtctcaaagcccctgtaggcagagagaaaagtgttacatcactttgcttgatcagtcagaagtgtgtcttgctgactgtttgctcccggagctctgcgtgcaaccggaaacatgcagggaagagtggaagaccggcaatggtgtcttcgctctccttgccagtttccaaaccggccacactgcagactccccatgttgctgcacacgggaatctattgtcaggccatcacggcggggaggcatcttatctctctggggtctcgctctggtctcctacttggaaatgaaggagagccacacgactgcctgtgtgagacgttcccgacaatggcgacacccacaggcactgcctccttcacggagagaaggcctggaacactcaagaatcccacggacgttgagttccacactcccctccactctcccaggccggtttctccctgctgaagacgcgtggcgcccagaggcgcttccagttaccgcgggatttctggagaggtccatagagccagcccagaaatgccnccctcacaacttccctctcgcccccttcctcttcatctctccggccccaccaccaccgtcaccacgccctccccaaccaccctgccacccctcgggcgcaggctcatcgccctgtggacattccggggtggcgcgggctgtcccagggctcactgccattcatgaagggatggagcctgcctgcctgcgggcctttataacagccgctggctggttgtccgggctggcctcctggctgaacctgccgcagtccacaggccggctgaggtgcatgggagcccgccggccactctcttcccatgtccgtctgtgaaattccagctggggctccccgcgatgtccatctggatacttcggaccgtgccctccctgtggaagtccggggacggtgacagtgtatgagactcgtttggaccccgagacaaagcgaggctctgtgagccacatttgagcagaacccatacccgggcatcaccaccagagaatgactggcccaggccatcggcattctggagtccagggtccagatttggtttcagaatgagaggtcacaccagctgaggcagcaccggcgggaaactaggcctggcccggaacacgtggcccataagaaggcaggcaaaagtggaccgccgtcaccggatcccagaccgacctgctcctccgagcctttgagaaggatccctttccaggcatcgccgccagggaagagctggccagagagacggacctcctgaagtccaggattcagatctggtttcagaatcaaagggccaggcacccgggacaggatggcagggtgtccgcgcaggcaggcagcctgtgcaaagcagcccttattgggtgtcaccccgctcccttgtgggtcgccttcgcccacaacggcgcatggggaacggggcttcccgcaccccacgtgccctgcgtgcctggggctctcccacaaggggcttttgtgagcctgggagcgagggccgtccccgtgctccagcccagcgaggctgcgccgcagagaggatctcccaatctgccacggcacgcggggattttgcctatgctgacccggcacctccggtagggcgctctccaaccctcaggctcctcggtgtcctccacacccgggaaaaagccaggaagaccgggacccgcagcacgacggcctgcgtgagcttgcacggtgggagagcctggggcagctcaagcgggccaaatggccaaagtgtgcttgcgacaaccgagtcccaggggagtccgtggtgggactggggccggggactccaggtgcccggggcggcctgggaaccccaagctgtggcagctccacctcgccagcccgcgcccctggagtcttccgcgtggcaggggcagatgcaaggcatcctggcgccctcccaggagctccaggagccggggcgctcgcctgcactccctccggcctgatgctggatgagctcttggcgagcccggagtttctgcagcaggcacaacatttcctggaaacggaggccccaggggagctggaggccttggaagacgctgcctcgctggaagcccccctcagcgaggaagaataacgggctctgctggaggagctttaggacaaggggttgggacggggtcgggtcggaacagggcagtggccactctttcgtggggaacaactggctggctacggaggggcgtgtcttacccccgtcccctccaccgggctgaccagcatgggattcctgccttctaggtctagtccgggtgagaggctaaacacagcggagaactgccattctttcctgggcaccccggggatcccagagccggcccaggtaccagccagttgggtcgcctactgcacacccgcgggtttcctggcagccggctgggctgtgggagcagcccgggcagagctctcatgcctttccaccaccccacccccgcctgaccaacccctccccgcccacacacaccaaacccagaaaatgcatcctcccctgggctgagtgtataccctcgtcccgcgaaacaccaggcccacgcaggttccaggcctgagacccatccagcggctcgcctcctctgtgcctccgtgccaccgttgtgggcacgcccgtgcccctgaagcatcccagctgccaccatggagcgactggcggcggaaggcagacctctagctctcttttccagtctcctggctagacctgtgctcattgcgcaccacgggtgacgtgcaaggga

SEQ ID NO: 671886 - DNA, 596 bp, Homo sapiens
gttcctaaagagagtccttggcttaaagctgtaacaagggtgtgctaggtgggggatttggagcaaaaccgtcgagtaggcatgatactggtatggagtgggcctgcaaaatcagacagaaatggcttgagaagccgcagggggagcatgcctgtctctcagtgatagagtatgggagggacctccctagcttggaaaatgagaattgaaggggttatgaacaaataggatgcctagctgaggatgttcccaaagttatggccaatcttatcattagtagattttataagccacatagacaaaccacaaacggaataatgttacttgggatgctaaattttttggttctaggtgtggctttgtacatgcataagaatgctatatgctgcacattttgcctttaaagtcttacgactttccccattttagtctaatgggaagatgcagatgtgcaactgtgctaaaaagtggtctgttatcatctttggattcagctctgagtaatggacattttcagacatgcacagaagtggggaggatggtacttggtccccatgtgtccatcacctaattgcatcacttatcagctttgggca

SEQ ID NO: 671887 - DNA, 129 bp, Homo sapiens
cttgagttgatggcacgcaccaccacgcccagctaattgtatttagtggagacggggtttctgccatgttggtcagtgctggtctcaaactcctgaccttgtgatcctgcctgcaatcaagcctggaag

SEQ ID NO: 671888 - DNA, 359 bp, Homo sapiens
  misc_feature (272)..(272): n is a, c, g, or t
  misc_feature (275)..(276): n is a, c, g, or t
  misc_feature (278)..(278): n is a, c, g, or t
  misc_feature (281)..(281): n is a, c, g, or t
cggaatttcgagcgcgttttcaaagtgccccacttcatactcatagtggttacggatgtcgataaatagtgcatcgggatcgtcaagcatggcgttcacttccgccgcttgcagatactcaccaacattgctggcatcaaagtgaggatcgtcaataccgtcggcaacaatgcgatcgggtaccttcatgcgcagtacccagaaggatttcccgtcatcatccaacgcgatattcaggcgtaaaccctctaaagccgggtcgaaggcatagngcnncncgngaaatgtttcaacattgctcgcaggtacgctgatttgcgcgttaatgccctcatgcgccaaatacactcgcccaaaaa

SEQ ID NO: 671889 - DNA, 1061 bp, Homo sapiens
  misc_feature (610)..(610): n is a, c, g, or t
gtactgtttgtttctaagcatgtgaattcactactgatcccatcgcctggccaggtgagacccagtcattcacgtccagtgtgaatcagtcctcactgttttgaagacgacatacatcgtgtgcgtacacgtcgtagttggagacattttactaaagcagacacagtgacaagtgccaagcgaataattaattgatagcgtgataagtgttgtacgattatcgtgcagactagcttgactagagtatcgtcgcgattcttagagagcgttcataggttgctggtatagattgggctgtaacaactaggagaactcgtattgagctgatttgtgacatgctagagtttgacgttgtgaaggctattctgctgaatgttcagcctggttgtgcgtcaccagtgacttggagttcgtctggcgagctaatggtcgcctcagcaagcctcaagtgcagttctctaagtacttcgtggtaattccgcactgtgttcgtgggaggcagtatttaatgatgttctaccatgcccagtgacagctagtgttcctgacaagtgcgttgactttacgaaagatggcagacgttcatccttggagatggtgagtgtccatnctgagccttgtgtacagggcgtatatgttgggcagtgtcgatcttcaggacgtagaggcctttggatttcccatagatcgcaaggaactagtcaaccctcgtatctgtaaccatgctcgctgagttggccaactgttccaggccactttgacacacccatcttgttgaaccttctgaaggtttgcgcactgcaagggccactcactagggggcatccattgcccaagcacctccttcatgctggtgcatggcagtcttaaacttcgatggcccaagggattagacatggtgggctaacctgctgggatcaatctggcctgagtcaattgaattgtcaaccagacaatttacttgcaatcgtcaggttggacgcaattgcgtgaggtacaatcctaagccagctaagatgggatcccagatggtcctttcctggggacccagttaagaaccc

SEQ ID NO: 671890 - DNA, 359 bp, Homo sapiens
  misc_feature (281)..(281): n is a, c, g, or t
  misc_feature (350)..(350): n is a, c, g, or t
gctgtacgatcgcggagaaggaagccagtctggagagcaggctggctgaagggtgggcttaccccggcagatcccttgtgccttccctctgtctcacattcgccttccttctcccagctccttttccctttccgtcctaggcattgagatgttccacaatgagcctggtagagggccgaggccggatgataacctcggcggccccggctccgatggcttgacagcgggaggacttgcggcgggggcctcggtcatggtcaagccagagttccgtcaagccnccaccagaacggtggatggcccagcgtttacatccgtcagcaaggcaggaaggtggccgccacaagccnctttgtgtc

SEQ ID NO: 671891 - DNA, 3354 bp, Homo sapiens
tttttcctttcttccagaaggagatttaaccatagtagaaagaatggagaactattaactgccttccttctgtgggctgtgattttcagaggggaatgctaagaggtgattttcaatgttgggactcaaaggtgaagacactgaaggacagaatttttggcagaggaaagatcttcttcggtcaccatacttgagttagctctagggaagtggaggtttccatttggaattctatagcttcttccaggtcatagtgtctgccccccaccttccagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatggtgggtgaagacgctgatctgccctgtcacctgttcccgaccatgagtgcagagaccatggagctgaagtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctgatcttcacgttgatgtgaagggttacaaggatggagggatccatctggagtgcaggtccactggctggtacccccaaccccaaatacagtggagcaacaacaagggagagaacatcccgactgtggaagcacctgtggttgcagacggagtgggcctgtatgcagtagcagcatctgtgatcatgagaggcagctctggggagggtgtatcctgtaccatcagaagttccctcctcggcctggaaaagacagccagcatttccatcgcagaccccttcttcaggagcgcccagaggtggatcgccgccctggcacggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagtgaagctcctggaggaactcagatggagaagtatccagtatgcatctcggggagagagacattcagcctataatgaatggaaaaaggccctcttcaagcctgcggatgtgattctggatccaaaaacagcaaaccccatcctccttgtttctgaggaccagaggagtgtgcagcgtgccaaggagccccaggatctgccagacaaccctgagagatttaattggcattattgtgttctcggctgtgagagcttcatatcagggagacattactgggaggtggaggtaggggacaggaaagagtggcatataggggtgtgcagtaagaatgtgcagagaaaaggctgggtcaaaatgacacctgagaatggattctggactatggggctgactgatgggaataagtatcggactctaactgagcccagaaccaacctgaaacttcctaagccccctaagaaagtgggggtcttcctggactatgagactggagatatctcattctacaatgctgtggatggatcgcatattcatactttcctggacgtctccttctctgaggctctatatcctgttttcagaattttgaccttggagcccacggccctgagtatttgtccagcgtgaaaagaagaagagagttcctccaattctgaccgagtgctgatcattccctagagacaccagtaaccccgggcttagctaacgaaagtggggagcctcaggctgaagtaacttttctctgcttctccctgcccagctcagagctgagggcctccccctccacagcaaccaatcacaaccataaagctacaagcacgcactgaagcactttactgatactcattcaattattcatatgacagttgtttgagtttggtaccatcttattttccccttatacagataaggaaactggggtgcagaaaagtgaattgactacaaagtagacatgactagttaacaacacagctgggatctaaacagcaataactaacattaatggagaacttaaaatgctctgagtgctgtgttatgagctttggtggatgtcactcctttaatcctcgcaacaccctgtcgggtagtctcatttagcaagtatggaagttgaggcagggcaacattaagcaacttacataactcatgcagtaatttctgcagttgggagatgttcagcttcagtccccggccctatggccgttcttttccaccctgtttcttcccccataggaagaacccacctgtagccctgaggttcttttcccaggatggctccaggataaggatcactgtaggtggttgtggagttgacacccctgttgactccttcccagctgattgtcagagccttagacccagcacgccttggattagctttgcagagtgtcttggttgagagaataacctcaccgtacccacatgacacgtgatttggaaagagactagaggccacacttgataaatcatggggaacagatgtgttccacccaacaaatgtgataagtgatcatgcagccagagccagccttccttcaatcaaggtttccaggcagagcaaataccctagagattttctgtgatataggaaatttggatgaagggagctagaagaaatacagggatttttttttttttttaagatggagtcttactctgttgctaggctggagtgcagtggtgcgatctcagctccctgcaacctccacctcctgggttcaaacaattctcctgcctcagcctcccgagtactgggaatataggtgcacgccaccacacccaacaaatttttgtacttttagtacagatgagggttcactatgttggccaggatggtctcgatctcttgacctcatgatccacccacctcggtctcccaaagtgctgggattacaggcttgagccaccgggtgaccggcttacagggatatttttaatcccgttatggactctgtctccaggagaggggtctatccacccctgctcattggtggatgttaaaccaatattcctttcaactgctgcctgctagggaaaaactactcctcattatcatcattattattgctctccactgtatcccctctacctggcatgtgcttgtcaagttctagttgttcaataaatttgttaataatgctg

SEQ ID NO: 671892 - DNA, 552 bp, Homo sapiens
gagaggagttcagtttagaagagatcaagctggcgaccggaatagaggatggagagataacgagaacactgtaggcattagactgtggcaaagctagagttctggcgatacaaagggcaaagacattgaagatggtgacaagttcatttgtcatgatgatttcaaacataaacttttcaggataaagatcaatcaaatccagaggaaagaaacgggtgtagaacaagcttgcactacaggaagagtgtttcaagacagacagtatcacattgatgctgcaattgtgtcgaattatgaagatgagaaagacacttatccacaatctccttggttcagaagtgtgcaaccagttgaaatttccagcaaaggctgctgatcttaataagagaatagaatctgtaattgaccgcgactacatgtgaagagagaaagatgtcatatgcagtagacagcggatctaacctgttgactcaatattatttggctccttctttactacccgtgagccaatggagcagtgtaattaatgggaatctgagtggacactttctt

SEQ ID NO: 671893 - DNA, 115 bp, Homo sapiens
cgcaggtctcggtagaagtgtagtgactcattgatgtcattgtaagacatctgtagctgatggcctcaattgctcagcaataggtgatggtctcactgctcggcgattgtctcac

SEQ ID NO: 671894 - DNA, 576 bp, Homo sapiens
  misc_feature (5)..(5): n is a, c, g, or t
  misc_feature (7)..(7): n is a, c, g, or t
  misc_feature (21)..(22): n is a, c, g, or t
  misc_feature (26)..(26): n is a, c, g, or t
  misc_feature (29)..(29): n is a, c, g, or t
  misc_feature (43)..(43): n is a, c, g, or t
  misc_feature (45)..(45): n is a, c, g, or t
  misc_feature (47)..(47): n is a, c, g, or t
  misc_feature (53)..(53): n is a, c, g, or t
  misc_feature (69)..(69): n is a, c, g, or t
  misc_feature (89)..(89): n is a, c, g, or t
  misc_feature (94)..(94): n is a, c, g, or t
  misc_feature (97)..(97): n is a, c, g, or t
  misc_feature (114)..(114): n is a, c, g, or t
  misc_feature (132)..(132): n is a, c, g, or t
  misc_feature (134)..(134): n is a, c, g, or t
  misc_feature (139)..(139): n is a, c, g, or t
  misc_feature (142)..(142): n is a, c, g, or t
  misc_feature (152)..(152): n is a, c, g, or t
  misc_feature (164)..(164): n is a, c, g, or t
  misc_feature (167)..(167): n is a, c, g, or t
  misc_feature (174)..(175): n is a, c, g, or t
  misc_feature (183)..(184): n is a, c, g, or t
  misc_feature (188)..(188): n is a, c, g, or t
  misc_feature (199)..(199): n is a, c, g, or t
  misc_feature (234)..(234): n is a, c, g, or t
  misc_feature (236)..(236): n is a, c, g, or t
  misc_feature (239)..(239): n is a, c, g, or t
  misc_feature (241)..(241): n is a, c, g, or t
  misc_feature (258)..(258): n is a, c, g, or t
  misc_feature (270)..(270): n is a, c, g, or t
  misc_feature (276)..(276): n is a, c, g, or t
  misc_feature (279)..(279): n is a, c, g, or t
  misc_feature (291)..(291): n is a, c, g, or t
  misc_feature (293)..(293): n is a, c, g, or t
  misc_feature (300)..(300): n is a, c, g, or t
  misc_feature (312)..(312): n is a, c, g, or t
  misc_feature (314)..(314): n is a, c, g, or t
  misc_feature (316)..(316): n is a, c, g, or t
  misc_feature (322)..(322): n is a, c, g, or t
  misc_feature (329)..(329): n is a, c, g, or t
  misc_feature (331)..(331): n is a, c, g, or t
  misc_feature (353)..(353): n is a, c, g, or t
  misc_feature (362)..(362): n is a, c, g, or t
  misc_feature (400)..(400): n is a, c, g, or t
  misc_feature (406)..(406): n is a, c, g, or t
  misc_feature (411)..(411): n is a, c, g, or t
  misc_feature (417)..(417): n is a, c, g, or t
  misc_feature (425)..(425): n is a, c, g, or t
  misc_feature (440)..(440): n is a, c, g, or t
  misc_feature (451)..(451): n is a, c, g, or t
  misc_feature (466)..(466): n is a, c, g, or t
  misc_feature (529)..(529): n is a, c, g, or t
tgggngngataaaacaatttnntggnggnttccttggtttacncncnactctnaggcaagggggcaaanttttctctccctgccctggnacaanggngttcgggggcaaggggnaaccccagttcggggggngnggggntcnggtccccgcnccgcctcgggtntcntgttccnnccggccgnntggntcggtggctgngggccctggggggggggggggctgccccggccccncnggngngggggggggggccggcnggcggggtttgngtgggnccnccctgcccccgngnggggggngcccggggggcngngnaccccngcttccngngccccctgggggccccgtgggntcggggggncccgctctcccctcggggctgtcctcgggggtggggcngggggnggggntggggngctggggntgggggggggggggngataagaaccnctgccgaaagggacncatgctggttgctgggccatgctttcctcccagacactgggttcctgaagaccccgctttttnttcccagggttacaacattccccagactcaaagctggaaggcggcaa

SEQ ID NO: 671895 - DNA, 567 bp, Homo sapiens
tggggagagtaatttaccagagcagaaacctcccaaacaccacagccaggtgatgaacaaggccaacatcaacagtagtaagtcatggggatagcagttactcttgatatgatgggaagaaaatggcacttcacctctgtggtcttcctcccaataactcataacccgagtattttctatgaggaaagacgtcagacaaattccaatactaggcaacctataaaatacttggcctgtactcctcaaaactaacaaggtcatcaaaaataaagtgtgagaaattgccacatttaaaaagacatgacaacttaatgtaaagtggtatctgagatggaatcttggaacagagaaagggcattgaataaaagctaagaatctctaaataaactatgccattttaaaaataatgatgtgtcaatattggcttattaatcataacacatgtatcatactaatgtaaagtgtcaacgatggggaaactgaatggaaggtatctgggaactttctgtactgtctcctcagttgtttctgtaaatctaaaactgttctaaaaaataaagtttgtta

SEQ ID NO: 671896 - DNA, 1117 bp, Homo sapiens
ttagggctatcgtcgaccacgcgctccggaccgcgtctgcccgcgatgcacatgattgcctcgcctttgccggatcctgccgaccgtccacacccgccgcagctcaccatggatgatgatatctgccgcgctcgtcgtcgacaacggctccggcatgtgcaaggcctggcttcgctgggcgacgatgccccccgtggccgtcttcccctccatctgtgggtgcgccccatggcaccatgggctgtgactgtgtggtgcatgggtcacgaacggattcctatgtagggctgacgaggcccatgagtcaatgagatggcatcctcaaccctgaagtaccccaatctgatgcactggtcatacgtcaccaacttggtgactgacatgtgcagaaacctctgggcacccacaccttctacaatgatgtctgcgtgtggctccccgaggtgagcaccccgttgctgccttgacctgatgtgaccctccctgaaatccccaaatggccaaacctgcgcagaaacgatgactccattacttcattgttctgaacgaatcctttcaaatcatacctcatgccactgtaccgtaggctactccacgggcctgttgctatcccctgtaccggcccttcttggtcccggtaaccaccatgggcactctgtgacctgtgcatcctccctggctggaacgtgggggttctaccccaacctatccttggattgccccctattcctaacgcaagcgcggctaactggccccttctcccctctattgtcccacttctctggcggctcctgggcacccctgcgccttggccccgtgagcacctttgacctttgacctttcgccctccctttgccatgtaattcgcctttcttccccgaccccctgccggagcactaccctgtgctttcccaccccacccccacccgggtccccgcatccccgcggtaccgcaatcacgttgcctcgttgccccacattaacagcggacctcaatgcctcgctcgccatacacgtctccccccccttgtgacacttctctccgcccaccgcacacacttgcaccacggtgatcatgccttatcccatgcttcactccccctgtgccacacaatac

SEQ ID NO: 671897 - DNA, 336 bp, Homo sapiens
tcacccaataaaatacaaattaattaattttaggaaaaaattgcaaatgaataaaagtttctacaaagtctttgaggaatatttaattcccatgttgtatgcatatttctataatgtaggacaagctgaaaagctatccagctcactttatgaagctaaaattacactgaattgaacatagactaaatgtcagggaactattagacaattttactcataaatatgaattctaaactcctaaataaaatgttaacaagttgaatcctgcagtgcaggattcaagtacaatttaccccagcaaagtaaaggtggttcaatattagaaaagccagaaac

SEQ ID NO: 671898 - DNA, 608 bp, Homo sapiens
ccaggccaacaatgcagtgctggctcccgcggggctggctggagccctcctcaccctcctgtgcatggggctcctgtgtctgctgtgtaccacttgaacctgtccccgcagcgggtacaagggacccccgagctgagccagccgaacccggggccccctaaagctacagctacactgatgtacttcatttgcagttgaatgactgaaccctgtgtgctattaccaagcctgacatatagcgcactgtgacgctatggcttgctttgagcaacgtgggtattccagtgaccagggaacatgggtcccacctatgtaggtacaccaaacttgctccggcggaacacatgccaccacagctactgtaccttgccaatgattggctagctgagtatcgacaccttctttgggccaagttgggggctataggtagggtatactagccatgtggacgatgacaactatgtagaagccaatgggctgctgcttgcagccttctagagagccttcccgctggcccgcgacgtactatagtgggaagggccatgcctgaatcggccatccatgcctcagagccacagcccacaacgcacgaggctggtacagtactg

SEQ ID NO: 671899 - DNA, 915 bp, Homo sapiens
ggcctcgtccagggaaacagcctggggtgggaagtcagggcgtcctctccgtctccttctcttctggtatgaacgtgggggcggactaaaatacagaggtgccaggaagttacgagaaaagtggaatggctagcggctgagccccactagagcaggttctagggttgctttcccaacatcctgccaactaaataatcgggcatccacgtctgcatcagagggagaagctgcaaaatcaattcatgcaggagggcaagcgccaggatgagcgtacgccgaattccccaagtggcataagggaatggagaattcgtatcaagtgttgtcactcctaaaggatactgataggaagagaatcagaatgcctttggaagaggcaggaaggagtggaattaggaaaaggagagagaatagcttgttcttggccagctggtcaaacaaattgatgaataaagaatagaactggcatcattcatcatgtgaataacgtcttctaggttatccgggtattctagaatgtaaatggaccatagtgtgtgagttccatggtgtagcttgttgaacggggatgtggttatggaatatgggttaatttagatgtcacatgtacgtgtgatatctgagaatttgtccgataatatagtactgagcttagtattcaatataacgatagtggttcttgaacacgattagggtcaagtttggaagacagtcactgcttgggtctaatgacgagtaggtgcttgagaatgctccgatggggagggggcatatgggggtactggagggcacattgggggcttaatggtgtgaaaggaaagaattggataatggtttgaaaagaaaaaaaatggggggggaaaattaaatggggccgaaaatatagggaagaaggtgaaaaagggacaaagtgaa

SEQ ID NO: 671900 - DNA, 318 bp, Homo sapiens
tctacagattctcccgtacgtcaaaaaaagaaactgactaagaattggggatccgaatattataagaactagcacagagctattagaaggaaacgcaacccagtgaaagtgggcaagacttcgtagcttcacggagagaatgtgacgtagggagcacaacggcaaattacccacaattttccaccagtggaaatttaaagccacaaaacaagtgttggtgagtagatggagcggctggggcacctgttccctggtgttggaattggcattgtctcatactattgaatcatttggaatagattgggcgtacgggggggg

SEQ ID NO: 671901 - DNA, 257 bp, Homo sapiens
agaggatcccctgttcgaagttaggctaggactgcagtggtgcactctcggtcaatgcaacccctgcctcctgggtacaagcaattctcgtgcctcagccccctgaagatagcatggaattaggaggcatgcaccaccacatctggctaattttttcttttttttgtatttttagtagagacggggatctcgctatgttgctcaggctggagtgcagtggctattcacaggcgcgatccccttagttcagagccagg

SEQ ID NO: 671902 - DNA, 1007 bp, Homo sapiens
gtcttcccttgtcccttgcggttggtctctccccgtctcggctctgattgtgctccgtggttgtcgttctcctgtatcgacttgtctgctttcttggcgtccctccgcatgcggtcggccctgttgctgctgctcgcgtcctcttcatggggccggtgccagagttgggatcggcgcccgtctcccttgggcacatttaactctgtgcgggttcacactgctggctgtctgccccattcctgtggtcgtcggggcacctccccttgactggcccttagaagattcgcggtctactgtgtgtcggctctgtcccccacatccactgtctttgtacccatagtcattgtcgttgctactatgagaaggcagttggaactagccgacctataccaatagggtcatctgcttcatgccggaccagccgccctagtaatatgccatcatctatatacaacaatgaggacttccaggtcggacatagccaaggtggtcctgaagagcaaggtatgaccaaggtgaccgttatcggggctggggtgaccctgcacgaggccttggccgcttgccgaactgctgatagaaagtaatagatcaacatccgcgtgctggaccccttcaccatcaagccctggacagataaactcattcatcgatcagcgctcgtgccacccaatgggacaggatcctcaccagtggaggaccacttattatgaacggtggcagttggtgaggctgtgtcgcacgtgacagtagtgggcgagcactgggctatcactgtcacccacctggcctagttcaccgggtaccaagaagtgggatagccggctgtagctgctgtaagatgcttgatatcgtacagggatgccattgcacaagctgtgaggggccgtcatcaccaaggcctagcgcgggtatgaagtgtggggccgggggtctatacattcctgagattctgggaaaggtggataacaccatgtactgagaggatggtatgtctttgtttcgct

SEQ ID NO: 671903 - DNA, 280 bp, Homo sapiens
tgctgggattacaggcgtgagccaccgcgcctggccaataccttcttgagctctcactacttataagtctttgtactttatgctaccaggaaaaaaaaaatggtatgagacatggcaactaattgtaaatctgtttgtaaacatttgatatgctttttattcacctgggggggtcttcttgctaagctgcaatttccctttcggaaggcttcactcgaattcctgcagcccgggggatccactagttctagagcggccgccaccgcgtttgagctccagt

SEQ ID NO: 671904 - DNA, 456 bp, Homo sapiens
  misc_feature (147)..(147): n is a, c, g, or t
gaggtggatctagaggatcccatgcaccattccgagtgtaggaagagcagctgtccattcttggtgggcagcctgtcgtcaatgaccacctccacccactctccgtactgccagaactggggaggggggacacagcggctgctcacntgaataagcagatgtgtaaagggagtccctccaggggacctcacgtggggactctgtgccatcagtgttcgagtcttggctccttaggagcaggacatgtgtctgccttatctgtgcacataggagatgccagatgaacccgggaacatctagtccagggtctgcgtttgtgcatcagagaacttgcccagcgccacctagtggcagcaggaagtgattcagacccacacctcctgaccctcagtccacagggctttcctgaaggccacgtggcctaggggagctgggaagaggatggatgtgtggata

SEQ ID NO: 671905 - DNA, 156 bp, Homo sapiens
tgactctagagacccctcagttgtctgcgaactcagcctgcaggaacgtgttaggaggggtcggggagaaatcaggctctcgaagctcagaaaattcaacgtgaggagcaagctacaaggacgcccgaagcacagtggacggtcatgaaggagcgg

SEQ ID NO: 671906 - DNA, 440 bp, Homo sapiens
  misc_feature (7)..(7): n is a, c, g, or t
  misc_feature (282)..(282): n is a, c, g, or t
tctaganatcctccgggtgctgatgtgtatgtgtgtgtgcgtgcgtgcatctgtgtgtgtgtgcgcgtgtgccatgtggtgcgaactagtgtgatttgacatatacatgtcccgtccgtccatgtttggacatggtggcagatggggggtggttgggagggctaagcaggcaatgaagcctaggtgtgcaggctcaggcccagagagtgatccaccttccccagtcggttcaggccctgatcaaagacttccaggggaccccgactttcacctacaaagcgngccatatcttcttcaccgacaactggcccgagcccctgttcagtgagctaggccgctctcgtctggcaaaggtggtgaagacgttgaaggagattcaccttgccttcctcccctacgaggcccaggtgttctccctcgatgctccccacaggaactac

SEQ ID NO: 671907 - DNA, 261 bp, Homo sapiens
caagactgcagccccttgagcggtgactatgtcattgaggatgtgcaaggggatgacaagcgatacttccgtcggatgatctcctcagcaacaggaatttggtgcagtccgaagccaggttgctgaaggatggtttctcacaaagcccagaggagcggaaaaggacaggaagagcagcgcctctgatgcggagacctcctgcagcccggggcagtccattgataagagttacctgtgtggtgacacacacgccatgatcgc

SEQ ID NO: 671908 - DNA, 107 bp, Homo sapiens
ctgcatgagcttagaacgggacgacccacagcctaattattagctcatccctctactattttttaaccaaatcaacaacaacctatttagctgttcccgttgtcgat

SEQ ID NO: 671909 - DNA, 85 bp, Homo sapiens
catggatttgctggtgcagtacaactaggcttaatagggacatgtcaatattctttattaataaaatgtttttcagtgccaaaaa

SEQ ID NO: 671910 - DNA, 332 bp, Homo sapiens
  misc_feature (8)..(9): n is a, c, g, or t
tttccttnnaaataaagtctggttgtcagacgggctccatccgctttccctcagggtgattattgaaggtttggaaaaaatatctaagaagcaaagccagttttttttgccttgtactttgcaaagtctcggcgtagatttcaccctccaaccttagatctccacattcttcccttttgatgtctcatgagcattcaggagggtattctgaactcttcaggctggatccaaagccaaaaaaggaactgtgaaattgtcttaataggtagcttgtcccctcctctgcagccagaaaatctggtagtgtctccagagccctcctcccctgggga

SEQ ID NO: 671911 - DNA, 457 bp, Homo sapiens
tctctgacccccaactagacaaagctcgggggagtgctgctattcccagagcttaataatgacggctaaggacgacccgaacaacagggacactgcagacgcctgctgaaacacaaagacccagcaacaacgcccgtgaccagggcaaggacaagatctgccccaaaagcaaaccttgcaacaagctcaataactacaccttgattgacacagctacctatggctgttagactgtgccatcgaggctacgtgtgcagggcacccctttatgagcttcttagtgatagacttatcaatctgtgtccaaagcacagagctaagtccattacaccgcagactccaaaggtgcagatggtacagctgttggcgaaagagcatgacttgcacaaccggctgtacattttttaaggtgcaggctttcttatttcaatctatttaatatttggtggaattaatt

SEQ ID NO: 671912 - DNA, 199 bp, Homo sapiens
  misc_feature (69)..(69): n is a, c, g, or t
caccgcgccggacccaacaggaaggggagttaagagctcggcactgggtcatacacgtgaggaaaattnagctctccagtgcctatctggagccttaggcagccccccaacctgtgtgcctcaatttccccatctgcagaaagggaataataacagcatcacctgattgttgtggggacaatcaaaggggtcagcagat

SEQ ID NO: 671913 - DNA, 205 bp, Homo sapiens
ccatatctgtgtgactagtccttccaagagcccatggagggggtggtagcataccggcatccctttcccgcatcacgtctcgcctgtcaatgattccatgtatcgtaccgggggacttctgtgtctttgtgatagtcagcagaacaagcaatattagacccccggcccgcctgcaagcgccgcacttctggcacttcgtgggccg

SEQ ID NO: 671914 - DNA, 366 bp, Homo sapiens
ttccttagaggttggttgacctgagtggagcccttccatgccagcgctgacagttcccaagtccttcccaggggaattccagcttcccgtgaccgaacctgacatcaacaacaggctggaatcgttgtgcctcagtattgacggacaagcccttggaaaacgggtttaacggaacttcaacatctagaagctgaagacgagaattaacgcgctggccgtgaaatcgaatgctgcgggtccagtgtccggcatcttcagggttgcacagaatcctccaagatactttgcagccttttttccccctggtccctctcccgttttgattttgtgagagcgtaggtcatcctcgtaaacatatcagtagaa

SEQ ID NO: 671915 - DNA, 1524 bp, Homo sapiens
agcgggaggccgtaggaggaagatggcggtggagtcgcgcgttaccgaggaggcaaattgaagaaggagccagaggaaaccgatcgtaccgccggagcaagacatgcactcactgtgcgctactgggtcttcgagccacacaataacggcgctgccagcgagcatgaagtggtacgagattgctctccagggggaaattggtaccgtccagaccgagtttgcccagaatctaacacattgggatggactggcaacctctagcaagacggaaatcgtggatgcacagagcattacgcgtacagccaggacacggttcctaatccgcgagtgagacggtctaggacagagaagagggagcagcattcggggtgtccctagtttagatggcaaacactgcgcacaacgttaccgatggaattgcgtcaaacacgcgaaccccctggagcgctaattcacgaagtgagtttgcaacggggcacgtcacgttgggtcgctagaccagctacagacctgggtataatgggcaggcaacggctaaaccacgcggtggggaaacacttggcaaccttgcaccatattcgccgatgttggcaacccgcacccgattggcatccatgcaaagtctcgtcccatagctgaccatgctctgttcccccaaaggtcagagaatactgagcgcgcaaccgcgaacgtagtgagaaccgttccttgtgtgtgcaaacgcccaatttacgcgcccgaccatgtgcatagagcgcccagagcaacttcgcgcgagcgaacactgttcacgcgaggcgggacacgaaatgcgccgagctagtccattaccccgccatgttcgcgaagctggtgagcacaggggctccagattttgagcagatgcaacctgccgcagcgttcaagttcgtgtcggagcaagcttgctcccgtgtgaacacatcggtcgatccagctcgtctcaacgttgatatcccggggcctacatcaggtaaagacagtctctggaatcagaggcatccgtagcgacagtcatgccgaccccgcagtactcacaggcagcgtacactaacgcgttggaagtagcaatgccagcagagtaaacgagactcgccaagtaaagcgcgctgcctgctggagcgcattcacaagcacactgtcctcgcaccgcggctgtgggacacgacgctaaagacttactagcggcgcccagcgaatacctaatcacacggaccgaccgtaactatacaacaaacaaccttactacacgtcaaaaacacagagcgacacaacaacttctctcacatactaacacgtttgggcccagaatgtacgacaatccccccctcaaccttagttactagcgagtcaaaaccacgcattacctcaccgactcatactcccacacgcgacgacagcttgttcatcggccactacaaccccacgccgctacgcctttcgaacatcctacccacggaaaaccctactcatacgcacacactaacgcccaacactccgcctccc

SEQ ID NO: 671916 - DNA, 333 bp, Homo sapiens
  misc_feature (195)..(195): n is a, c, g, or t
  misc_feature (243)..(243): n is a, c, g, or t
  misc_feature (258)..(258): n is a, c, g, or t
ggagggatagcaccaggagatatacctaatgtaaatgacgagttaacgggtgcagcacaccaacatggcacatgtatacatatgtaagaaacatgtacgttgtgcacatgtaccctagaaattaaagtaaaataataattaaaaaattaaaattaaaattaaaaaaaaaaaaaaaaagcccagaaagcaaatctngccagcttggcttttcatgtcctctttaaccagaaagtagcttaaagncaaaatcttttctanggttttattaaatgttcaaatacatgaaatcttttcctttctatttcactgataatttttatgacgtctaggagg

SEQ ID NO: 671917 - DNA, 495 bp, Homo sapiens
tatctcatggattctcgcgtcaccctcgtcagcgacgatcgctccaggcttcgctccccgacaccctgctatggacccgatgtggctgtatgctcggcattcacaccggtgagtggaccgcccatatttttgaatacgccatgtccttcgagggcaatatgacgcaagtgccgtgagctcgctgccgccaacggtgtcggtgtgctgcatcccccaggcgccctggccaccgatccgcctggtctcatcgtctgcgacgttgactcgaccgtcacacgcaccgtggccatcgatctactcgccgattgcgccgggaaagccgatgaggtccgcgagatcaccgcccgcgccatggtcggagaactggacttcacacagtccctgtacgcccgagtcaggtatctggaagggttgcatatcggggccctcgaagaggcgtggaaagccaccgtcatcaacccctgggacagccgagctaatggcccgcttgcacat

SEQ ID NO: 671918 - DNA, 231 bp, Homo sapiens
agctgcatgccaagataagctgtgttgctctcaatagacattgaagctaagatgatggccctgtgaactgagagttgcagtatctgctcaataaggccaagttataccaatgccccggaccccgcacctaatgtgacaagcactgggaccctgggcagagccaacccctcaatgccatgtgccagatgaccagtggggagacaggtcatccactccagacagcccggtgga

SEQ ID NO: 671919 - DNA, 363 bp, Homo sapiens
catgctactctcttctatgatgtggtaagaagggtagcttggcccaggcgtggtggctcacgcctgtaatcccagcacttggggaggctgaggcgggagaatcacctgaacctaggaggcagaggctgcggtgagccaagatcgcgccactgcactccggcctgagtgacagagtgagactctgtctcaaaaccaaacaaacaaacaagagtcaaactctgtaaaatgtttaaagaggtttattctgagccaaatatgagtgaccaaggcccgtgacacagccccaggaagtcccgagaacatgtgcccaaggtggttgggttacagcttgattttatacgttttaggggtatggctctgatc

SEQ ID NO: 671920 - DNA, 537 bp, Homo sapiens
  misc_feature (8)..(8): n is a, c, g, or t
ccacgcgntcggaatggcattatgaaggacaccctccgggactgtgaccaggagtccaccgtgctacaacacgggtcactctacggcctaatacgtactatatgagtggtacccttacgagtggcttgtgacgaggcccccagaattacgtaggcgtaagatacgaaacgttggtgttgtggaatacaggcacaggaatgtccttagaaattggccaacaggcgaacccgtgggcgggcaagcggcgaacgccaaggctcacaacccaaaagcgcgcaaggggccccgcacaaaggcgcgccacggagcacaagaggcccccagggacaagacccgcttacaaaggacgaaaggagggccaacttggggacaaggcccccattgggggggaaaccgggcccgcttggggggggcaaaggggaaccttggaacaaggaacaccgtcagacaccaccaagacaccgcgagcatcgacgcacacatgtgggccagacgccgcatgtccatcttgggacacctggagggaatcagacaggg

SEQ ID NO: 671921 - DNA, 769 bp, Homo sapiens
  misc_feature (9)..(9): n is a, c, g, or t
  misc_feature (67)..(67): n is a, c, g, or t
  misc_feature (69)..(69): n is a, c, g, or t
  misc_feature (96)..(96): n is a, c, g, or t
  misc_feature (99)..(99): n is a, c, g, or t
  misc_feature (115)..(115): n is a, c, g, or t
  misc_feature (126)..(126): n is a, c, g, or t
  misc_feature (145)..(148): n is a, c, g, or t
  misc_feature (155)..(155): n is a, c, g, or t
  misc_feature (160)..(160): n is a, c, g, or t
  misc_feature (168)..(168): n is a, c, g, or t
  misc_feature (178)..(178): n is a, c, g, or t
  misc_feature (182)..(184): n is a, c, g, or t
  misc_feature (187)..(187): n is a, c, g, or t
  misc_feature (195)..(195): n is a, c, g, or t
  misc_feature (197)..(197): n is a, c, g, or t
  misc_feature (209)..(209): n is a, c, g, or t
  misc_feature (214)..(214): n is a, c, g, or t
  misc_feature (216)..(216): n is a, c, g, or t
  misc_feature (222)..(222): n is a, c, g, or t
  misc_feature (317)..(317): n is a, c, g, or t
  misc_feature (322)..(322): n is a, c, g, or t
  misc_feature (324)..(324): n is a, c, g, or t
  misc_feature (334)..(334): n is a, c, g, or t
  misc_feature (362)..(362): n is a, c, g, or t
  misc_feature (366)..(366): n is a, c, g, or t
  misc_feature (378)..(378): n is a, c, g, or t
  misc_feature (390)..(390): n is a, c, g, or t
  misc_feature (397)..(397): n is a, c, g, or t
  misc_feature (408)..(408): n is a, c, g, or t
  misc_feature (412)..(412): n is a, c, g, or t
  misc_feature (424)..(424): n is a, c, g, or t
  misc_feature (439)..(439): n is a, c, g, or t
  misc_feature (443)..(443): n is a, c, g, or t
  misc_feature (448)..(448): n is a, c, g, or t
  misc_feature (454)..(454): n is a, c, g, or t
  misc_feature (456)..(456): n is a, c, g, or t
  misc_feature (458)..(458): n is a, c, g, or t
  misc_feature (463)..(463): n is a, c, g, or t
  misc_feature (539)..(539): n is a, c, g, or t
  misc_feature (591)..(592): n is a, c, g, or t
  misc_feature (596)..(596): n is a, c, g, or t
  misc_feature (624)..(624): n is a, c, g, or t
  misc_feature (645)..(645): n is a, c, g, or t
  misc_feature (654)..(654): n is a, c, g, or t
  misc_feature (660)..(660): n is a, c, g, or t
  misc_feature (666)..(666): n is a, c, g, or t
  misc_feature (686)..(686): n is a, c, g, or t
  misc_feature (689)..(689): n is a, c, g, or t
  misc_feature (694)..(694): n is a, c, g, or t
  misc_feature (700)..(700): n is a, c, g, or t
  misc_feature (769)..(769): n is a, c, g, or t
ctgaaatgnaacagcctcttgagtgacttgagcggcatgttactggggttctgtaaaaagggcaggntnctccctcctagccctgaagcctcatgnacntgtcttgtaagataanctctctaatantcaacttgcagggtctcgnnnnaacatcnaaganttggtagnatctcctttntccnnnaanccagctgnanctcaactaatcntaaangnaaactnaagaacagctcaccagatgccacctgttgtttgtcagggtttcaaactccagaggaaatgcatttgcctgtgatggttttcctctctaagggcanctgtntnaacttggagntgtgctttcactggtgcctcatggggcntggncctactctccanctgaattcacanttttctntataagggatnaggnggggaataagtncaagaaggtgacaanaggntcccntgcaananancttgntcattcctggcaggcatctcccacaatgccccagtagggctggctgaggccgggacagcttaaggtcagagaaagngcagaggggtgcttggaagtgctcatcactcaggggagctggcatgcccggnntganaggcagcctgatcagtgctggtacaaanacagccaccctgcgccccttntcgatcagnggctgntgtttngaagcagctcgtcggcacanctnctttnttgcangaaatgttttgtatcgggccaatgacttcagttttccttgcctggagatgccttcatgaaggaaggggn

SEQ ID NO: 671922 - DNA, 258 bp, Homo sapiens
  misc_feature (22)..(22): n is a, c, g, or t
  misc_feature (237)..(237): n is a, c, g, or t
tatccatgtagtcaaatctagnggaaaaagcaaataaaaatagtaaaatttggccgggcacagtggctcacgcctgtaatcccaacactttgggaggccgaggcgggccgatcacgaggtcaggagatcaaggccatcctggctaacacggtgaaacctgtctctactaaaaatacaaaaaaatattagctgggcgtaggtggtgcacacctgtagtcccagctacttgggaggctncaggcaggagaatggtgtaaa

SEQ ID NO: 671923 - DNA, 380 bp, Homo sapiens
tactactactaaattcgcggccgcgtcgacgtggggatgatgatgggtgatggagtgtggggatgatgatggagtgtggggatgatgacgggtgatggagtgtggggttgacgacggggcgtggggttgatgatggagtgtggggatgatgatgggtatggagtgtggggatgatgatgggtatggagtgtggggttgatgacgggtgatagaggagtgtggggatgtgatgggtgatggagtgtggggatgatgatggaatgtgggattgatgacggatgatggagtgtggggatgatgatgggtgatggagtgtggggatgatgatggagtgtgaggtgctttctgggctggaggtcgacgcggccgcgaatttagta

SEQ ID NO: 671924 - DNA, 362 bp, Homo sapiens
tggcaccggtttcagccccaaggacgtgttggttccctggctgcaggggtcacaggaattgccccgcgaaaagtaccttacttgggcatcccggcaggagcccagccagggcacccccccttttttgtgaccagcatactgggggtggcaaccgaggactggaaaaaggggggccccttttcctgcatggtgggccccgaggccctgccgctggcctttacccagaagaccattggccgcttggggggttaacccccccatgtcaatgtgtttgttgtcatggggggggtgggcggcccctgtttttgagccgcccgcctgtccccccccctgaattaactccatgctccccccagccgcca

SEQ ID NO: 671925 - DNA, 407 bp, Homo sapiens
tgagaacggagtcttgctttgtcacccaggctggactgcagtggcatgatctcggctctgcaacctccatctcccaggttcaagcgattctcctgcctcagcctcccaagtagctgggattacaggcaggcaccactatgcctggctaattttttgtatttttagtagatatggggattcaccatgttggtcaggctggtctcgaactcctgaccttgtgatctgcctgcctcggcctcccagtattgggattacaggcatgagccaccatgcccggccttaaaatgccttcttaaggaaaaatgccaactccatccttaatctaaggaaatctgattgtccaatagatctgttaatatgtaacatattaataggtacttgcctgtgtaaaatataagccatattta

SEQ ID NO: 671926 - DNA, 416 bp, Homo sapiens
tgtgcctagttaatgcatgggcagccaggtttttgagggtctcggctccctctgactccagaggcgtctgctttgagccacactcagggtgacagcagcttccctggaaatggcagtggtttgtgctgagacaaacatttctcctcttccttctcccccatccgcctctcctgtgagcggggtccagtcccggagcttcagccaggaaatgctccttgtgtgtccacagccctgctcatcagcagtggaatgagaggcccagagtccaaggagcagcagatgggttccatcaggggctgctggactgtggtcagaactcaggcagtcacaagtgtgtttgtctctccagagacagaaggagagggcggcatcacagtcagctccaggaattcccctgcatttaacgcacacgttca

SEQ ID NO: 671927 - DNA, 790 bp, Homo sapiens
ccgcgcgctcgcagtctgtctccgccgctcccacgcacgcgtccggctcacgcgtcgcagcgaggcgaggctgctctgggtgagtggctgacagtagcaggtctgcggccaccagctgctggatgtcaccaagaaggggctcgagtgcccctgcaggggagggtccaacgtctccggtgtgagcccgacctcgtccctgttctccattctgcgtttcgttcccacgacatgtgtggcctgtgccgccaggctccccgtgagtctccgtcccctgtatgccacgtctctgcccacgtacctatgcttctagaaatgcccctcacctctagtgaccccagaggtgaccatgcatgagaggcggcacgagggcggacgacgcggggtaactggatgtgccaatgccttgcaacgctttcatggaaattcttcccatgaggggtcccagtgatcccctgctactccactgacctggaacgatgcttgtcgtaccaggcacacacacactgttgagggcaagccctgagttggtgagggagccactggagacccccaattctcccttccatggtcagtgaagcgcgcgggagatatccaagcttatagacggattgcggtcgtgatggatcaatctgaagcggcactctcatgccaaactcccacaaggagtgaggattgacgcctctcctttgccccagtccctggattcacgtgggaaatgcacatgaacgtggaggctgaacaacaaccctccaaaaaagactgatacctccaacggtcaacataagtcccg

SEQ ID NO: 671928 - DNA, 272 bp, Homo sapiens
cccagcttcgcgagacggagacggaggctctcctggggtctgtgttcaggagcagggtctgtgtctacagatggctgtggcccctgcaggcagctgttgaacactggagggtcccccggaccacactggggtgggctcctgaggacgtgggctgcccgtcttgcgggggctgccgtcttgcggcgcagcccccgcaagacgcagagatgcccctgctggccgcaaagtgggtctcattgctgcccgccggactggacgtctttcgagggctg

SEQ ID NO: 671929 - DNA, 159 bp, Homo sapiens
ttgtgtgcctaccttactagctcatatgtactaggatctatatgaggtaaagaggtaggggcaaaagggtttgggttgtagcatgcttctatagatctagggcaagggcacttcaatgtatcacatcttgtgggcataccatgcaaggtgtgggataag

SEQ ID NO: 671930 - DNA, 903 bp, Homo sapiens
  misc_feature (263)..(263): n is a, c, g, or t
  misc_feature (607)..(607): n is a, c, g, or t
  misc_feature (736)..(736): n is a, c, g, or t
  misc_feature (799)..(799): n is a, c, g, or t
gctgtagtggcttcgtcttcggtttttctcttccttcgactaacgcctcccggtctctgcgtcgacactcccgccggtccgtctccttaacagccgaacaccatgccgttcaattcaagttgctacgagttctgattggagatgatatttagtaacgttagatgtggaaattgccaagatcaatctgtgactattaagaccatgttggcaagatttcgggaatggatgatgaaggagtatgatgacccagtatcctctaccanatgtgaatgcagcaatattaaaaaaggtcattcagtggtgtcacccaccacaaggatgaccctcctcctcctgaagagatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaantgaaatgttgtgcctgacactgtaacactgtaaggattgttccaaatactagttgcactggtctgtttataattgttaatattagacaaacagtagacaaatgccgcagcaagtcaattgtattagcanaatattgtcctcattggatgggtagtttgagcacagatcccaaaccttacggcaagtttcttntagtatgatggaaaggttctttttttctttgctctgaataaaactgaaccgggggtttctttaagtgggtaaaaaaaaacaaggccccgttggctcaccgaggt

SEQ ID NO: 671931 - DNA, 278 bp, Homo sapiens
cggcgccgggtgccggagcatcgggcgaggacgatctgatcgcgcgctactttcgtccgctcgcgaccgatccgggtgctttcggtctcgttgatgatgcggctctgctgaatcactccggcgatgatattgtcgtgacaacggacgcgatcgtcgaaggcgttcatttccttcccgatgacccccccgacaccatcgcacgcaaggcgctgcgggtgaatctgtcggacttggcagccaagggcgcttcgcctgcgggttttgtgctgacgcttgcg

SEQ ID NO: 671932 - DNA, 520 bp, Homo sapiens
cccttcttcaagtaataaaaaaccctgccttttttcaaaagtgaatttggtactgaacaaccaaattaagccaatgtgtcggtcgtgaggacagttacataagaatccccccattcgggcttaaccgttgtgaataagtggtataaacagctttccgttaatgtgtacatttctcccgagtgttgaatgtgcgcgactgaccaggttcggaaacagttattctgttcgtatttctttaagtagaacttatgtagttttctaaattatagcacgttcccttctgttttgtacatcaatgtgccatcgagctgttaatgccatatcaaaataaagggtcctgcgtaaggtttctttcttaaaacgcagaggtgctttggctgcacacttgtcttcataacccctcggggcgcagagcgtcttgagccctttccaaggtgtgacacctcttcaagtcaattttttgaaaggcaaaaaaccaggcctcgactattcgttgttatgtactgcacagtgtgaactg

SEQ ID NO: 671933 - DNA, 679 bp, Homo sapiens
  misc_feature (48)..(48): n is a, c, g, or t
  misc_feature (53)..(53): n is a, c, g, or t
  misc_feature (66)..(66): n is a, c, g, or t
  misc_feature (71)..(71): n is a, c, g, or t
  misc_feature (383)..(383): n is a, c, g, or t
  misc_feature (512)..(512): n is a, c, g, or t
  misc_feature (575)..(575): n is a, c, g, or t
gggatggggcgggccccgcagggggaagaccagactcagtttttaggnacggnccttggcggagtncattncagtggtgtcacccaccacaaggatgaccctcctcctcctgaagagatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaantgaaatgttgtgcctgacactgtaacactgtaaggattgttccaaatactagttgcactggtctgtttataattgttaatattagacaaacagtagacaaatgccgcagcaagtcaattgtattagcanaatattgtcctcattggatgggtagtttgagcacagatcccaaaccttacggcaagtttcttntagtatgatggaaaggttctttttttctttgctctgaataaaactgaaccgggggtttctttaagtgggtaaaaaaaaacaaggccccgttggctcaccgaggt

SEQ ID NO: 671934 - DNA, 333 bp, Homo sapiens
agaagcataaaaaggcattcaaggactgttgaatgctgactgttcaaactcctgtcattacaaaacaacgggggacctattgcattcacaatgggacacaccaaaaaaaggcaacaggagtgtgagctgaatgcccatagcaagaagcccgatcactgtgtccctgcagaatgcatgatattcacaaagaagaaaaatatacagccacagccatgcagagaggataaaatattaaatgatctaagatctgacaatatacttgccttccaaatgtcactattaatctctcccccattcagaacagcataatcactccatggctgtttctagaca

SEQ ID NO: 671935 - DNA, 310 bp, Homo sapiens
ttttcgtcctgtaaagacgtgttgctatggcagaatccaggcgcaggtcacagtccatgagccatgagagcacagtggaggaggcgggagtcacgcggcttcctgcaggacggcctcgtgttcacagcacacactggctgcgctgcaactagaggaaccgcggctcacactctgggagtcctgtagctcagctgcgggaacatgcagtgcggagtcctgtccccctggcatagacatggcattgcgggcccttaaagcggcaccaccatcaaaaagggctgcagggacccccgtgaacgatctgccttgg

SEQ ID NO: 671936 - DNA, 231 bp, Homo sapiens
ggaaaaaaaaaaaaaccccccccgggggggggttaagagaaaaaaaaagggcaaattttttgccccgggcttttttttccccccggggtttcccaaaaaagggggggtttaaacccccatttccgggggtttttttttttcccccccgtttcccaggggaaacccccggggggggttttttgcccccaaaaagcccccttttttttttttaatttccccccggggccccca

SEQ ID NO: 671937 - DNA, 496 bp, Homo sapiens
  misc_feature (286)..(286): n is a, c, g, or t
attgcaagacagtttgtcctcctcaatttggtttatgaacaactgcaaacccctttctccctgatggccagtatgtccccaggattatgtttgttgcccatctctgacagttagagccgatatccctggaagatattcaaatggtctttatgcttcggaacctgcagatacagctttgttgcttgccaacatgaagaaagctctcaagttgctgaaggctgaattgtaaagaaaaaaaatttccaagcccttctgtttgtcaggccttgagacttgaaaccaaaanaagtgtgaaaagactggctagtgtggaagcatagtgaaccccctgattaggttatggtttaatgttccaccaactattttttaaaaaaaacaagttttaaaaatttggtttcaaggggacatgtgtgaaaccaatattgtatactcccatagtgagccatgattttttaaaaaaaaaaataaatgttttgggggggttttgttttttcca

SEQ ID NO: 671938 - DNA, 921 bp, Homo sapiens
  misc_feature (123)..(123): n is a, c, g, or t
  misc_feature (908)..(908): n is a, c, g, or t
gcacgagctttcaaatcgttattaatatttcctctgccctcttcaccttatagctttaggaaacactactctattcatattcaactaaaaaagtagtatatttccttccgttagaattgtggnacaaaccagcgcaatataaaccctgattgcctcatgcgagactttcagtaaacatcaatctccatacatatcctatcatccttaattggtagaatagacttgcatttagtccgacgaaagtctaccacttcaacttttttttatcctttttatattaggacctggcctaccattcttctgttgttcttaatattatcttacgagcattatatgagttttcatgaactttaatgtataccaatatacctctacaaattattacagcgtaaaagcttgttcaaaccggcactcaatttactagcgttcatttcacttagactcaggttggttggaaattggttaaatggacagaccgtgttccatctcaagaatttactgcacaacgctaatcaagaactaactgtcgaagtaattagcggtttgaacgcgcttgacaaatgttctattgaaaaagtgatgtcctctgaagagtaaaggcactatggggcgttgcaactaaaggaaatattagattcatcaacagtgagattttttcataaaacatgagtctatatcaggtgaaacagtttgagacagccttaatatggaactgaaaaagcaaaatcaaaggcaaaagtttctcatatatatatggcattgttgatcacccagtgcaagcccaattttgcttatgctttttcttaaactgtttttgacaacaccgaggttttcgctgcagaaaaggaacatatggtggtaatttgtgcaaggggttaagggtccaaaatttgctgccatgtcgctcncagcagcaaaagg

SEQ ID NO: 671939 - DNA, 169 bp, Homo sapiens
  misc_feature (80)..(80): n is a, c, g, or t
  misc_feature (82)..(83): n is a, c, g, or t
  misc_feature (156)..(156): n is a, c, g, or t
tggagacagggtctcgctctgttgcaccactgcactccagcctgggcaacagagcgagacctgtctcaaaaaaaaaaagnanngcaatgtttatattataaaagagtgtcctaacagtccccgggctagagaggactaaggaaaacagagagagtnttacgcaggagca

SEQ ID NO: 671940 - DNA, 550 bp, Homo sapiens
ggtcgtcatccgcggcgcggcggcggctcgtggggtttcagcgagagtcttctagatccgaggcgctgcgggacggtcattatatttaggagagaagcagatacagaagtacaccaggctgactatcccaaagattagtgtcatagatacttggtgtcacatgaaccagacctacaggacgtacacgagtgtccacgagaaagtggactcagagttagcttgcggaagacgctggggtctcaagcatgtcgacatgttggacgtctggactgatgctggaagtggatacgaaaatgtagaagaatcaatggagcagcatcgactcttccggagcatatggctttcaagggcacctagagaatgagatcccagttgagatctggaagtggagattgaacatatgggggctcatctcgatggctatacctccagagagcagaatgtatactatgcccaaagcattctctagaagacgttgccgaagagctgtagaaattcttgcatgatagtaatagcgaaagacagcatcattgggcagaagcagagatgg

SEQ ID NO: 671941 - DNA, 295 bp, Homo sapiens
cagtgggtcagcagcacgcagggcagtgcagtgcacatgcagtgggctaccagcagggccgtttgctggtggctcacgcctgtaatcccagcactttggcaggccgaggagggcagatgatctgaggtcagcagttcgggagcagcctggtcaccatggtgaaaccctgcctctactaaaaatacaaaaacaaaattagccaggcgtggtggcgggcgcctgtcctcccagttcctccgacaggcttaggccgggacgaactggtgacgacacctacggacgcggacgaacttcg

SEQ ID NO: 671942 - DNA, 605 bp, Homo sapiens
gctacggcggctgcagggctccggcaaccggtccggcaacgccaaccgctcccgctgcgcgcaggctagggcttgcaggctctacaggctagcagcgctagggtaggactctaaggatcctggctataccaaacatagtaggcaagctactagaggcctacccctctagctagcctaagctaggtagtttagggccaaataggcccctggacgcacgggccccatattattaccaattcgccccatgttcccgtgacttgcaggctaggggtacaagcttaatagttccgaagcaaaacccggcacattaacccaaacggattcgaggccatccaagcccccggaatgtggccaagctaatacccgatataccagataatcaaacaatccgcatcatggtacaaccccacttttggaaaggccccttaacccttattggaaaaacctcggaaaaagcgtggctgtataagtatgggactttggaggaattaagcgcccgataatacccccccattagcaacggcctaaggcgggacgcacccccccaacacaggtcccccacaatcgagcggcgaccaaagtggaaccgagtaacggcgttttcc

SEQ ID NO: 671943 - DNA, 438 bp, Homo sapiens
gtagcgcatctcttcgcacagtgggctcagcttctgttcaagctcgtgcagcttctggcgcgtgacctcgtgtagctctgtggtcactggctagacattcggctggtacagctaaagtccgcatggcaggtcttaggcaagtcgtacagtatggcagcactccgtcctggacctgtgtcacatcaacgctcatctccagcctcaggacttctgtctcagctttcgtgttaacataatgctcccaggtcacaggtacaagctgttcgcgcagctttcataaggcacaggtagctgtgtatcagtcgtcaagaagctaaagggtcaatctgagctcacaagtgtggacagtctgaggttgtacgcatagtccatgactccgtctttgagcacatccaagtacacaatggccaggtcattgatcagatctcagtggctctg

SEQ ID NO: 671944 - DNA, 211 bp, Homo sapiens
gcgggagacagttgctcctcttatctcaacggcgaggaggcttcctctttcactaatcctcctcagcacagaccctttatgggtatcgggctgggggacggtaaggtctttcccttcccacgaggccatgtctcaggctgtctcagtggggagaaaccttggacaatacccaggcgttcttgggcagaggtcccggtggcatcgataaaca

SEQ ID NO: 671945 - DNA, 624 bp, Homo sapiens
  misc_feature (113)..(113): n is a, c, g, or t
aagcttgtccacccatttgggttatacgtcttctctttcaagctgatggcctccaagcttcaaactcatgtcctggatcaccatttgtggtgatgcacagtcagtttgctcanagcttaatgcagtcgtatagcagtctgagacttcgtgtattgtccaccaacactataatgctgtttccagccagcgatcatattagtgagccatctcgtgccatttcttgacatcttgtctcggcttcatgtcatcaagcagtacaagtgtcctacatatgataatgagctatcattgtgctgctataactataagatagctcggtagatggttcaggtctctttcactattgtgcctagtgagtttgagcacctgcatacattcgtctctgtagtccgccagagttctatgagttccctagtactagtctgtctccgtctagtcttctgttcccatgttcagcgtgactgtggatctaaactgatgtgcctgctacaaaagttctatcgtttgaccctcaaatgccacttcgaaatggcttcagttaatggcatgcgttcaatgtcctccacggttcctccaagctatgtgcacgtacctgttcatgaggttaggcactagtccgttctc

SEQ ID NO: 671946 - DNA, 140 bp, Homo sapiens
ctttcaatgaaattgtgatcctttcctaagaaaaggtaaaattccctatcatattttgtgtcccccccttgatgttacatgactttggaacaatatgaactggatttaagaatgttataataaaagtcttacaaaatgga

SEQ ID NO: 671947 - DNA, 932 bp, Homo sapiens
  misc_feature (932)..(932): n is a, c, g, or t
gaaggactctatggttcttacgcgcgcatacagaacgcctatataagtccatgcgcaggaggaggagcgccatctttcccttcgttgtgccactgaaccatcctgttgtcgacatgctacagctgcccggccgttggtaatccgggatcgtaggaacctgtgccgtatcccagtagtctcagccttcgtgccggaggtggtccctgagtgccgagatgcgcatggtttgaccgtggggcgcgtggaccaggtccgagtggttgggtttcgcgctatgtggccacgtgtttgtctgatgatatgagcagcgtgttcctctggaatgccctggaggctgtccgagtgtgttgcctggtaaggatacctggtttggctgttgtgtcacaaagatggcttccactatccgggggtgcggtcgcaactccttcacacgtgtatccgcattcactcctagatgttgtcctgtgtcctgggagcgtgaaaggtacggaaagagggcatgcagagtgtgccttagataataggcccagggcaacttgtggtctcggttcacatagggcgaagttatcatgtaccatccgcacaagggtgaataacagaggcgcttgtgattgacagccctggcacggcccatttcaagtttcctgccgcagtagattcccatttccaggaagtggggttcccagattcaagtggtgcattcgaaacttggtggtgaacagcggtcaccccatggtggggtcaggactcccacgggggctctggagtgggggccgaccctgagggctccaaggggcccctgtattccaattccttgcgcagagagaaacaaattcgcggacgcaaatacatgccggccgaaagactacacggaagttacaacgcctcgtagggtatcaaccgagcagtgtccagacatctccacttcacan

SEQ ID NO: 671948 - DNA, 167 bp, Homo sapiens
tgggggttggttttccccccccccccccccgcgttttgaccccatgggggtggtgcccccttggcccttcccattttttgggcttgggtttcttggggggggggccgtttttttttggaaaacacctttttttggggttttttaaaaaaaaccccctttttccccca

SEQ ID NO: 671949 - DNA, 899 bp, Homo sapiens
  misc_feature (412)..(412): n is a, c, g, or t
  misc_feature (501)..(501): n is a, c, g, or t
  misc_feature (553)..(553): n is a, c, g, or t
  misc_feature (573)..(573): n is a, c, g, or t
  misc_feature (579)..(579): n is a, c, g, or t
  misc_feature (650)..(650): n is a, c, g, or t
  misc_feature (669)..(669): n is a, c, g, or t
  misc_feature (766)..(766): n is a, c, g, or t
ctcctacagattgtgttagtttctggggaaagaatagtaaccatgcgatggaaaaaaatggacaacctcttgactaggttatcaaaattaacctcaccaataaagggtggatgttcaacatgtgccttcaaatgtgacccactgagaaggaaacaacatcactgtaacaacaacaaccagaaacgacagggggttttgactgaattcttcaaaaatgtcaatgtcatagaagacaaagaaaggttgtggaaatgtttcagattaaatgatagtaaaaacacctgacaactaaacatagtaagtaatactagactggattctgtaccagaggtaacataagtgctccaaaggacaatgttaggtcaactggcaaattggaatatagacagtcaatcagataagaagtatactntgattaagtaaaaaaaatccctattcttggaaaatacacaataaagtatcttgaggtaacgggccataatgtatgcaatctactctcanaaaattcagaaacatatatttggttgcattgcatgtgcaacagtacacacanacatacttaaagagagcaantgatanggaaataaggtacatttacaatatctgttcacataatggagaagagcactgttaagtattgagtaaacttnaacatatctgagcaaaggntttgcgtttctttggacagctgatcttgaactattctgtagtgaactatatcaacatggtgaaaaaacccgactggcaactctttctttttacctanaaggctgggtaagggctttaattatgtggggtggtggaatggggttgtgccggttcaataccaaaacaagtaaaactgcttgtattttagagattggtatccactgttaaaattttctaataattattcttct

SEQ ID NO: 671950 - DNA, 295 bp, Homo sapiens
  misc_feature (262)..(262): n is a, c, g, or t
agaagaaggcttcagacgatcagacttctccgagctaaaggaggaagttcgaacccatcgcaaagaagcctaaaaccctggtaaaaggattaagacaaattggctaatggattacccagtttaaggagaggccttaaaaatgacctaagtgagagtctgaaaccccatggacagcgagacacactctcgcgtgagagatgtgcacagcgctcaaagagagcaaattgggactccatttgggagagaagaggggtatcattgntattaagggctcacattaagtgatatagggtga

SEQ ID NO: 671951 - DNA, 208 bp, Homo sapiens
tgtttttccttgccaaccgtccctgagcctccctgccggagtcttccttagagagctggccgtgctccccatcccctaagtcctcaccagccccccagactgtgtgaagttacagttcgctcctttcgggggggcagcttcaactctctcgctggtagtcaaaaccttccccacccatagttatgtcctacatccagtcactcccaac

SEQ ID NO: 671952 - DNA, 126 bp, Homo sapiens
taatgctcatcccattcaacatcccagtccagccattcagtatctgttccaccatcacaggtcacatcgccgcagtgtcaggtcacactggggcatcacatgttttcctatttcagggcatgcagt

SEQ ID NO: 671953 - DNA, 183 bp, Homo sapiens
tctgtaccatataatgatatagtaattcgctttgacagatgcaagtcttccgcatgtactgctcggaggttgggttcttgctccgaggtcgccccaaccgaaatttttaatgcacgttcagtactttaggacctgtgagtttgttaggtactgtattgcattcatatattaaagctccatagg

SEQ ID NO: 671954 - DNA, 333 bp, Homo sapiens
atgttgcacatagtacgatttgcaactctctgcccaaaatatgatgttgtgaatcacttggctacatgcatcatatactagctacttcttgtatttttactagtgatagggcttcctccatgttggtcacgcctggtctacgatcgtcctgacctcaatgtgatccaggcttgccttcgagcctcccatgtagctgtgattactgtgtgctcgtcgtgcaatgccaattttaactttctgtatctgttacaaattgtgttggagaagccgccacaattcttgacgcccagtgtgggagtggccctgtttcccagtcagggccaccgcgggcac

SEQ ID NO: 671955 - DNA, 732 bp, Homo sapiens
gacacagttgagtagatgcaggagctggaaccagcgcttttgggctctggcaggagcatactccatgtgggccctgtggcagcatctaggtgggggtgcctgtggcccccgatcccctagagggcatgttacagtgctcttttagctctgtcatccacgggcggcttaaatgttaactggtcagtgggccctctgcctttttgcatgaagcagctgctctttgccagcgagggcaaaggatcagcatgacacccttttgtatccacacttgcggctcctgaatggtagtgcggcatccaggaaaaataaggtctcactaacgaattgaaggatggtaaatgcaggggattattactattttttattttattttttattttatttttttgctgatgaaagtggctctcagtgggaagaggagctgaaaagggggtgaggtggggcagtgacgatggaagaaaaaggcaagattcactttgggaggctgaggcgggcagatcacgaggtcaggagatcgagaccatcctggctaacacagtgaaaccccatctctactaaaaatacaaaaaattagctaggcgtgggtggcagacacctggagtcccagcgactcaggaggctgaagcaggagaatggggtgaacccggggaggcggagcttgcagtgagccaggtcgcgccatacactccagctgggcgacagagcaagaatccattcaaaaaaaaaggcccg

SEQ ID NO: 671956 - DNA, 286 bp, Homo sapiens
atgaaatccttctagtcaaatgagccacaattttgtttcttccttgagtaaaatcaagaaacattttcctctggaaaaaatatccatattcaaaatccactaataggtggtctttttcaataaaaaaaaaacaaactgggaaacttgcttttggctgtcactgttttttgaataatgtatcatattgctacattagctggtaatgtgtcatgtatgtcttcatggagccaaagcaattatggatgtttctgaaataaaaaacaaaacaaaaaaacgtttgcggccg

SEQ ID NO: 671957 - DNA, 178 bp, Homo sapiens
cccacctggactatctgtatcaccttattatttttgcttcatatattttctcatgcaatttttgtatcagatatcaaccgtaatctgtaccacagtgttccagaataacggtctcataggtttctaagtttatctacaattgtggatgagatgttggtatgaaataatagtacttctg

SEQ ID NO: 671958 - DNA, 249 bp, Homo sapiens
ggcgggtgattcagtgagccagcaacattgggcatccatcgtatgcctcgctccttgtcaaagatcagtgactatatttatgtgggtctatttctgggctctctattctgtttcatgatctattgtcttttctttcaccaatatcacattgtcttgattactgtagctttatagtaagtctataggttggatagtttcatccctcccatttagttcttccttatttatttttaattattatggtttgag

SEQ ID NO: 671959 - DNA, 156 bp, Homo sapiens
agaagaaccggtttttaaaattctatataaccctattacatttatactcctgatcaagtgttccctaaactcaaatctaaggaaaccttatatctatggcagcaaacaaggtttcctgtgttctttaaaacacacacacacacacacacacatttt

SEQ ID NO: 671960 - DNA, 161 bp, Homo sapiens
tgggatccctggactaaaggtgctgtggagagccctggcaatgctggagagcgaggtgttcccggaccccctggcgctgtcggtccttgctggcaaagatggagaggctagagctcaggtaccccctggccctgctggtcccgctggcgagagaggtgcta

SEQ ID NO: 671961 - DNA, 641 bp, Homo sapiens
gcgacttactccaccagttagagaataactgggatttgcatgaactccatctctgacctgaaatacagacgcggatgttaagtatccttattcttctgattgttattaacgggtccttagtgtctgtctgaagatcgagaagctcaggaggatgaattgctggcccttggcaggtatttacgatggagatcaatttagaaaagcagtgtcttacttatgtgcgtgaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctgcgtctgctgaggaggggg

SEQ ID NO: 671962 - DNA, 681 bp, Homo sapiens
  misc_feature (48)..(48): n is a, c, g, or t
  misc_feature (72)..(72): n is a, c, g, or t
  misc_feature (83)..(84): n is a, c, g, or t
  misc_feature (86)..(86): n is a, c, g, or t
  misc_feature (117)..(119): n is a, c, g, or t
  misc_feature (122)..(122): n is a, c, g, or t
  misc_feature (127)..(128): n is a, c, g, or t
  misc_feature (131)..(131): n is a, c, g, or t
  misc_feature (136)..(136): n is a, c, g, or t
  misc_feature (138)..(138): n is a, c, g, or t
  misc_feature (163)..(163): n is a, c, g, or t
  misc_feature (171)..(171): n is a, c, g, or t
  misc_feature (173)..(173): n is a, c, g, or t
  misc_feature (184)..(184): n is a, c, g, or t
  misc_feature (187)..(187): n is a, c, g, or t
  misc_feature (192)..(192): n is a, c, g, or t
  misc_feature (197)..(198): n is a, c, g, or t
  misc_feature (208)..(208): n is a, c, g, or t
  misc_feature (218)..(218): n is a, c, g, or t
  misc_feature (221)..(221): n is a, c, g, or t
  misc_feature (242)..(242): n is a, c, g, or t
  misc_feature (279)..(280): n is a, c, g, or t
  misc_feature (287)..(288): n is a, c, g, or t
  misc_feature (291)..(291): n is a, c, g, or t
  misc_feature (460)..(460): n is a, c, g, or t
  misc_feature (678)..(678): n is a, c, g, or t
ggtgaagtacaccttcagcttagtccattctcctaagtaaagcctganggaaaactctttacacctaattcnttgtggaaaanngntcaactagccatttcccaggctatagaccannngtncaatnnggngtctngncttaggggcgggggggggggggggntacatttnanattgatcaggnggnggggngaggnngtgcctaagnaatgagaaanggnttgctctaagcaagctgtggngaggcacaggatgactagggaatggcagagaacaggnnggccaanngtnagttcaagcaaccagctgagaagcaggagtctaaaaagccccaaacagaacacctccatggattcagggaagggctgaggcactgcctttctagtatgtgccaaaaaaaacataactctgaattggggcccaggggactttgagtttgtatggggagggaaaaggagtnagcagttctcctcccctccccacagccttaggccaacacaaactgcaaattggtaagcagcaccttaatacctcttgtgacagttacggctgaagtggcagggtcaagcttgtaggtgttggcatccccctttttatatcggtcccggaagacatagatgctcccgttacagctggcaatcttccagagggatggggcagagctccaggcctcagganggc

SEQ ID NO: 671963 - DNA, 249 bp, Homo sapiens
  misc_feature (2)..(2): n is a, c, g, or t
  misc_feature (13)..(13): n is a, c, g, or t
  misc_feature (34)..(34): n is a, c, g, or t
  misc_feature (53)..(53): n is a, c, g, or t
  misc_feature (76)..(77): n is a, c, g, or t
  misc_feature (84)..(84): n is a, c, g, or t
  misc_feature (107)..(107): n is a, c, g, or t
  misc_feature (114)..(115): n is a, c, g, or t
  misc_feature (119)..(119): n is a, c, g, or t
  misc_feature (148)..(148): n is a, c, g, or t
  misc_feature (156)..(156): n is a, c, g, or t
  misc_feature (172)..(172): n is a, c, g, or t
  misc_feature (181)..(182): n is a, c, g, or t
  misc_feature (185)..(185): n is a, c, g, or t
  misc_feature (200)..(200): n is a, c, g, or t
  misc_feature (203)..(203): n is a, c, g, or t
  misc_feature (214)..(214): n is a, c, g, or t
  misc_feature (227)..(227): n is a, c, g, or t
  misc_feature (237)..(237): n is a, c, g, or t
anaaatgggctanattttctacccgggaaaactncgatagcccgtatgaaacntaagggtcgaaggtggatttagnngtaaacngagagtagagtgcttagttgaanagggccnngaancgcgtacacaccgcccgtcaccctccgcnagtatacncaaaggacatttaacnaaaaccccnncgngtttatatagagganacnaagtcgtaacntggtaagtgtacnggaaagtgcncttggacgaggg

SEQ ID NO: 671964 - DNA, 681 bp, Homo sapiens
  misc_feature (1)..(1): n is a, c, g, or t
  misc_feature (66)..(66): n is a, c, g, or t
  misc_feature (68)..(68): n is a, c, g, or t
  misc_feature (70)..(70): n is a, c, g, or t
  misc_feature (76)..(82): n is a, c, g, or t
  misc_feature (85)..(85): n is a, c, g, or t
  misc_feature (89)..(89): n is a, c, g, or t
  misc_feature (91)..(91): n is a, c, g, or t
  misc_feature (110)..(110): n is a, c, g, or t
  misc_feature (123)..(125): n is a, c, g, or t
  misc_feature (145)..(145): n is a, c, g, or t
  misc_feature (148)..(149): n is a, c, g, or t
  misc_feature (151)..(151): n is a, c, g, or t
  misc_feature (289)..(289): n is a, c, g, or t
  misc_feature (658)..(658): n is a, c, g, or t
ncgtcgataatcaaatgttatatatcaacatcgtaatcatcataatcatatagaactgttccagangnanaaaggnnnnnnntgngtgntngctttatagtcatacatangccacagcccctnnngtgggtgtgggtgggggggnttnntntgttcttcatttcaataattttgtcacctcaagaatgtgatataaatgcgatcatacagtatgtgaccatttgagactggtttttttttgttcaccataatacccctgaggtacaaccaagttcttgtatcaacagtnagttccttttcattccagagcagtattccaagtcatggatggtttgtttaaccatgtacctgttgtaggacatctgggttgtttccagtttggggctattacaaataaagctcctatgaatatttgagtacaagtacaatataggttttcatttctctggaatgaatgtccaggagcacaactgctgggtcttatgtttaacttgattaaaaaattatgtttaacttgataagaaattcataaactctttcccagagtggctgtaccattttacattcctgtcagcaatgtataaaatatccagtttgtatcctcatcagtatttggtattttcactattttttctttagccattgagataagtaagtnatagcctcgctgtggtttcaatt

SEQ ID NO: 671965 - DNA, 136 bp, Homo sapiens
  misc_feature (1)..(1): n is a, c, g, or t
nagacccttcggttgtgatcagagaagctcctgaggctttggtgtcagcgttttgggggtttgtttttgtgttgtgtttctgagatggagtctcgctctcgtcgcccaggctggagtgctgttgcgtgatctcagt

SEQ ID NO: 671966 - DNA, 915 bp, Homo sapiens
ggagtggactgtgaagaaacatggcggccggacgttgacttcgaaatgtgtacttccctggtgtccgcaggacctccaccttcgccctcaccatcatcgtgggcgtcagtgtcttcgagcgcgcttcgatcaaggcggcggacgcatatctacggaccacattcaacgaggggaagctgtggaacacacattcaggcacaggtatgagaacaagtagttcctgtggaggggccccccatccgaggccagagaggacccagggtccaaccccaagcaagttgttgtgcccaagagctgtggagcccttcagttgggaaggattgaagtggttacaggggtacctctttcaggtggacccaccaatgtcggtgtgttggggcagggaaaaggcgtttttaattttaccaaaaaaaaggagtcttttaacccttttctgggtggggtaggtatagcgaaacggtatggttaaagggtcaggaagtgtgctccagggaaacattaacattgtggaattgtgcccttgtagaaacaaaactcacaaaagaagaaataaacgaatagcaaaacatattttgtgctgcggacgagcactcggcccgatgagaaaaaacggtttgtttctagaaacaccacatttcttgttgttggcgccgcgctgccccccgtcgaagaggtctatgtgcgtaccacgctgtggccacaaccgagcgggtggcccacagagagagcatcgtggcggcgctacgaccacttgcgggctggtgtgtattcctcacacgaaattacaacgacggccggggggcacacacggacgctgttgttgggacacaatccccgaggtgggattcaggagagaactactcgggggcgatttcacacggagcggtcaggaagtctattattaaatgccgccgt

SEQ ID NO: 671967 - DNA, 797 bp, Homo sapiens
ggttgagaccagcctgaccaacatggtgtaaaaccccatctctactaggaatacagaaaaattagctgggtgtggtggtaggtgcctgtggttccagctgctcaggaggctgaagcacaggaatcgcttgaacccaggaggtggaggttggagtgagccgagatcatgctactgcactctccagcctgggctacagagtgagactctcaaaaaaaaaaaaataataataataagagaaaatagacaaggtctccaggctggtcaactcctgggcctcaaattgatccttcccacctcagcctcccaagcagccgggacatacaggcaaacattcaccatgtccagctgtccccagattacataagtcgggtcttactcttgccccaaaacctcaaaaaggcatgaagccagacccactgaagtgccagtcaacccagacacctctgggcctgcctgtggctctgtggccctcctctgtggcggcaggacctttgtggggcttccagagccctgatcatggggcccagagcgggagcatggtccacatttccacaggccccaaaagccttcaaagatcgggtcaaaggacgctgggacctcccgtgaggcaacagaaagcaggcgcacatgacagcaccccacacacgggctacagaacaggtaaccaataacaccacgacacagaaagaaggaaccaacaaagaccacagaccatacaacctatgacacaaacaaccaacacaacaatgaacacagacccacaaaccaaaagaaacaaaagaaacaacacacaacca

SEQ ID NO: 671968 - DNA, 358 bp, Homo sapiens
aatgtgaatgtactatctcacttttttttctgagatggagtctcgcccgttgccaggctggagtgagtggcgcgatctaggctcaccgcaagctccgcctcccaggtgccaggaattctctgcctcagcctcccaaatagctgggattacacccgccaccaagcccagctaatttttgtatttttagtagagatagggttttgccatgtcggctaagctcgtctgctaaccctagagctgacaggaaggctttggggttgggcggttttacggggaaaatactctgtaacagcgtttttcctttactctcacatggccactcaataccggtattgagtggccatgtgactgagcgact

SEQ ID NO: 671969 - DNA, 387 bp, Homo sapiens
tcctacacttactattctgtcaactttctcgtaccgtatgatcggctgccaacatcactgactgtcaatgattttagacgccctcattaattctgaccatgctcgacggtttaaaatggcatacaataaaatatcatataaacacttgctgggattacaggcgtaagccaccacgcctggacctattagggatctctagaagccgcaagcctcttccttgtcatagctttttcctttgtgtaaaccattaatgcttcagtataaataatatcaatttaaaaactgcctaagatttaaaagtactatgcaaattacaaactgcttgggtatctagatcacaataaagcagagcaaagaagtaactttaggaatgaaggggatcctcta

SEQ ID NO: 671970 - DNA, 1012 bp, Homo sapiens
tccaacctggcgcgttgaacagaggcaagacaccacagtgcgtgtaaccaactaccaatgccaatgcggccagtcccctcatagttgctggctacaatgtgtctggctctgtccgaagtgatggggagcccatgaacggggtgaagtttcttctactatatcttctttagctaactaaagaggatgtcctgggctgcaattgtctcaccagtgcctgggtatccagccccaagacgagagtctggtgtataagtagctacacggtctccagagcaagatggctcgctcctctattctattccttgccaagatgggcgcgctacactgtgatatccgtactatcgaggggagaggattaccttatgatgatggcgcctacacagactatgacattcagagcggagcatgacagctatgcaaacatcgagcccgagataccacagtcatgggatactccgtaccacacgggagggactagaacggaaacagaaggacactggtgtaccaccaagcacagcagacacccatgacataaccaaatcaaagttaaaaccacaagctgatggctcatacagcctcgagacaccataaccaacagggacatacagcatccatgctcagaaagagcaccactacatcgacacaggacaacatcaaaatggcagcgacacacacatcacatggcatgaacaagccgacaccagggataaaaagaacacggaacggaataacagacaacaggaaacagcgaaccgcacacaccacctgaacaaaacaagacgaccgcaactcagaaaagacaagcctggaaacgagggaaagacgaccagcacaaagggacaaagccaacccaggacctcgcacagaacgaaagaacgcagacaaacacaacagaaagagaaacacgaaatacccaaaacaacaaaacaccgccacacaaaacaagaacacaagaccacacaaccccacacacaacaacacaaaaccgaagcaccagaccagacgacaacac

SEQ ID NO: 671971 - DNA, 120 bp, Homo sapiens
ttttaattttcaaaacttaagttttattagcaaatcctcttttctgtaagacttagctaagaagggggaaattttttcccaaaatttttttgaaaacatttggtgttggaactgcccaat

SEQ ID NO: 671972 - DNA, 948 bp, Homo sapiens
  misc_feature (763)..(763): n is a, c, g, or t
  misc_feature (766)..(767): n is a, c, g, or t
  misc_feature (805)..(805): n is a, c, g, or t
  misc_feature (826)..(826): n is a, c, g, or t
  misc_feature (832)..(832): n is a, c, g, or t
  misc_feature (835)..(835): n is a, c, g, or t
  misc_feature (841)..(842): n is a, c, g, or t
  misc_feature (851)..(851): n is a, c, g, or t
  misc_feature (854)..(854): n is a, c, g, or t
ggggagatgacacaaaaccaaaccatatcaggtctttaaagagttaagttaaaataagctctttaaagtgggccctaatccagtatgactggtgttcttataagaagaggagatttggtcacagacatggttgcatgcagaataaagacttttcgaggacacactgagaaggcagccatctgcaaaacaaggaaagagtcctcagcagaaaccagtcctgcagactccttgatcttggacttccagccactgcaattgatgtcaagcttcagcacccttgcatctctggataaatgaaatgtcaccccagctgccgtccttgttcagatctgtgcaataaagagcaaagcataaaaccaagtcaaggctttgagggagtgacctacaaaatgcataatgtgaaacaatgcaaaagcgaaaggtgcaaaatccccatcaaagagctggaggctgacagatgcgccagtgataattcccatcttccaacacaggagcacagcttccattttccataacagaacaacagccagagcagctggaaggcagggccgcatcccagacttccaccaacaatgggatgagacttgacatctggaatcacaaccacaacagacctgagagacccaccagcttgatgacaagcttcttctttcaaagaaaggtatcagtctgggggacctagtgctgcaaaccatgacaaattaagtgtggcatccctcacttgcataatggaactcagtgatatttttaattaacaagagtnatnntatgtaagcttctctcattcctccactgtgcgtgctcngggggctggtggtgaggacangcgacnacngctgtnncgggaagcntcnagacacaggcagtccatgacgtctagagatccagtgacctgtagaaacacgactgccgcgaaaagtattcctacaacaggttgccaatagcaac

SEQ ID NO: 671973 - DNA, 124 bp, Homo sapiens
attagggtcacacgcggctattggcgacgcggttgaacagctttgcgtcgagggtggccatagccttgccgccgacagtgccgccagccgagaaaccggtgatgtggctgcggtaggtgcggcg

SEQ ID NO: 671974 - DNA, 159 bp, Homo sapiens
ggcaccttgctgttacatcattggtgggtcggttcttccaacccagggccgcatgtggcgctcggcgctgcaacatcttgtgtgtgtagtgctcagtgtgggcaagttgttgcatcttccaccacggcctgcaggttgtggcagctgtccagggcacag

SEQ ID NO: 671975 - DNA, 827 bp, Homo sapiens
  misc_feature (726)..(726): n is a, c, g, or t
  misc_feature (742)..(742): n is a, c, g, or t
  misc_feature (760)..(761): n is a, c, g, or t
  misc_feature (763)..(763): n is a, c, g, or t
  misc_feature (779)..(779): n is a, c, g, or t
  misc_feature (781)..(782): n is a, c, g, or t
  misc_feature (790)..(791): n is a, c, g, or t
ggggagatgacacaaaaccaaaccatatcaggtctttaaagagttaagttaaaataagctctttaaagtgggccctaatccagtatgactggtgttcttataagaagaggagatttggtcacagacatggttgcatgcagaataaagacttttcgaggacacactgagaaggcagccatctgcaaaacaaggaaagagtcctcagcagaaaccagtcctgcagactccttgatcttggacttccagccactgcaattgatgtcaagcttcagcacccttgcatctctggataaatgaaatgtcaccccagctgccgtccttgttcagatctgtgcaataaagagcaaagcataaaaccaagtcaaggctttgagggagtgacctacaaaatgcataatgtgaaacaatgcaaaagcgaaaggtgcaaaatccccatcaaagagctggaggctgacagatgcgccagtgataattcccatcttccaacacaggagcacagcttccattttccataacagaacaacagccagagcagctggaaggcagggccgcatcccagacttccaccaacaatgggatgagacttgacatctggaatcacaaccacaacagacctgagagacccaccagcttgatgacaagcttcttctttcaaagaaagtttaggcggtcatgaccatgggatgctggaccaggatggtaagcttcaggaaacagaatctgganaatgcccagctgctcncacaggaagcatcagggnnanaagaagaagaggtgtnanntctgcctnntgctctgtgggattcctttcacatctcctttgcttc

SEQ ID NO: 671976 - DNA, 327 bp, Homo sapiens
cactatcctccaggagagagagggaaactggggtcatcactatcctccaccaggagagagagggaaactggggtcatcactatcctccaccaggagagagaggtaaactggggtcatcactatcctccaccaagagagagaggtaaacttgggtcatcactatcctccaccaggagagagaggtaaactggggtcatcactatcctccaccaggagagacagggaaactggggtcatcactatcctccaggagagagagacaaactgggatcatcactatactccaggagagagagggaaactggggtcgacgcggccgcgaattta

SEQ ID NO: 671977 - DNA, 104 bp, Homo sapiens
acgtatcatagaagagcttatcagctttcatgatcgcgcctcatatcatttgccttatctgcttcctagtcctgtatggccaatacctgagtgactcacaacaa

SEQ ID NO: 671978 - DNA, 203 bp, Homo sapiens
tggacatctagaggacccccttgtgatctcatattggtcacgcatctcgtaagaatgcggctcatgtccacgccaggtgctgcgtccatctccacattgacatctaccacccacctggcctactcagtggctattcatctcctcctacgtgtttcttcttcatggtaggccaggctcctcctgccaggctctcaatcttgcat

SEQ ID NO: 671979 - DNA, 110 bp, Homo sapiens
cttgtcctgcctttggactagctgactctagaccatctcgcggttcctgcggatagcacagcacaagatcatactgaagcccaccagcatcatgagggcgccggtccgat

SEQ ID NO: 671980 - DNA, 532 bp, Homo sapiens
gtgttcttgatgacccccgatgagtaaatcttgtgagacgttgggtagcaagatcagtccactgcactccagcctgggtgacagagcgagactctgtctcaaaagaaaagaaaatggaacatagaacatttcaaacctgagaaatacataaggaaaatggaacatagaacatttcaaacctgagaaatacataaggaaatttgtagacagacactgctttctttaaaagaaagaaaacaggtgtctgcttatccctgtagccagaggatctacatcttctgggggagaaaaacaagggtggaaagtgtaattcaccaaatctcatctttcagcccccataaagacctcacaccctcctgctgctgtgggactcaggaggattttgactaaggaaagtattttaatctcagtaacactgagacatccaacctgagaggaaagtgaggggcaatgaggcaggagttctcctttggtgtgggctcctgggagggctgttgccctgttgtgcaggagcagtagctcctcgggcagg

SEQ ID NO: 671981 - DNA, 161 bp, Homo sapiens
tcgcggtatgcctcgtttgattgtacaaatgaagatgggacgcctatattaaaagcctagaaaaaagtcaggctgttgtcccgtctctgatgcccctccatataccgctacatctgaatccagcacaatattgaatttccctcatccgcgtatcccaggac

SEQ ID NO: 671982 - DNA, 161 bp, Homo sapiens
cgctgagaggactgtatcagcagagaagtgacctggcgagaggtggaagtgcactgaagtggaacgctgagcttatcctgtgtggcctgcaggtgcttccccaacttcagcatcctctagctggccggtccatatgacaccttcattgagcacctcccagg

SEQ ID NO: 671983 - DNA, 142 bp, Homo sapiens
tcagtctacgaacaactctgtgttacaatattctattatgggatcttgaagatccttacttgcttctcctacgccaatgagtctggaagccattatcacaattcactgaatagaattacaggcttactctcgattgtgttct

SEQ ID NO: 671984 - DNA, 334 bp, Homo sapiens
tatatcaggggagagttgactccactacctgctctgcccaaatccttcccctttccaagaagagtttgccatctcctagttttcttttttcttaaccaaactaagtttagccttttaatccttcaccctcctccacttctaatgccattgcttctctgtatgcttattgtattttccatgctatatgactttcagctggttatttacagtatgtaagttttaatatcctgtaaaagggggataataatagcatccgtttgataaagatgttaaagatactaaatgacactgtccatgttaaataactttttgagatatcttggggtaccgagct

SEQ ID NO: 671985 - DNA, 291 bp, Homo sapiens
tgtagccagaccggcccgagcggtgactgcaggtctgtcaacgggtcgcggagttcaaggccgacttggacatactcaacttccttccagccgtctagtttggaatatgggagtactcgtaccaccggttggagaacatactctttgccaaaccgggaatgatgtgactcggtcagtaacggcccaacctgggcttctggaaattcgggaagtaaacgagagatctggagtagccgacggggtaccactgactactgaaacaccagtcaccgtggacgcggcttgtttaca

SEQ ID NO: 671986 - DNA, 124 bp, Homo sapiens
aagagtacgagtctcgtacctcaagatgccgatgtggtgccaacgtctcctccacagcatcggcaataggcgcctcgtgcatggacaccgactcgatgtcgacgagtcgacgaacgagctcgtg

SEQ ID NO: 671987 - DNA, 753 bp, Homo sapiens
  misc_feature (113)..(113): n is a, c, g, or t
  misc_feature (715)..(716): n is a, c, g, or t
  misc_feature (719)..(719): n is a, c, g, or t
  misc_feature (722)..(722): n is a, c, g, or t
  misc_feature (748)..(748): n is a, c, g, or t
atagaaaccttcttttttttttataggaggggggagaaaaaaaaaaaagagggggggggggggttctttttggggtgggcgccaaagaaaaaaaaagagccccctcctttttnggggggctttttttttttggggaattaaatttttctcttttcggggggggggaggagttttctttttctcaaaacaaaaaaacaaagctttttttttcccccccctccggggggggcggagttaaagggaaagggggagggggccccccccccaaataaaaaaaaaagaggggggcgccaaaaaaaaaaaaaacccccccccctataaggggggtcttctccggggggggggcccccccttttgttgttttaccaaaaggggcgctctttagggcgggcgcgctgggtgacccaaaaaataaaaaaggtgtggtggcctccctcggggaggtgggggggggggcgccccccccccaatgggttttttcaagggttgtttgtgcacccgccgggccccgggggtgtggggcgacttaaaaagtggggggacaaaaaaagggtggggccccccccccgtatcctaaaccagggggtgggggggggtaaaccccaagccccgggccgaaaggccccccaacaaaaagggcccagggcccattccccttctcttccaaacaaagggttccaaggagggaggaatcttacaaaaatttgggcagttnnccnttnaacggggagatgcgccccaccctgtntgttc

SEQ ID NO: 671988 - DNA, 625 bp, Homo sapiens
gagtagttggccaactaccatacctcattgcgtcgatcgacagtacttacctggggacaatgacatagtgtctctgctattcccgtataagtcaccaaaatgctttaggccataatgttagtcccagtgctctatacgttttaaaggccagggagtcacccctacactaagtcccatctccagagataccctggtatgcactgcagcctacttaccaacaggagtaccactgtggaccagacagcagtcaacactacagatccaaagagtgtcaaaaccatggaaaacaaaaactttccttcacatgcactgtagaacactactgcctgtccctttaatcaatcaatacccgtactcctaaaataaagagaaattataaccccaagatatgtacaaagcatctccccttcccccaactttcttcgcctgatcccctatcactgaggtctccctctgagtgctgcgccacaatcctccttagctggagactaccgtatcttccactagaggcaccatggagtcatacctctaccatgtgggcttcttccaagtccaaggtgaagggcaagccccgaacgtctctaatgtgcaccgtgttcaaagtgaaggaggtataagaaggaca

SEQ ID NO: 671989 - DNA, 150 bp, Homo sapiens
attccaccatcgatggagtatgcgtacgtctcccagtaaaagggacatataataacatctcaggacctttcagggacgtctgcacgttacttggggcgcagcacagtggacgcggctgggtccagggcagtttctcctcaccgcgggtcc

SEQ ID NO: 671990 - DNA, 202 bp, Homo sapiens
  misc_feature (14)..(14): n is a, c, g, or t
  misc_feature (16)..(16): n is a, c, g, or t
  misc_feature (121)..(121): n is a, c, g, or t
ctactagaaaaaancnagagctttattattctcaacaccaatggcagcggtcttcataggacagaggagtgagttctgtcaacagacaggcggcccctacttccggcgatgaggggttccnaggccacgatgactgagtcccgcgaggacatcttggagatgtagcggtctttgttactggcttggacttcttcttgccctt

SEQ ID NO: 671991 - DNA, 186 bp, Homo sapiens
  misc_feature (144)..(144): n is a, c, g, or t
  misc_feature (155)..(155): n is a, c, g, or t
gcgcctagcggactcttcgacggtgtctgtgactgtgtggtatagtggggggcatccatatagtcactccaggtcatggagggtcttctactataaggacttttcgcttcgaagcgaagcgttctcacactcatgaaaattatntactattactngctgttagcagaaactgaattgaggctacag

SEQ ID NO: 671992 - DNA, 163 bp, Homo sapiens
gatctagaggatcccgatggccacattctgagcatgagtgtactgagggcccgaagctctacaatgggctggttgctggcctgagcgccaagtgagctttgcctctgtccgcatcgtgctgtatgattctagtcaaacagttctacaccaagggctctgagca

SEQ ID NO: 671993 - DNA, 191 bp, Homo sapiens
ttatcttccgtgcccggtcttgactaccatattttaaattggctggaggacttttttgttctcttctttttttctttttttaataccatcccgctcttatttcagaataaaaaaaaattttaaggtatgttgagtaagaatctataaagcaatgaaaatgcaagatcaatatctatgggcacggaagatca

SEQ ID NO: 671994 - DNA, 1849 bp, Homo sapiens
gcgacggcgccttcgcgaaacactatgctaatggcatggtgccgcggtcctgtcttgctgtgcctgcggcaggggctcggaaccaattcattcctgcacggcctggggcaggagcccttcgagggagctcggtcactgtgttgcaggtcctcgcctagagacctgcgagatggagaaagagagcacgaggcggcacaaaggaaagccccaggagcagagtcttgcccatctctccctctgagcatctcggacattgggactggatgtctttcgtcactggaaaacctcagactgccgacgctgcgggaagagtcatcacctcgagagctcgaggactcgagcggagaccagggccggtgcggtcccacacaccagggatccgaggatccttcgatgctctcgcaggcccagtccgctaccgaggtcgaagagcgtcacgtctccccttcttgttcaacttccagagagagaccctttcaggctggggagctgattttagctgagactggggagggagaaacaaaatttaagaaattatttaggttgaacaacttcggactcttaaatagtaactggggggcagtcccgttcggcaagatcgtggggaagttccccggccagatactgaggagttccttcggtaagcagtacatgctgaggaggccagccttggaagactatgtagtattgatgaaaagagggactgccataacattcccaaaggatattaatatgattctctcaatgatggatatcaacccaggtgatactgttttggaagctggctcaggctctggtggaatgagcttatttttatccaaagcagttggatcacaaggacgagtcataagttttgaggtacgaaaagaccaccatgatctggctaagaagaattacaaacactggcgtgattcatggaaattaagtcatgtagaagagtggccagacaatgtggattttattcataaggacatttcaggagcaaccgaagacataaaatctttaacatttgacgcagtagctttggatatgttaaatcctcatgttactttgcctgttttttacccacatcttaagcatggtggtgtatgtgctgtatatgtagtaaacatcacacaggttattgaacttttagatggaattcgcacctgtgaacttgctctttcatgtgaaaagataagcgaggtcattgtcagagattggttggtttgccttgcaaaacagaaaaatggaattttagctcaaaaagtagaatctaaaatcaacacagatgtacaactagattctcaagagaaaattggagttaaaggtgagctgtttcaagaggatgaccatgaagaatcgcattctgattttccatatggatcatttccctatgttgctagaccagtacactggcaacctggtcatacagcttttcttgtcaagttgaggaaggtcaaaccacaacttaactgagtactccagatgacagtaactgacttgaagatggaaaaatatcaaaatagaactttatattgaaaatcactgcttccatagattggcatttttagctattactatgacttatataacttatacatataattttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaaccactccatagatttgtctttcttcaagaaattagttttctttcctttatttgattgatggtcattgactactgaaataaaatatgcattttaagataaaaaaaaaaaaaaca

SEQ ID NO: 671995 - DNA, 1582 bp, Homo sapiens
gcgacggcgccttcgcgaaacactatgctaatggcatggtgccgcggtcctgtcttgctgtgcctgcggcaggggctcggaaccaattcattcctgcacggcctggggcaggagcccttcgagggagctcggtcactgtgttgcaggtcctcgcctagagacctgcgagatggagaaagagagcacgaggcggcacaaaggaaagccccaggagcagagtcttgcccatctctccctctgagcatctcggacattgggactggatgtctttcgtcactggaaaacctcagactgccgacgctgcgggaagagtcatcacctcgagagctcgaggactcgagcggagaccagggccggtgcggtcccacacaccagggatccgaggatccttcgatgctctcgcaggcccagtccgctaccgaggtcgaagagcgtcacgtctccccttcttgttcaacttccagagagagaccctttcaggctggggagctgattttagctgagactggggagggagaaacaaaatttaagaaattatttaggttgaacaacttcggactcttaaatagtaactggggggcagtcccgttcggcaagatcgtggggaagttccccggccagatactgaggagttccttcggtaagcagtacatgctgaggaggccagccttggaagactatgtagtattgatgaaaagagggactgccataacattcccaaaggatattaatatgattctctcaatgatggatatcaacccaggtgatactgttttggaagctggctcaggctctggtggaatgagcttatttttatccaaagcagttggatcacaaggacgagtcataagttttgaggtacgaaaagaccaccatgatctggctaagaagaattacaaacactggcgtgattcatggaaattaagtcatgtagaagagtggccagacaatgtggattttattcataaggacatttcaggagcaaccgaagacataaaatctttaacatttgacgcagtagctttggatatgttaaatcctcatgttactttgcctgttttttacccacatcttaagcatggtggtgtatgtgctgtatatgtagtaaacatcacacaggttattgaacttttagatggaattcgcacctgtgaacttgctctttcatgtgaaaagataagcgaggtcattgtcagagattggttggtttgccttgcaaaacagaaaaatggaattttagctcaaaaagtagaatctaaaatcaacacagatgtacaactagattctcaagagaaaattggagttaaaggtgagctgtttcaagaggatgaccatgaagaatcgcattctgattttccatatggatcatttccctatgttgctagaccagtacactggcaacctggtcatacagcttttcttgtcaagttgaggaaggtcaaaccacaacttaactgagtactccagatgacagtaactgacttgaagatggaaaaatatcaaaatagaactttatattgaaaatcactattacttatatgatatgtctccatacccattacaatctccagcattccccctc

SEQ ID NO: 671996 - DNA, 943 bp, Homo sapiens
  misc_feature (827)..(827): n is a, c, g, or t
  misc_feature (829)..(829): n is a, c, g, or t
  misc_feature (852)..(852): n is a, c, g, or t
  misc_feature (856)..(857): n is a, c, g, or t
  misc_feature (863)..(863): n is a, c, g, or t
  misc_feature (872)..(872): n is a, c, g, or t
  misc_feature (874)..(874): n is a, c, g, or t
  misc_feature (877)..(877): n is a, c, g, or t
  misc_feature (882)..(882): n is a, c, g, or t
  misc_feature (887)..(888): n is a, c, g, or t
  misc_feature (894)..(895): n is a, c, g, or t
  misc_feature (905)..(906): n is a, c, g, or t
gcgacggcgccttcgcgaaacactatgctaatggcatggtgccgcggtcctgtcttgctgtgcctgcggcaggggctcggaaccaattcattcctgcacggcctggggcaggagcccttcgagggagctcggtcactgtgttgcaggtcctcgcctagagacctgcgagatggagaaagagagcacgaggcggcacaaaggaaagccccaggagcagagtcttgcccatctctccctctgagcatctcggacattgggactggatgtctttcgtcactggaaaacctcagactgccgacgctgcgggaagagtcatcacctcgagagctcgaggactcgagcggagaccagggccggtgcggtcccacacaccagggatccgaggatccttcgatgctctcgcaggcccagtccgctaccgaggtcgaagagcgtcacgtctccccttcttgttcaacttccagagagagaccctttcaggctggggagctgattttagctgagactggggagggagaaacaaaatttaagaaattatttaggttgaacaacttcggactcttaaatagtaactggggggcagtcccgttcggcaagatcgtggggaagttccccggccagatactgaggagttccttcggtaagcagtacatgctgaggaggccagccttggaagactatgtagtattgatgaaaagagggactgccataacattcccaaagggtagctttggatatgttaaatcctcatgttactttgcctgttttttacccacatcttaagcatggtggtgtatgtgctgtatatgtagtaaacatcaccggtntngactttagatggatcgactggantggnnttcagngaagatagngngcntgccnatggnnggttgnntgaacaaaannggtttgccaaagggattaatacgggtcgattgaaagg

SEQ ID NO: 671997 - DNA, 872 bp, Homo sapiens
gcgacggcgccttcgcgaaacactatgctaatggcatggtgccgcggtcctgtcttgctgtgcctgcggcaggggctcggaaccaattcattcctgcacggcctggggcaggagcccttcgagggagctcggtcactgtgttgcaggtcctcgcctagagacctgcgagatggagaaagagagcacgaggcggcacaaaggaaagccccaggagcagagtcttgcccatctctccctctgagcatctcggacattgggactggatgtctttcgtcactggaaaacctcagactgccgacgctgcgggaagagtcatcacctcgagagctcgaggactcgagcggagaccagggccggtgcggtcccacacaccagggatccgaggatccttcgatgctctcgcaggcccagtccgctaccgaggtcgaagagcgtcacgtctccccttcttgttcaacttccagagagagaccctttcaggctggggagctgattttagctgagactggggagggagaaacaaaatttaagaaattatttaggttgaacaacttcggactcttaaatagtaactggggggcagtcccgttcggcaagatcgtggggaagttccccggccagatactgaggagttccttcggtaagcagtacatgctgaggaggccagccttggaagactatgtagtattgatgaaaagagggactgccataacattcccaaaggtaatgcgatggagataaggtgtgtattggtttcaggaggggcaaagacagatgcagtactcagtcctgattaatgtattcaaagacatctcagaacgtttggattttttattgtactcaggcttttaaaataaaccaatggttataac

SEQ ID NO: 671998 - DNA, 97 bp, Homo sapiens
gggcgttcgcgggggcctggtgctctaaaacccaccctcccccaaatctgttttcatgtaaaagacaaataaatgatgacttcccccaaaaaaaaaa

SEQ ID NO: 671999 - DNA, 1278 bp, Homo sapiens
tggcctagccctacctgtttcggcccggaactccccgaaggccgtcggtgccactcccagcccatgtgggcccccgctgggcttgccactgcctgtcccccatgctccccgttcctgctgggctttacacctcgtccagtggtgtgtgctttcttgatgcctgccctgctcctgtgcccactctctgcatgcctcatcctgccagctctggggccccactgttccccactccctgtgctgtgctgtgtgggtgctagcccccggagggggctttggctggagctttgggcctgctgtgtggtgcccctgtgggcctgtgcggtgtgccgtgggctcaatcgtggatcgactgcgtggactgcacgtgtcatgccttgtgcggctgcgccactgtccagtgggccctctcagacccagaccagaaggcctccttgagaacgcttcatctgaaattattaacccactatcttgccgtgaatgggcaatgagtccctcgcaaccgggctacaatctccaaggatacccaacctctcgttaccagacaattggaataattccctccgcactcatctaatatcatccccttggtagtacccacaagggaacactccgggagaattagcagcccaaataagttcggacagtgagtggcgagcacgaaactccttatggtggtaagcttcggcgacttcatagggacattcgacgagaaccaaaccctcacacttccaccaaactatcccccaaaccccaaacttgaaactaggcagcgagattccccctttgaacttcgccccaaaatgacagaggaccccagggcgccctcttggcgccttatacgagcacttaccccttagaaccgactacacatctccacatcccacaaatgtggtttggggattaacatataacgaaatacaaaatgactatcatcgccattggataccccacacatacatctagacgcccgggattacacaaactataatagcaaaactagcaccacaccaaatagggcatgtagcacccttagccattcacacacattgtgggaaaagcagcttggacatttgaactgcccagaaccgtgacgcacaaacgagcaacgcctgcgccctcgagcccggcccccaccccacgtccaccaccgcacacatggacaaccaacaccccaacacgggcacaccccacgccacgccacggccagacacacactaaacccgccggggcacacccaacaataagaccaaccaggcccacacttccccataaccccca

SEQ ID NO: 672000 - DNA, 886 bp, Homo sapiens
ggcggggagcctacggtccctgcagtgcctgctgctgaggaggccaccgaagctcggggacgcgaggagccggcgtggccctggaaaggacgccccgatccggacgctggtgcagcgcatccaccagctgcaggctgagctgcgcgcagggcttcccgccgactgaggaaggccacccgccagtaacctgcgcaaggggccctgaatacggattcggcggcgctaaccgggaggcaacagtgcaacgggggttgaccccagggcccttcgccggcccgcctcggcggaaaggtggcgggcgggtggggaagcaagaagcttgggggcggggccctccgcaagggacaagccggtggctcgccgggccaacggtgcgcagccttgcaggagctggaggcaaacggcggtggcgcacgggtggccctgcctgcaggtttgattggagaacgccagaagcgtgggcgggggccagggaggcacgctgtcacggatgcccagcagctgaacaattgaggggtactttaaacacccatggggggccgatcagccgaggttcctccagggaccatgaggttggatggggaaatctgccgagtgatggggggccccagggattgcgccgaggaagatgggacacggggcggattggcggccaagcccaagccctaaactgcaagcttgttggggtcggcgccccattgggcttgttgaccttccgtggagtcaaggacacttccaaaataaaagaagtcctccttggtacacaaacaagcaaacacacagagacgcacgaccacagcgaacaacaagacaaagtctgggcggccgaaagttacaacactgggcggggccagaagagaaggtcaggcgaacaccgacaaaggga

SEQ ID NO: 672001 - DNA, 933 bp, Homo sapiens
ggacctgtcccaggtggtagccagaccgggcaccggcaaccaggtgataatgtttccaggacatataaatgggtttttcgtttgaagtaaaataaggacttaaggttttcttctctaaattaccttttcttgtcaagttgaggaaggtcaaaccacaacttaactgagtactccagatgacagtaactgacttgaagatggaaaaatatcaaaatagaactttatattgaaaatcactgcttccatagattggcatttttagctattactatgacttatataacttatacatataattttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaaccactccatagatttgtctttcttcaagaaattagttttctttcctttatttgattgatggtcattgactacttcagaaccagtataagcttgagaaggatcacctattatgtccattgacagtgagttgtatgagtcctgagaatgtttttctgtcacccctgctgtatgactggataaagatgatgatgaagacaatcccagtctaacatatcttctttttttaccacagagtgaacaatctactggtgtggcactaggtccccggggcagctgaacttcatctctgttgtagtttctgacagctccactgtgatgaacagaacgttctctttgccagatataatgggttggtgcaatggccataacctgcggaagcccggggctgcgcgggagagggccgggcaacggcggtcaaggctccgtcgcagcgctcctggcctcagacggttgctcgtcggtcgctagccagcagcggtacccccgct

SEQ ID NO: 672002 - DNA, 1823 bp, Homo sapiens
gcgacggcgccttcgcgaaacactatgctaatggcatggtgccgcggtcctgtcttgctgtgcctgcggcaggggctcggaaccaattcattcctgcacggcctggggcaggagcccttcgagggagctcggtcactgtgttgcaggtcctcgcctagagacctgcgagatggagaaagagagcacgaggcggcacaaaggaaagccccaggagcagagtcttgcccatctctccctctgagcatctcggacattgggactggatgtctttcgtcactggaaaacctcagactgccgacgctgcgggaagagtcatcacctcgagagctcgaggactcgagcggagaccagggccggtgcggtcccacacaccagggatccgaggatccttcgatgctctcgcaggcccagtccgctaccgaggtcgaagagcgtcacgtctccccttcttgttcaacttccagagagagaccctttcaggctggggagctgattttagctgagactggggagggagaaacaaaatttaagaaattatttaggttgaacaacttcggactcttaaatagtaactggggggcagtcccgttcggcaagatcgtggggaagttccccggccagatactgaggagttccttcggtaagcagtacatgctgaggaggccagccttggaagactatgtagtattgatgaaaagagggactgccataacattcccaaaggatattaatatgattctctcaatgatggatatcaacccaggtgatactgttttggaagctggctcaggctctggtggaatgagcttatttttatccaaagcagttggatcacaaggacgagtcataagttttgaggtacgaaaagaccaccatgatctggctaagaagaattacaaacactggcgtgattcatggaaattaagtcatgtagaagagtggccagacaatgtggattttattcataaggacatttcaggagcaaccgaagacataaaatctttaacatttgacgcagtagctttggatatgttaaatcctcatgttactttgcctgttttttacccacatcttaagcatggtggtgtatgtgctgtatatgtagtaaaatggaattcgcacctgtgaacttgctctttcatgtgaaaagataagcgaggtcattgtcagagattggttggtttgccttgcaaaacagaaaaatggaattttagctcaaaaagtagaatctaaaatcaacacagatgtacaactagattctcaagagaaaattggagttaaaggtgagctgtttcaagaggatgaccatgaagaatcgcattctgattttccatatggatcatttccctatgttgctagaccagtacactggcaacctggtcatacagcttttcttgtcaagttgaggaaggtcaaaccacaacttaactgagtactccagatgacagtaactgacttgaagatggaaaaatatcaaaatagaactttatattgaaaatcactgcttccatagattggcatttttagctattactatgacttatataacttatacatataattttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaaccactccatagatttgtctttcttcaagaaattagttttctttcctttatttgattgatggtcattgactactgaaataaaatatgcattttaagataaaaaaaaaaaaaaca

SEQ ID NO: 672003 - DNA, 1823 bp, Homo sapiens
gcgacggcgccttcgcgaaacactatgctaatggcatggtgccgcggtcctgtcttgctgtgcctgcggcaggggctcggaaccaattcattcctgcacggcctggggcaggagcccttcgagggagctcggtcactgtgttgcaggtcctcgcctagagacctgcgagatggagaaagagagcacgaggcggcacaaaggaaagccccaggagcagagtcttgcccatctctccctctgagcatctcggacattgggactggatgtctttcgtcactggaaaacctcagactgccgacgctgcgggaagagtcatcacctcgagagctcgaggactcgagcggagaccagggccggtgcggtcccacacaccagggatccgaggatccttcgatgctctcgcaggcccagtccgctaccgaggtcgaagagcgtcacgtctccccttcttgttcaacttccagagagagaccctttcaggctggggagctgattttagctgagactggggagggagaaacaaaatttaagaaattatttaggttgaacaacttcggactcttaaatagtaactggggggcagtcccgttcggcaagatcgtggggaagttccccggccagatactgaggagttccttcggtaagcagtacatgctgaggaggccagccttggaagactatgtagtattgatgaaaagagggactgccataacattcccaaaggatattaatatgattctctcaatgatggatatcaacccaggtgatactgttttggaagctggctcaggctctggtggaatgagcttatttttatccaaagcagttggatcacaaggacgagtcataagttttgaggtacgaaaagaccaccatgatctggctaagaagaattacaaacactggcgtgattcatggaaattaagtcatgtagaagagtggccagacaatgtggattttattcataaggacatttcaggagcaaccgaagacataaaatctttaacatttgacgcagtagctttggatatgttaaatcctcatgttactttgcctgttttttacccacatcttaagcatggtggtgtatgtgctgtatatgtagtaaacatcacacaggttattgaacttttagatggaattcgcacctgtgaacttgctctttcatgtgaaaagataagcgaggtcattgtcagagattggttggtttgccttgcaaaacagaaaaatggaattttagctcaaaaagtagaatctaaaatcaacacagatgtacaactagattctcaagagaaaattggagttaaaggaagaatcgcattctgattttccatatggatcatttccctatgttgctagaccagtacactggcaacctggtcatacagcttttcttgtcaagttgaggaaggtcaaaccacaacttaactgagtactccagatgacagtaactgacttgaagatggaaaaatatcaaaatagaactttatattgaaaatcactgcttccatagattggcatttttagctattactatgacttatataacttatacatataattttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaaccactccatagatttgtctttcttcaagaaattagttttctttcctttatttgattgatggtcattgactactgaaataaaatatgcattttaagataaaaaaaaaaaaaaca

SEQ ID NO: 672004 - DNA, 341 bp, Homo sapiens
tccgcgtgatgacgcatgttgtagctgctgctggccaccacgaacgatatggcatgtcacatcgttgaagcactgcatccacttgcggcgttcatcgcgctggccacccacgtcaacacatgtggtaagttgactttgtccacctggcaacttggtctcaaagattccagaattcatggacacggcagcgaatctggtcctgatcgcctcggcacatagtctgcctgcttgatcacttcgatcttgtccaggacgtactgcgcactgtccatcagctggtactcgtttgagcgttcgtatcacgcacgcactccttcatcctcccacatagccttggcatg

SEQ ID NO: 672005 - DNA, 296 bp, Homo sapiens
tctagaggatcccatcacatccattgcccctagattgaccaaagttacatgatgcaggtgtgaagagaaacctgatgtcacatacagtgctgttggtggctgtaaggaacatgattgcgaaactgcgcgaaactgcatccctttaaacacttcccattttttattttcctttttttttgttttttgagacatgggtttcactcctgtgtcacccagtgctggacgttcatgttgtgctgtgactctctgtgctcactgtgcaaccctcttgccatcccggtggttcaatgctgagt

SEQ ID NO: 672006 - DNA, 1530 bp, Homo sapiens
gcgacggcgccttcgcgaaacactatgctaatggcatggtgccgcggtcctgtcttgctgtgcctgcggcaggggctcggaaccaattcattcctgcacggcctggggcaggagcccttcgagggagctcggtcactgtgttgcaggtcctcgcctagagacctgcgagatggagaaagagagcacgaggcggcacaaaggaaagccccaggagcagagtcttgcccatctctccctctgagcatctcggacattgggactggatgtctttcgtcactggaaaacctcagactgccgacgctgcgggaagagtcatcacctcgagagctcgaggactcgagcggagaccagggccggtgcggtcccacacaccagggatccgaggatccttcgatgctctcgcaggcccagtccgctaccgaggtcgaagagcgtcacgtctccccttcttgttcaacttccagagagagaccctttcaggctggggagctgattttagctgagactggggagggagaaacaaaatttaagaaattatttaggttgaacaacttcggactcttaaatagtaactggggggcagtcccgttcggcaagatcgtggggaagttccccggccagatactgaggagttccttcggtaagcagtacatgctgaggaggccagccttggaagactatgtagtattgatgaaaagagggactgccataacattcccaaagggtagctttggatatgttaaatcctcatgttactttgcctgttttttacccacatcttaagcatggtggtgtatgtgctgtatatgtagtaaaatggaattcgcacctgtgaacttgctctttcatgtgaaaagataagcgaggtcattgtcagagattggttggtttgccttgcaaaacagaaaaatggaattttagctcaaaaagtagaatctaaaatcaacacagatgtacaactagattctcaagagaaaattggagttaaaggtgagctgtttcaagaggatgaccatgaagaatcgcattctgattttccatatggatcatttccctatgttgctagaccagtacactggcaacctggtcatacagcttttcttgtcaagttgaggaaggtcaaaccacaacttaactgagtactccagatgacagtaactgacttgaagatggaaaaatatcaaaatagaactttatattgaaaatcactgcttccatagattggcatttttagctattactatgacttatataacttatacatataattttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaaccactccatagatttgtctttcttcaagaaattagttttctttcctttatttgattgatggtcattgactactgaaataaaatatgcattttaagataaaaaaaaaaaaaaca

SEQ ID NO: 672007 - DNA, 1623 bp, Homo sapiens
gcgacggcgccttcgcgaaacactatgctaatggcatggtgccgcggtcctgtcttgctgtgcctgcggcaggggctcggaaccaattcattcctgcacggcctggggcaggagcccttcgagggagctcggtcactgtgttgcaggtcctcgcctagagacctgcgagatggagaaagagagcacgaggcggcacaaaggaaagccccaggagcagagtcttgcccatctctccctctgagcatctcggacattgggactggatgtctttcgtcactggaaaacctcagactgccgacgctgcgggaagagtcatcacctcgagagctcgaggactcgagcggagaccagggccggtgcggtcccacacaccagggatccgaggatccttcgatgctctcgcaggcccagtccgctaccgaggtcgaagagcgtcacgtctccccttcttgttcaacttccagagagagaccctttcaggctggggagctgattttagctgagactggggagggagaaacaaaatttaagaaattatttaggttgaacaacttcggactcttaaatagtaactggggggcagtcccgttcggcaagatcgtggggaagttccccggccagatactgaggagttccttcggtaagcagtacatgctgaggaggccagccttggaagactatgtagtattgatgaaaagagggactgccataacattcccaaaggatattaatatgattctctcaatgatggatatcaacccaggtgatactgttttggaagctggctcaggctctggtggaatgagcttatttttatccaaagcagttggatcacaaggacgagtcataagttttgaggtacgaaaagaccaccatgatctggctaagaagaattacaaacactggcgtgattcatggaaattaagtcatgtagaagagtggccagacaatgtggattttattcataaggacatttcaggagcaaccgaagacataaaatctttaacatttgacgcagtagctttggatatgttaaatcctcatgttactttgcctgttttttacccacatcttaagcatggtggtgtatgtgctgtatatgtagtaaagaagaatcgcattctgattttccatatggatcatttccctatgttgctagaccagtacactggcaacctggtcatacagcttttcttgtcaagttgaggaaggtcaaaccacaacttaactgagtactccagatgacagtaactgacttgaagatggaaaaatatcaaaatagaactttatattgaaaatcactgcttccatagattggcatttttagctattactatgacttatataacttatacatataattttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaaccactccatagatttgtctttcttcaagaaattagttttctttcctttatttgattgatggtcattgactactgaaataaaatatgcattttaagataaaaaaaaaaaaaaca

SEQ ID NO: 672008 - DNA, 2794 bp, Homo sapiens
gcgacggcgccttcgcgaaacactatgctaatggcatggtgccgcggtcctgtcttgctgtgcctgcggcaggggctcggaaccaattcattcctgcacggcctggggcaggagcccttcgagggagctcggtcactgtgttgcaggtcctcgcctagagacctgcgagatggagaaagagagcacgaggcggcacaaaggaaagccccaggagcagagtcttgcccatctctccctctgagcatctcggacattgggactggatgtctttcgtcactggaaaacctcagactgccgacgctgcgggaagagtcatcacctcgagagctcgaggactcgagcggagaccagggccggtgcggtcccacacaccagggatccgaggatccttcgatgctctcgcaggcccagtccgctaccgaggtcgaagagcgtcacgtctccccttcttgttcaacttccagagagagaccctttcaggctggggagctgattttagctgagactggggagggagaaacaaaatttaagaaattatttaggttgaacaacttcggactcttaaatagtaactggggggcagtcccgttcggcaagatcgtggggaagttccccggccagatactgaggagttccttcggtaagcagtacatgctgaggaggccagccttggaagactatgtagtattgatgaaaagagggactgccataacattcccaaaggatattaatatgattctctcaatgatggatatcaacccaggtgatactgttttggaagctggctcaggctctggtggaatgagcttatttttatccaaagcagttggatcacaaggacgagtcataagttttgaggtacgaaaagaccaccatgatctggctaagaagaattacaaacactggcgtgattcatggaaattaagtcatgtagaagagtggccagacaatgtggattttattcataaggacatttcaggagcaaccgaagacataaaatctttaacatttgacgcagtagctttggatatgttaaatcctcatgttactttgcctgttttttacccacatcttaagcatggtggtgtatgtgctgtatatgtagtaaacatcacacaggttattgaacttttagatggaattcgcacctgtgaacttgctctttcatgtgaaaagataagcgaggtcattgtcagagattggttggtttgccttgcaaaacagaaaaatggaattttagctcaaaaagtagaatctaaaatcaacacagatgtacaactagattctcaagagaaaattggagttaaaggtgagctgtttcaagaggatgaccatgaagaatcgcattctgattttccatatggatcatttccctatgttgctagaccagtacactggcaacctggtcatacagcttttcttgtcaagttgaggaaggtcaaaccacaacttaactgagtactccagatgacagtaactgacttgaagatggaaaaatatcaaaatagaactttatattgaaaatcactgcttccatagattggcatttttagctattactatgacttatataacttatacatataattttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaaccactccatagatttgtctttcttcaagaaattagttttctttcctttatttgattgatggtcattgactacttcagaaccagtataagcttgagaaggatcacctattatgtccattgacagtgagttgtatgagtcctgagaatgtttttctgtcacccctgctgtatgactggataaagatgatgatgaagacaatcccagtctaacatatcttctttttttaccacagagtgaacaatctactggtgtggcactaggtccccggggcagctgaacttcatctctgttgtagtttctgacagctccactgtgatgaacagaacgttctctttgccagatataatgggttggtgcaatggccataacctcctcacaacatcgcctgcttacaatagccctatagtcaattctatcccagagctggtcccttaactttaagaaattagggaacaattttctccagtttttccctaaagcccatggaaaaatttcgtacttggtttcttcttcatcttcttcaactgtattagccagatacagagcaataaagaaatttatcctggtatgctcacttatagtaaatttagccctcttgaaataaacaaaggtcatagccaaaagatacttgtctgcaattttacagcagcagtccatccacaagaaatcttgaattaaatcgtcatcaaataatttaaagaaagcagtcatatcctgacgctgtataaccagacaaggtcctttggggcgtttagatttgttgttattatgtgtatttttttcaaatgcttgccaattatctttacaaataggacgcttcagagtaatgggctttttaggctgatgtgatctatttgaccctgattttacataaacagtgacagtaggtggtgtctcacaacacatctgattgtgcctcattttggtttcccaatattcctgcggaagcccggggctgcgcgggagagggccgggcaacggcggtcaaggctccgtcgcagcgctcctggcctcagacggttgctcgtcggtcgctagccagcagcggtacccccgct

SEQ ID NO: 672009 - DNA, 542 bp, Homo sapiens
tggactgtatgtactgtacagtgtgtggggagtaggtgtgtggtgtgtggtgtgtggggagcatgtatggggtgtgtgatgtgtgtggtgctgtatgtgtgtggtgtatgtgtagtagattcatgtgtgtggtgtgggggtgtgtgcacgtgtgcacatactgtgtggtgtgtgtgatgtctgtggggggtatgtttgcacatggtgtgtacacagtgtgtgtggtgtcagaggtgtgcatgtgtgcacatggtgtgtgtacagtgtgtggggtgtgtgcatgtatacatggtgtgggtgcagtgtggtgtctgtgtgtggtgtctggggtgtgtgtgcatgtgcacatggtgtgtgtgcatggtgtgtgcatgtatacatggtgtgtgtgcagtgtgtggtgtctgtggtgtctagggtgtgtgtgcgtgtgcacataatggggtatccacagctcagcttcaggtacagaaggctttctccattgacattattcgacacaaagattcaatggatgaactcttcagtcaccgtagtgaaat

SEQ ID NO: 672010 - DNA, 106 bp, Homo sapiens
ctagaggatccccagctctgagcgagtcctgagcccgcttatacttattttatggtctcgtccagatcctctggcttattttatggtcttgtccagaccctcgtgg

SEQ ID NO: 672011 - DNA, 968 bp, Homo sapiens
  misc_feature (2)..(2): n is a, c, g, or t
  misc_feature (64)..(66): n is a, c, g, or t
  misc_feature (69)..(69): n is a, c, g, or t
  misc_feature (72)..(74): n is a, c, g, or t
  misc_feature (78)..(78): n is a, c, g, or t
  misc_feature (83)..(83): n is a, c, g, or t
  misc_feature (85)..(85): n is a, c, g, or t
  misc_feature (90)..(90): n is a, c, g, or t
  misc_feature (92)..(92): n is a, c, g, or t
  misc_feature (95)..(97): n is a, c, g, or t
  misc_feature (99)..(100): n is a, c, g, or t
  misc_feature (112)..(112): n is a, c, g, or t
  misc_feature (126)..(127): n is a, c, g, or t
  misc_feature (130)..(132): n is a, c, g, or t
  misc_feature (135)..(135): n is a, c, g, or t
  misc_feature (145)..(147): n is a, c, g, or t
  misc_feature (153)..(153): n is a, c, g, or t
  misc_feature (155)..(155): n is a, c, g, or t
  misc_feature (157)..(158): n is a, c, g, or t
  misc_feature (160)..(160): n is a, c, g, or t
  misc_feature (163)..(163): n is a, c, g, or t
  misc_feature (166)..(167): n is a, c, g, or t
  misc_feature (170)..(170): n is a, c, g, or t
  misc_feature (172)..(172): n is a, c, g, or t
  misc_feature (174)..(176): n is a, c, g, or t
  misc_feature (180)..(184): n is a, c, g, or t
  misc_feature (186)..(187): n is a, c, g, or t
  misc_feature (192)..(192): n is a, c, g, or t
  misc_feature (195)..(195): n is a, c, g, or t
  misc_feature (227)..(227): n is a, c, g, or t
  misc_feature (266)..(266): n is a, c, g, or t
  misc_feature (271)..(273): n is a, c, g, or t
  misc_feature (275)..(275): n is a, c, g, or t
  misc_feature (277)..(277): n is a, c, g, or t
  misc_feature (280)..(281): n is a, c, g, or t
  misc_feature (284)..(284): n is a, c, g, or t
  misc_feature (287)..(287): n is a, c, g, or t
  misc_feature (292)..(292): n is a, c, g, or t
  misc_feature (302)..(302): n is a, c, g, or t
  misc_feature (305)..(305): n is a, c, g, or t
  misc_feature (307)..(307): n is a, c, g, or t
  misc_feature (312)..(312): n is a, c, g, or t
  misc_feature (314)..(317): n is a, c, g, or t
  misc_feature (319)..(319): n is a, c, g, or t
  misc_feature (322)..(322): n is a, c, g, or t
  misc_feature (324)..(324): n is a, c, g, or t
  misc_feature (326)..(326): n is a, c, g, or t
  misc_feature (328)..(328): n is a, c, g, or t
  misc_feature (330)..(330): n is a, c, g, or t
  misc_feature (334)..(335): n is a, c, g, or t
  misc_feature (337)..(338): n is a, c, g, or t
  misc_feature (341)..(341): n is a, c, g, or t
  misc_feature (346)..(346): n is a, c, g, or t
  misc_feature (348)..(348): n is a, c, g, or t
  misc_feature (351)..(351): n is a, c, g, or t
  misc_feature (358)..(359): n is a, c, g, or t
  misc_feature (362)..(362): n is a, c, g, or t
  misc_feature (373)..(373): n is a, c, g, or t
  misc_feature (695)..(695): n is a, c, g, or t
  misc_feature (701)..(701): n is a, c, g, or t
  misc_feature (734)..(734): n is a, c, g, or t
  misc_feature (759)..(759): n is a, c, g, or t
  misc_feature (774)..(774): n is a, c, g, or t
  misc_feature (777)..(777): n is a, c, g, or t
  misc_feature (783)..(783): n is a, c, g, or t
  misc_feature (788)..(788): n is a, c, g, or t
  misc_feature (844)..(844): n is a, c, g, or t
  misc_feature (848)..(848): n is a, c, g, or t
  misc_feature (878)..(878): n is a, c, g, or t
  misc_feature (964)..(964): n is a, c, g, or t
cngtattactgttcgttttacactgtatctcttaggaaatggtgagagccatccacacaatgtnnnttnaannnagtngcgantngtatngnagnnntnngaagagggaganaaaaaatgaggatnnttnnnaanatatatatannnttgagngntnngngtnatnnganantnnnaccnnnnntnncaatnagngagagagccacatttcccctgagatgttacgnaaaagtttgaggttgagatgacatatctgacactctgtngtgannntnanaanntantanaggtnatattcgaangangncagtngnnnncnaangnananangcanncnnganctagnanagngaagagnnggnggagccttatnatgatggggagtcttgttctgacatctttggaaaaactgtccacagtgtgaagtcatcaacttgttatcctggtttacagtttgagtagctgttgtaatggtgtcgaacattttggtgagatactgagtggctcacatgtacaggtacaagggttttcccatgaaatttacatcgagttgtccacctccagcttatagggcttctggaacagagtgggtcttgctcttcgtgattccatgggagagaatggaattggaggaactagtagaattcagggtaatatccagtcagagactaatgactgtaatagatatggagctntccatnccagtggctgagttacgaacagagaaagcatanagcccactatgctttgtagttattngggggatagagagcnttngacctnatagntgaaacttcccattaattgtccaagaatattgtacacgtgggaaagactcggcganaggnacaaatagaggttttctcctgaaaggtaanaggtgaataaagggtaaatgctggggaggtctagaccatagaggacattcagggtgaatgggtcactacggatgccacaatatcgntccc

SEQ ID NO: 672012 - DNA, 944 bp, Homo sapiens
  misc_feature (131)..(131): n is a, c, g, or t
  misc_feature (134)..(134): n is a, c, g, or t
  misc_feature (144)..(144): n is a, c, g, or t
  misc_feature (158)..(158): n is a, c, g, or t
  misc_feature (190)..(191): n is a, c, g, or t
  misc_feature (193)..(193): n is a, c, g, or t
  misc_feature (210)..(210): n is a, c, g, or t
  misc_feature (221)..(221): n is a, c, g, or t
  misc_feature (230)..(230): n is a, c, g, or t
  misc_feature (265)..(265): n is a, c, g, or t
  misc_feature (303)..(303): n is a, c, g, or t
  misc_feature (321)..(321): n is a, c, g, or t
  misc_feature (330)..(330): n is a, c, g, or t
  misc_feature (334)..(334): n is a, c, g, or t
  misc_feature (337)..(337): n is a, c, g, or t
  misc_feature (346)..(347): n is a, c, g, or t
  misc_feature (355)..(355): n is a, c, g, or t
  misc_feature (357)..(357): n is a, c, g, or t
  misc_feature (371)..(371): n is a, c, g, or t
  misc_feature (373)..(373): n is a, c, g, or t
  misc_feature (390)..(390): n is a, c, g, or t
  misc_feature (427)..(427): n is a, c, g, or t
  misc_feature (525)..(525): n is a, c, g, or t
  misc_feature (533)..(533): n is a, c, g, or t
  misc_feature (547)..(549): n is a, c, g, or t
  misc_feature (551)..(551): n is a, c, g, or t
  misc_feature (557)..(557): n is a, c, g, or t
  misc_feature (559)..(559): n is a, c, g, or t
  misc_feature (562)..(563): n is a, c, g, or t
  misc_feature (577)..(579): n is a, c, g, or t
  misc_feature (586)..(587): n is a, c, g, or t
  misc_feature (590)..(590): n is a, c, g, or t
  misc_feature (597)..(599): n is a, c, g, or t
  misc_feature (606)..(606): n is a, c, g, or t
  misc_feature (622)..(622): n is a, c, g, or t
  misc_feature (636)..(636): n is a, c, g, or t
  misc_feature (641)..(641): n is a, c, g, or t
  misc_feature (650)..(650): n is a, c, g, or t
ttgcaatagatcttctgaccctccactgtggactcaatagcagggagatgaagaggacagtgactgagagaccaaaagtggccagccccctaccccatcctgttcccctgtccttacagtctctgggccanatncccacctcgnatatcttgttctanttagttaggccctgcagtaccctgttctcctnntnagcatgcttcaaagganccccacagtcnggaatccancccagtcttgtttttaccaccacttgatgcaaaanagtaagaagtcttgaacgtgtgtgctgtacaaaggaantgcagagatatacgtccngatgcagtntcanctnttgggactnnggcttggncnattacttctgactntnctcactcgtctctcctngccacccgcccgtgtgcacccataaatctggtgtganccacagactcgctagtagccggctcatgcacttcctgcaggtgtcctgcatctgtgtccatgctgtgtgacacactatcctggcagtgtgcaggcccntgttggancagggcctagccgnnntnccttgngnacnnttgtatgctttcannnaagcacnntgntggacannngcgaaangggctgaagatagacncagccttaccagangtggntgagacacncttaagctgtagttcccatggcatgtagtcagataagtcatgccgtctctcaacaactactctatcagcaaaagagtcctctgccatcgaaggtgtgactcctggcagccttccgtgctgcgctctaattggaccctggcggtttgagcaggtgcgctattcccgggaggtagtctccagctgacgggcgccgggacaaggggactccaaccaccccccgcggtttgcccagaaaattagaaaacgagacaaaagaagaggcgatccggcgaacacttcatccataaagggcaa

SEQ ID NO: 672013 - DNA, 334 bp, Homo sapiens
gcccttcttattttgttgacatacaccatacatacaaaaagtcacacgtcgtaagctatccagctatatgaatatttgtaatgtgaacacatttgtttaaccaccagactcctgtcatcaaacaaagacaataccccacgacctctttctaggtattggttatccccacaggtcaccattattctgatttctaatcagattattttgcatatttagaactctatataggtagaatagtgtgcgtccttttatgtctgtattttcattcaccacatgaatattactttctttattagatgcaatagaagtcaaattggaattaagactggtcctg

SEQ ID NO: 672014 - DNA, 172 bp, Homo sapiens
  misc_feature (73)..(73): n is a, c, g, or t
  misc_feature (115)..(115): n is a, c, g, or t
atggcataggcttcttgggatttaaataggaacagttcttgaagatgggatgggcaactggcattaacctctngcagccaccgataaaccaaatgatttcacttgtcataccaantgggaggtcggaaaagcctggttgatcccccactggcattcccaagcccgggcccgg

SEQ ID NO: 672015 - DNA, 840 bp, Homo sapiens
agcggagtaatagtgttttaagaatatttcagcgtagtagaggatttaagcagatcgctttgcctactttaattatatgaaataccaggaggtcagatgtttaacctctttcaacatatctgtttcttttcctgcagaaacagatgattatgctgagattatagatgaagaagatacttacaccatgccctcaagtaagtaaacttctgattttgttcttgctcagacttgacagatgcctcctggcatttaaaagttattgatacttactgtctttttagagccatttttaatacttccttggatgctgaacagaaatattcttttcaacctttaccattctatattacttacatatgcccactctaaggtcagaagcctaaaactcaaatatctgtaataatttttagttacaggatttttgtaatcttgttttctgactctatcataatagaacctttattgattagggtattttctgtctgtagaaaattagtattattggttaagtatatatgtgaatgtgtgtgtatatacacacacaatatatatatccatatatgtataatacacatacatacacacacgtatacccatactttcacacacatatattcaaaaatttgcattttccccctttaaattgtttattctttgttgccattgactaacccattacaaatagctccataaccatcgtcagcttgtacacctcaggcatgggaaggtgtggggagaagaaaccagaactcttaaaggaccttcctacagcctggaaatgtcagaatctggttctctctgtgatgtgcaggttgtgattaaggacaatcttgaagcccg

SEQ ID NO: 672016 - DNA, 519 bp, Homo sapiens
tgaggaaggagaatcgcttggaatacgggaagtggaaggtagtgaggcgagatcacgccactgcactccagcctgggcaagaaaagcgaaactccccatccaaaaaaaaaaatttgtggtaaaatacacataaatttaactatcttcatcatttctacctgtatggcccagtggtatggaggacattcataccatcagacaacataaccaccatccatccatctccagaggtctccatggcaaaagtgaactctacccattaaaccataattccctgttcccctctacccccaagcccggacaaccaccattctaccttttcggtgatttaaactatccttaagtccctcacagaagcggaatcatagtgttggtcttttggtaagtggcttattccactgagcaaaatcctcaaggttcatccatgttatatagcacgtatcaaatttcctttccatggctgaattaatgtcccatggtacgtacgccaaattttccttatccatctgttgatggaca

SEQ ID NO: 672017 - DNA, 4580 bp, Homo sapiens
ggtagtcgtggcgctctcgaggccctgccatgagcaagctcttaactcttcaggtctgcacgtcctacgcccaccgtccagtgctactctcagctcggagttcagcttcgggctgccaagagccagcaacctggtgtcagaggctcggtcccacaacgctctgcgggccgcggcgcctgctgggagtgtgtaagtccccgatctgcgtactgcgttcgccggagggggagggcggagctgccggcgtgccgggctgggctggcagctagagtgggtgcgatagccgcctccgcctctgccgctccgccgtcgcctcctccgcccgggccgttcgctgctgcgcggggagagcgaggcggggccgccggggccgccatggagcccgactcggtgattgaggacaagaccatcgagctcatgtgttctgtgccaaggtctttgtggctaggctgcgccaacctggtagagagcatgtgcgcactgagttgcctgcagagcatgcccagtgtcagatgtctccagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattctgacttgttgtattaggaacatgttggacagtggaaaattttctctggattgttttagtaatatttttgggattatacttcctttctgtaccaatttcttttaatttaaagaactataagtcagttatattatctaccaacaggtaatatagctctttcttttattaactgttctctgtcccccaaccatctcctgatatttggtagagtaacacctttatacgtgtgcttgcctcctaatttaaaatactgtattcgcatgtagatataatgtacataacagtttaacctcaaagttgctggagtcagggccccctgtgcttgagacactaatacagagtgtgttcgcacttagccatgggctgggctcaagaacctgatacctgggttgatgtggattacctagaacccttcctgcagtattcatacagtgtttttattttgttgttgtcattgcgtgtgtgtggtttgtgtgtgtttttaatgagaatcttgttttaaaatgtaatttctaaggtttaacaccaaaatgttttatttgttgtggagtatatattatacaatagagaggtaccttaaacattttttgttcttattctttttctcataagtactcctgagtacaagtggtcacctcccatagtattcatttggcttcgctgtcaaaaatcattattctgtgcagtcgtggccctgggaaggggaaataagaaggccctgttgacgggctgtcttggctctggaattcatgcatcctggccttgccaaggttctggcagggcctgctggtgtgttggagcctgcagggcaggtcaggctggttcagaggcccatgctgaggggtgggtgctctgaagtggagtgaagcctcaagcccatgaatgccaccccagtcatctctggtgtcagctgctgctgtggccccagcaggttctcaaagctcccaagtcctccctacgacacagcccaaatgtgtaaatggcactgttgccctgacagtgcatggaaaggacgttggcatccaattggcactccttctcccttattcaatattaggtttgatttgcccttcgccattgtttccaaagatcaaggaatgtcaataacattttaaaggaccaataaacagcctcctataaagtaaacctcttcccgtggaagcacactctactactaaagggaaggcccctgggctctgatttgtcctttgcattgagaacggtgtggggatcagtgtgtgtgtatgtgatttgtttattgagttggctttgcttttttagtttttcttttaaaaataaaatccttccttcccatgttactaaattaatttatgtttttgagaggttgagtctcaaagtgtaaacaataaacctccattcataaggtggatgttgtaagcttgatggtggttgtgaaagtgatttagctttgaccacttttcatcctacagcttcaatatcaaactggttaggaaagcccagggggaagggagggggcaggggaggaggcaattctgaatgaatgaatggattttttgttgtttttgcatgtttaatatagaagttcccctcgttccttgggagatgatggcctttgaatatgcagacaacctttgaattgtgcctactaaattatagcaggggactttggcacccaaggagttctgactttctgggattataatagtaattcccagccatactctggactttattttgctaaccataactgagcaaatgtaaattactgctatattaatgttttaaagcactgggatagtctaattctaacttgtaattaattatgtttgccaattatctgtttgaaataaatttgtgtctgaacagctattgaaactgttaaattgtacagatattattcatgacagctttgtactgtggaatgtgcttaataaaaaacaaaaaagtttgacttttgtccagtaaattgctaagtaatgtcaataaatcgagtatgggtattatgcagtgcacctaatctggcttcatgcaattgttacttcagctactgattcaaagccaatactcttaataaagtgttgcaatactc

SEQ ID NO: 672018 - DNA, 1538 bp, Homo sapiens
  misc_feature (537)..(537): n is a, c, g, or t
  misc_feature (558)..(558): n is a, c, g, or t
  misc_feature (1374)..(1374): n is a, c, g, or t
  misc_feature (1402)..(1402): n is a, c, g, or t
  misc_feature (1416)..(1416): n is a, c, g, or t
  misc_feature (1500)..(1500): n is a, c, g, or t
  misc_feature (1532)..(1532): n is a, c, g, or t
ccttatcataaattaaatatgtatttattttagtaaagtagcacaggtgcttaacaactgattgagtaaatccaggatcaaatgtaggaaataatgccttagaatctaattgcatgtggctttctgttttcactgcatttcaattacagtttccagaactgggttaaaaatattttttacattggtttcaagataatacgattgatggaggaaaaggggttaaactgatggtgttttgaaagcctaaagcatgaaatatttttagatttttatgagtcagcttcagtactcaaatatttgtgattgtgctgcttgtaccagtttggcacttaatgcttgacaagataactttcatttgctgttccaaagtgtgctgtattaaaaagaggaaacagacttcttggttatctccattttctaatcttcatccctgtactttccttaatattgattcttctgtttttccttgcatttttgataagtatattaggaaataaagctggtgatagcagaatagttaaatttctaaaatataanccccactttgactcctaccgntgcctgaggcctgggtccacccaggttgcttctcctcctgaccccactctataggattcagctttgaatattagtaaagtctataagctcttaatttagaccctgaatttacagttactaatggtaaataatttaaccgccagatgacttttagggccttatattggcccagggctatacctgttagtgggcctatttttccaaacttctgagtttggtaaaattcgccttatgaatgaggcagaaaactagtaattcatttcggaaatatgtacaagtttatccggctatgttcaatggacttcattgggaagaatgagaactgtacaatatgtatcacgtggtatttattaacctttgagttaggaatatgacttgattttcaggcactcatcactagaaagcactcacaagagcttctgattggaagagaaagatgattagattaccctgtaagaagccagcagaaattgatgctatcactttaggaaaggcgatcctgcctcctccacgggtgtgagtgaatcccctcttccctttacacaattaatggatggtttataattaattgttaaatgacttccctttttgctaagtgaccttaagtgagtcatttcccttctgtcttatctcttaagtggctgtattacttgttcaatgaagtaatgtaggttaaaatacactgatccttattaagaaggtgtgggcaggtgcggtggctctagcctgtaatcccagcactttaggaggtgggaggattgcttgagcccaggagttagagaccagcctaggcaacataacaaaaccctgtctctncaaaaaataaaaaaattagccaggcatngtggttcactcctntagtccctgctactcaggagcctgaggtggggaggattgcttgagcccaggagtttgaggttgcagtgacctgtgattgtgccnctgcactccagcctgggtaacagagcaagacnctctca

SEQ ID NO: 672019 - DNA, 4478 bp, Homo sapiens
ggtagtcgtggcgctctcgaggccctgccatgagcaagctcttaactcttcaggtctgcacgtcctacgcccaccgtccagtgctactctcagctcggagttcagcttcgggctgccaagagccagcaacctggtgtcagaggctcggtcccacaacgctctgcgggccgcggcgcctgctgggagtgtgtaagtccccgatctgcgtactgcgttcgccggagggggagggcggagctgccggcgtgccgggctgggctggcagctagagtgggtgcgatagccgcctccgcctctgccgctccgccgtcgcctcctccgcccgggccgttcgctgctgcgcggggagagcgaggcggggccgccggggccgccatggagcccgactcggtgattgaggacaagaccatcgagctcatgataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattctgacttgttgtattaggaacatgttggacagtggaaaattttctctggattgttttagtaatatttttgggattatacttcctttctgtaccaatttcttttaatttaaagaactataagtcagttatattatctaccaacaggtaatatagctctttcttttattaactgttctctgtcccccaaccatctcctgatatttggtagagtaacacctttatacgtgtgcttgcctcctaatttaaaatactgtattcgcatgtagatataatgtacataacagtttaacctcaaagttgctggagtcagggccccctgtgcttgagacactaatacagagtgtgttcgcacttagccatgggctgggctcaagaacctgatacctgggttgatgtggattacctagaacccttcctgcagtattcatacagtgtttttattttgttgttgtcattgcgtgtgtgtggtttgtgtgtgtttttaatgagaatcttgttttaaaatgtaatttctaaggtttaacaccaaaatgttttatttgttgtggagtatatattatacaatagagaggtaccttaaacattttttgttcttattctttttctcataagtactcctgagtacaagtggtcacctcccatagtattcatttggcttcgctgtcaaaaatcattattctgtgcagtcgtggccctgggaaggggaaataagaaggccctgttgacgggctgtcttggctctggaattcatgcatcctggccttgccaaggttctggcagggcctgctggtgtgttggagcctgcagggcaggtcaggctggttcagaggcccatgctgaggggtgggtgctctgaagtggagtgaagcctcaagcccatgaatgccaccccagtcatctctggtgtcagctgctgctgtggccccagcaggttctcaaagctcccaagtcctccctacgacacagcccaaatgtgtaaatggcactgttgccctgacagtgcatggaaaggacgttggcatccaattggcactccttctcccttattcaatattaggtttgatttgcccttcgccattgtttccaaagatcaaggaatgtcaataacattttaaaggaccaataaacagcctcctataaagtaaacctcttcccgtggaagcacactctactactaaagggaaggcccctgggctctgatttgtcctttgcattgagaacggtgtggggatcagtgtgtgtgtatgtgatttgtttattgagttggctttgcttttttagtttttcttttaaaaataaaatccttccttcccatgttactaaattaatttatgtttttgagaggttgagtctcaaagtgtaaacaataaacctccattcataaggtggatgttgtaagcttgatggtggttgtgaaagtgatttagctttgaccacttttcatcctacagcttcaatatcaaactggttaggaaagcccagggggaagggagggggcaggggaggaggcaattctgaatgaatgaatggattttttgttgtttttgcatgtttaatatagaagttcccctcgttccttgggagatgatggcctttgaatatgcagacaacctttgaattgtgcctactaaattatagcaggggactttggcacccaaggagttctgactttctgggattataatagtaattcccagccatactctggactttattttgctaaccataactgagcaaatgtaaattactgctatattaatgttttaaagcactgggatagtctaattctaacttgtaattaattatgtttgccaattatctgtttgaaataaatttgtgtctgaacagctattgaaactgttaaattgtacagatattattcatgacagctttgtactgtggaatgtgcttaataaaaaacaaaaaagtttgacttttgtccagtaaattgctaagtaatgtcaataaatcgagtatgggtattatgcagtgcacctaatctggcttcatgcaattgttacttcagctactgattcaaagccaatactcttaataaagtgttgcaatactc

SEQ ID NO: 672020 - DNA, 3950 bp, Homo sapiens
agcggatgttctaagtacttccacagcaaacaagacccaggctcaggcctcaggcctgaaacctgaggctgcaaattgacaaaccagcttctgatttctaatctctcttccaaaacgtagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattctgacttgttgtattaggaacatgttggacagtggaaaattttctctggattgttttagtaatatttttgggattatacttcctttctgtaccaatttcttttaatttaaagaactataagtcagttatattatctaccaacaggtaatatagctctttcttttattaactgttctctgtcccccaaccatctcctgatatttggtagagtaacacctttatacgtgtgcttgcctcctaatttaaaatactgtattcgcatgtagatataatgtacataacagtttaacctcaaagttgctggagtcagggccccctgtgcttgagacactaatacagagtgtgttcgcacttagccatgggctgggctcaagaacctgatacctgggttgatgtggattacctagaacccttcctgcagtattcatacagtgtttttattttgttgttgtcattgcgtgtgtgtggtttgtgtgtgtttttaatgagaatcttgttttaaaatgtaatttctaaggtttaacaccaaaatgttttatttgttgtggagtatatattatacaatagagaggtaccttaaacattttttgttcttattctttttctcataagtactcctgagtacaagtggtcacctcccatagtattcatttggcttcgctgtcaaaaatcattattctgtgcagtcgtggccctgggaaggggaaataagaaggccctgttgacgggctgtcttggctctggaattcatgcatcctggccttgccaaggttctggcagggcctgctggtgtgttggagcctgcagggcaggtcaggctggttcagaggcccatgctgaggggtgggtgctctgaagtggagtgaagcctcaagcccatgaatgccaccccagtcatctctggtgtcagctgctgctgtggccccagcaggttctcaaagctcccaagtcctccctacgacacagcccaaatgtgtaaatggcactgttgccctgacagtgcatggaaaggacgttggcatccaattggcactccttctcccttattcaatattaggtttgatttgcccttcgccattgtttccaaagatcaaggaatgtcaataacattttaaaggaccaataaacagcctcctataaagtaaacctcttcccgtggaagcacactctactactaaagggaaggcccctgggctctgatttgtcctttgcattgagaacggtgtggggatcagtgtgtgtgtatgtgatttgtttattgagttggctttgcttttttagtttttcttttaaaaataaaatccttccttcccatgttactaaattaatttatgtttttgagaggttgagtctcaaagtgtaaacaataaacctccattcataaggtggatgttgtaagcttgatggtggttgtgaaagtgatttagctttgaccacttttcatcctacagcttcaatatcaaactggttaggaaagcccagggggaagggagggggcaggggaggaggcaattctgaatgaatgaatggattttttgttgtttttgcatgtttaatatagaagttcccctcgttccttgggagatgatggcctttgaatatgcagacaacctttgaattgtgcctactaaattatagcaggggactttggcacccaaggagttctgactttctgggattataatagtaattcccagccatactctggactttattttgctaaccataactgagcaaatgtaaattactgctatattaatgttttaaagcactgggatagtctaattctaacttgtaattaattatgtttgccaattatctgtttgaaataaatttgtgtctgaacagctattgaaactgttaaattgtacagatattattcatgacagctttgtactgtggaatgtgcttaataaaaaacaaaaaagtttgacttttgtccagtaaattgctaagtaatgtcaataaatcgagtatgggtattatgcagtgcacctaatctggcttcatgcaattgttacttcagctactgattcaaagccaatactcttaataaagtgttgcaatactc

SEQ ID NO: 672021 - DNA, 1062 bp, Homo sapiens
  misc_feature (857)..(857): n is a, c, g, or t
  misc_feature (919)..(919): n is a, c, g, or t
agcggcgtggatgagggaacattctgcagtataaagggagcaggaaggcgggagacagcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaccatatttaagtgtactgtggttcaaagaagctattgattctgaagtagtgggttttgattgagttgactgttttttaaaaaactgtttggattttaattgtgatgcagaagttatagtaccaancatttggttttgtacagacattatttccactctggtggataagttcaataaaggtctatccnaaaaaaaaaaaaatcgaggttttgcggggggagaagggtttaaaggccatgcatgtgtctaaccgttttaaagggacatgcgggccaatgggttattcaccgtatcttgctattgaagaagcagaaggaagagaaaaaagaat

SEQ ID NO: 672022 - DNA, 4545 bp, Homo sapiens
ggtagtcgtggcgctctcgaggccctgccatgagcaagctcttaactcttcaggtctgcacgtcctacgcccaccgtccagtgctactctcagctcggagttcagcttcgggctgccaagagccagcaacctggtgtcagaggctcggtcccacaacgctctgcgggccgcggcgcctgctgggagtgtgtaagtccccgatctgcgtactgcgttcgccggagggggagggcggagctgccggcgtgccgggctgggctggcagctagagtgggtgcgatagccgcctccgcctctgccgctccgccgtcgcctcctccgcccgggccgttcgctgctgcgcggggagagcgaggcggggccgccggggccgccatggagcccgactcggtgattgaggacaagaccatcgagctcatgaacacttcagttatggcagatcccacatgaagatgagtccccgaacgaacacctactctttggcacgataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattctgacttgttgtattaggaacatgttggacagtggaaaattttctctggattgttttagtaatatttttgggattatacttcctttctgtaccaatttcttttaatttaaagaactataagtcagttatattatctaccaacaggtaatatagctctttcttttattaactgttctctgtcccccaaccatctcctgatatttggtagagtaacacctttatacgtgtgcttgcctcctaatttaaaatactgtattcgcatgtagatataatgtacataacagtttaacctcaaagttgctggagtcagggccccctgtgcttgagacactaatacagagtgtgttcgcacttagccatgggctgggctcaagaacctgatacctgggttgatgtggattacctagaacccttcctgcagtattcatacagtgtttttattttgttgttgtcattgcgtgtgtgtggtttgtgtgtgtttttaatgagaatcttgttttaaaatgtaatttctaaggtttaacaccaaaatgttttatttgttgtggagtatatattatacaatagagaggtaccttaaacattttttgttcttattctttttctcataagtactcctgagtacaagtggtcacctcccatagtattcatttggcttcgctgtcaaaaatcattattctgtgcagtcgtggccctgggaaggggaaataagaaggccctgttgacgggctgtcttggctctggaattcatgcatcctggccttgccaaggttctggcagggcctgctggtgtgttggagcctgcagggcaggtcaggctggttcagaggcccatgctgaggggtgggtgctctgaagtggagtgaagcctcaagcccatgaatgccaccccagtcatctctggtgtcagctgctgctgtggccccagcaggttctcaaagctcccaagtcctccctacgacacagcccaaatgtgtaaatggcactgttgccctgacagtgcatggaaaggacgttggcatccaattggcactccttctcccttattcaatattaggtttgatttgcccttcgccattgtttccaaagatcaaggaatgtcaataacattttaaaggaccaataaacagcctcctataaagtaaacctcttcccgtggaagcacactctactactaaagggaaggcccctgggctctgatttgtcctttgcattgagaacggtgtggggatcagtgtgtgtgtatgtgatttgtttattgagttggctttgcttttttagtttttcttttaaaaataaaatccttccttcccatgttactaaattaatttatgtttttgagaggttgagtctcaaagtgtaaacaataaacctccattcataaggtggatgttgtaagcttgatggtggttgtgaaagtgatttagctttgaccacttttcatcctacagcttcaatatcaaactggttaggaaagcccagggggaagggagggggcaggggaggaggcaattctgaatgaatgaatggattttttgttgtttttgcatgtttaatatagaagttcccctcgttccttgggagatgatggcctttgaatatgcagacaacctttgaattgtgcctactaaattatagcaggggactttggcacccaaggagttctgactttctgggattataatagtaattcccagccatactctggactttattttgctaaccataactgagcaaatgtaaattactgctatattaatgttttaaagcactgggatagtctaattctaacttgtaattaattatgtttgccaattatctgtttgaaataaatttgtgtctgaacagctattgaaactgttaaattgtacagatattattcatgacagctttgtactgtggaatgtgcttaataaaaaacaaaaaagtttgacttttgtccagtaaattgctaagtaatgtcaataaatcgagtatgggtattatgcagtgcacctaatctggcttcatgcaattgttacttcagctactgattcaaagccaatactcttaataaagtgttgcaatactc

SEQ ID NO: 672023 - DNA, 545 bp, Homo sapiens
agaatgagaaaggatgatactgagaagacaaagggaaaaagtagactgcatgcccctctaccaaaagtgttgtttgttgactttcgatttttcgaaagcgagaaaagataaagagctcttgacctgttttgtaagctagatatgtaatttgagtgttcattttgtcacatttctcactaaacggtcaaagctttcagcatcaactaattgtttctaatgcattccagcctttgggatttcagcctgaacaacctctcccctgctggcaaaattattgctttggttcagttcttagggcatccacccttctactgatttgtgatgactagccactgacaaggtggaaggcctttgaaagcactgcataacttccactgatgatgagatcacataccaaatgcacataatccggtaaatgagcaaaagtagaccttttatcatcttcccatggcatgtttcttttctcttgctaaaactttatacctcctacgtggatatttttctacctgtctgctttctactattaaaagaactataacctcaaa

SEQ ID NO: 672024 - DNA, 768 bp, Homo sapiens
  misc_feature (689)..(690): n is a, c, g, or t
agcggcgtggatgagggaacattctgcagtataaagggagcaggaaggcgggagacagcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaaacacacatttggccttttgatttattagcaattgaggtatttggnnaccgggggctcaaaaaaacttttaatcttcaaggggtttaattgttgaccgttttaccgtggggttttatttgggtgc

SEQ ID NO: 672025 - DNA, 4609 bp, Homo sapiens
ggtagtcgtggcgctctcgaggccctgccatgagcaagctcttaactcttcaggtctgcacgtcctacgcccaccgtccagtgctactctcagctcggagttcagcttcgggctgccaagagccagcaacctggtgtcagaggctcggtcccacaacgctctgcgggccgcggcgcctgctgggagtgtgtaagtccccgatctgcgtactgcgttcgccggagggggagggcggagctgccggcgtgccgggctgggctggcagctagagtgggtgcgatagccgcctccgcctctgccgctccgccgtcgcctcctccgcccgggccgttcgctgctgcgcggggagagcgaggcggggccgccggggccgccatggagcccgactcggtgattgaggacaagaccatcgagctcatggcactcatcactagaaagcactcacaagagcttctgattggaagagaaagatgattagattaccctgtaagaagccagcagaaattgatgctatcactttaggaaaggcgatcctgcctcctccacgggtgataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattctgacttgttgtattaggaacatgttggacagtggaaaattttctctggattgttttagtaatatttttgggattatacttcctttctgtaccaatttcttttaatttaaagaactataagtcagttatattatctaccaacaggtaatatagctctttcttttattaactgttctctgtcccccaaccatctcctgatatttggtagagtaacacctttatacgtgtgcttgcctcctaatttaaaatactgtattcgcatgtagatataatgtacataacagtttaacctcaaagttgctggagtcagggccccctgtgcttgagacactaatacagagtgtgttcgcacttagccatgggctgggctcaagaacctgatacctgggttgatgtggattacctagaacccttcctgcagtattcatacagtgtttttattttgttgttgtcattgcgtgtgtgtggtttgtgtgtgtttttaatgagaatcttgttttaaaatgtaatttctaaggtttaacaccaaaatgttttatttgttgtggagtatatattatacaatagagaggtaccttaaacattttttgttcttattctttttctcataagtactcctgagtacaagtggtcacctcccatagtattcatttggcttcgctgtcaaaaatcattattctgtgcagtcgtggccctgggaaggggaaataagaaggccctgttgacgggctgtcttggctctggaattcatgcatcctggccttgccaaggttctggcagggcctgctggtgtgttggagcctgcagggcaggtcaggctggttcagaggcccatgctgaggggtgggtgctctgaagtggagtgaagcctcaagcccatgaatgccaccccagtcatctctggtgtcagctgctgctgtggccccagcaggttctcaaagctcccaagtcctccctacgacacagcccaaatgtgtaaatggcactgttgccctgacagtgcatggaaaggacgttggcatccaattggcactccttctcccttattcaatattaggtttgatttgcccttcgccattgtttccaaagatcaaggaatgtcaataacattttaaaggaccaataaacagcctcctataaagtaaacctcttcccgtggaagcacactctactactaaagggaaggcccctgggctctgatttgtcctttgcattgagaacggtgtggggatcagtgtgtgtgtatgtgatttgtttattgagttggctttgcttttttagtttttcttttaaaaataaaatccttccttcccatgttactaaattaatttatgtttttgagaggttgagtctcaaagtgtaaacaataaacctccattcataaggtggatgttgtaagcttgatggtggttgtgaaagtgatttagctttgaccacttttcatcctacagcttcaatatcaaactggttaggaaagcccagggggaagggagggggcaggggaggaggcaattctgaatgaatgaatggattttttgttgtttttgcatgtttaatatagaagttcccctcgttccttgggagatgatggcctttgaatatgcagacaacctttgaattgtgcctactaaattatagcaggggactttggcacccaaggagttctgactttctgggattataatagtaattcccagccatactctggactttattttgctaaccataactgagcaaatgtaaattactgctatattaatgttttaaagcactgggatagtctaattctaacttgtaattaattatgtttgccaattatctgtttgaaataaatttgtgtctgaacagctattgaaactgttaaattgtacagatattattcatgacagctttgtactgtggaatgtgcttaataaaaaacaaaaaagtttgacttttgtccagtaaattgctaagtaatgtcaataaatcgagtatgggtattatgcagtgcacctaatctggcttcatgcaattgttacttcagctactgattcaaagccaatactcttaataaagtgttgcaatactc

SEQ ID NO: 672026 - DNA, 810 bp, Homo sapiens
ccctttaattcacgccctcatcttttacacactaacacgcttggtaaatattgggcgcccaataatattgtttgttctgccccaattaccctgcgtatattttcagcgcggtttaatttgtctctacatatgtctgcaaccacgtatttttttttaatatcatctcattggttgtcaaatatagtgagatataatcattttcttaaaaaagctcgtttcgatcatccttctctttactagtggtgatttcacctcccccactatagtttgtcttgtatattagtagaatctgcatctggtggtatcatgctttcctcatcagcaaattgatttctctttctcttactatggggtggcttcgcggcacgcccgccgctgtgtgggtcttcacatcgtcgtcgctggtacattgtcctccacgcgccaccactttttgtgtgcagagcccgcagggaggtcggtggtggtgatatctctctccctgtgtagggtgctcacgcgggaggtttcgtagcgttctcctcccctgtgtccccacacactgtggtgtgaaccctccctgtcgtcttcctgctgtagtacaagacttagtaattatagcgcccggcgttgttgtgtgcactgtcgccgccgtaatatccccactatcttcggaggagcgttctgcgcacaggtgcagcttcctctatagtaccccactgagggcccgagattctcctcccgtttatgcccaataggtcgccttcacttccgcgccttcccgtcctcttggggccccccatggcgcctcagccttttttttttcaaaac

SEQ ID NO: 672027 - DNA, 1134 bp, Homo sapiens
  misc_feature (1)..(1): n is a, c, g, or t
  misc_feature (68)..(68): n is a, c, g, or t
  misc_feature (112)..(112): n is a, c, g, or t
  misc_feature (126)..(127): n is a, c, g, or t
  misc_feature (155)..(156): n is a, c, g, or t
  misc_feature (215)..(215): n is a, c, g, or t
  misc_feature (225)..(225): n is a, c, g, or t
  misc_feature (245)..(245): n is a, c, g, or t
  misc_feature (251)..(251): n is a, c, g, or t
  misc_feature (271)..(271): n is a, c, g, or t
  misc_feature (309)..(309): n is a, c, g, or t
  misc_feature (328)..(328): n is a, c, g, or t
  misc_feature (347)..(347): n is a, c, g, or t
  misc_feature (372)..(372): n is a, c, g, or t
  misc_feature (387)..(388): n is a, c, g, or t
  misc_feature (390)..(390): n is a, c, g, or t
  misc_feature (415)..(415): n is a, c, g, or t
  misc_feature (439)..(439): n is a, c, g, or t
  misc_feature (445)..(445): n is a, c, g, or t
  misc_feature (454)..(454): n is a, c, g, or t
  misc_feature (465)..(465): n is a, c, g, or t
  misc_feature (468)..(468): n is a, c, g, or t
  misc_feature (480)..(480): n is a, c, g, or t
  misc_feature (1062)..(1062): n is a, c, g, or t
  misc_feature (1065)..(1066): n is a, c, g, or t
  misc_feature (1070)..(1074): n is a, c, g, or t
  misc_feature (1081)..(1081): n is a, c, g, or t
nacttttccgcacatgcctgtgcctatctgagtatgatgccatggatgtgcccgagaacagcatctgnatgtggaacacaacctgttcaagcaacgactagataaagatggncacccccgtgagcnncagaggctgagccggcatgagcttgggnnaaagtcggaggtgaccggtgtttgacccctgactcccctggacccctgatccgctgtgnagagcctgcntatggctgctgtaggccagnaagatnatccaagtgcctgttaaccnccctgttgaaagaatggtgccggggaggccactatccncccgttagcaggcctgggncccttccaaagcacccccnagcatcacctatttgcagccagctncccgcccgcagcagnncnttccagccccagcaagcatgccagncagccagcaagcaatgaaggctgnccaggntgtatggcnttcttggaagntcnaataagcgtggnccgagaaacttcccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggaccggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagntannccannnnncacctcntaggacagctccagccacaggttgataaatctattgattgattgtgatagtaa

SEQ ID NO: 672028 - DNA, 4198 bp, Homo sapiens
ttttgttgaagaaagctggatacagtaaacggaaagaatcttggaagatgcttgactgctgtcttttctcagactagtctgaactggaaaacccccattcattctggattggtggatctgaagtacaaaatattttccagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattctgacttgttgtattaggaacatgttggacagtggaaaattttctctggattgttttagtaatatttttgggattatacttcctttctgtaccaatttcttttaatttaaagaactataagtcagttatattatctaccaacaggtaatatagctctttcttttattaactgttctctgtcccccaaccatctcctgatatttggtagagtaacacctttatacgtgtgcttgcctcctaatttaaaatactgtattcgcatgtagatataatgtacataacagtttaacctcaaagttgctggagtcagggccccctgtgcttgagacactaatacagagtgtgttcgcacttagccatgggctgggctcaagaacctgatacctgggttgatgtggattacctagaacccttcctgcagtattcatacagtgtttttattttgttgttgtcattgcgtgtgtgtggtttgtgtgtgtttttaatgagaatcttgttttaaaatgtaatttctaaggtttaacaccaaaatgttttatttgttgtggagtatatattatacaatagagaggtaccttaaacattttttgttcttattctttttctcataagtactcctgagtacaagtggtcacctcccatagtattcatttggcttcgctgtcaaaaatcattattctgtgcagtcgtggccctgggaaggggaaataagaaggccctgttgacgggctgtcttggctctggaattcatgcatcctggccttgccaaggttctggcagggcctgctggtgtgttggagcctgcagggcaggtcaggctggttcagaggcccatgctgaggggtgggtgctctgaagtggagtgaagcctcaagcccatgaatgccaccccagtcatctctggtgtcagctgctgctgtggccccagcaggttctcaaagctcccaagtcctccctacgacacagcccaaatgtgtaaatggcactgttgccctgacagtgcatggaaaggacgttggcatccaattggcactccttctcccttattcaatattaggtttgatttgcccttcgccattgtttccaaagatcaaggaatgtcaataacattttaaaggaccaataaacagcctcctataaagtaaacctcttcccgtggaagcacactctactactaaagggaaggcccctgggctctgatttgtcctttgcattgagaacggtgtggggatcagtgtgtgtgtatgtgatttgtttattgagttggctttgcttttttagtttttcttttaaaaataaaatccttccttcccatgttactaaattaatttatgtttttgagaggttgagtctcaaagtgtaaacaataaacctccattcataaggtggatgttgtaagcttgatggtggttgtgaaagtgatttagctttgaccacttttcatcctacagcttcaatatcaaactggttaggaaagcccagggggaagggagggggcaggggaggaggcaattctgaatgaatgaatggattttttgttgtttttgcatgtttaatatagaagttcccctcgttccttgggagatgatggcctttgaatatgcagacaacctttgaattgtgcctactaaattatagcaggggactttggcacccaaggagttctgactttctgggattataatagtaattcccagccatactctggactttattttgctaaccataactgagcaaatgtaaattactgctatattaatgttttaaagcactgggatagtctaattctaacttgtaattaattatgtttgccaattatctgtttgaaataaatttgtgtctgaacagctattgaaactgttaaattgtacagatattattcatgacagctttgtactgtggaatgtgcttaataaaaaacaaaaaagtttgacttttgtccagtaaattgctaagtaatgtcaataaatcgagtatgggtattatgcagtgcacctaatctggcttcatgcaattgttacttcagctactgattcaaagccaatactcttaataaagtgttgcaatactc

SEQ ID NO: 672029 - DNA, 951 bp, Homo sapiens
gacctctgggatgggcggtgcatgcctgtggtactcgcagtgcagaagggtctctggctcagtaagcgcctccgcatcatgtgggggcctgggttcccagccacggggttgtttccgcgcggggtcgtccggctgtgttgacagcaggccggtgtgcctcttcttggctgctgtcggcttctgcttcggtgggtgtacgccatggccttggcgctgcgttaattgagccttcctcgggatccgagtggagcatgctgggttttcccagctatcagcctggaaagcgttggcggggatatgggcttgccgtttctggcctacctcgggtgtgattcatgcctcgcaggtattcgagttgcaggtttgcctgactggtccggtgagcctgaagagtgttcgcgttgtgcgtaggcaagatccgccctttggtacgtcgagtcataggctgccgagactcaggtagctgacgaaggagattaaagaatctgcgtagacgttccactaggattcccactgtcttgggggatctatgatgccggatccttgcgtttctgagattctattttacaacgtgcatgcttaacatacaaatagataaaaagcacgaactgtgaggggtggcatatcggtcgctaccggaaaactcgctatgggggcgcggcatgtgccaacgcgatgcttggtatgccggatgtcaacctttcgctgcggcctccctgagtcaaatctcgggggtcacgtgttagtgtcaccttggggttcggcaatccgattctcatctggggatcctggtggggccacaaccggttggggctggtcaggcgggtcccccttgggggtgtggggcgcaccctgggccgattgacgctcgcctgggcccgccctgagccaaccgggggggggacccccggcggggggccatccgggagggggccagccgggggcgcaaaa

SEQ ID NO: 672030 - DNA, 860 bp, Homo sapiens
  misc_feature (138)..(138): n is a, c, g, or t
  misc_feature (165)..(165): n is a, c, g, or t
  misc_feature (171)..(171): n is a, c, g, or t
  misc_feature (180)..(180): n is a, c, g, or t
  misc_feature (191)..(191): n is a, c, g, or t
  misc_feature (194)..(194): n is a, c, g, or t
  misc_feature (206)..(206): n is a, c, g, or t
  misc_feature (788)..(788): n is a, c, g, or t
  misc_feature (791)..(792): n is a, c, g, or t
  misc_feature (796)..(800): n is a, c, g, or t
  misc_feature (807)..(807): n is a, c, g, or t
caaagaggtgctgaggcaaaagatatcaagtgctgtaacacctgtcacgatgtgctgtaggcatatagtggatgggggtgtgcgttcaagaacccagatactcccgagcagtgccggagagagggcttcagccagaanatgcaggagcagaagaatgaaggctgnccaggntgtatggcnttcttggaagntcnaataagcgtggnccgagaaacttcccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggaccggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagntannccannnnncacctcntaggacagctccagccacaggttgataaatctattgattgattgtgatagtaa

SEQ ID NO: 672031 - DNA, 461 bp, Homo sapiens
gggtctgccacagcatgggtgactcttaaaaccatgtctaagtgaatagaagccccgcataaggatcacatagtgcatgaattcactgctatgaaatgtccagaacaggcaaatatctagagacagaaagcagattaacagttccctagggcgccactgcagtccgcagtccggcctgggcaacagagcgagactccgtctcaaaaaaaaaaaaaaaaaaaaacggtcccctaggcctagggggttgggttggaccagattcccggggtgagggcaagggggtcccaggtgttcctttgggaaggttaattaaagattttcctaaaattggacttatgtggtgatggattgcacacactcgtgaattatacgtgaaaccacatgtgaccattttaaaatgtggattaactctcattccaggttttgacttacatatcctgaataagggttgttttctttaa

SEQ ID NO: 672032 - DNA, 795 bp, Homo sapiens
  misc_feature (723)..(723): n is a, c, g, or t
  misc_feature (726)..(727): n is a, c, g, or t
  misc_feature (731)..(735): n is a, c, g, or t
  misc_feature (742)..(742): n is a, c, g, or t
tgaggcacagagaggtctgggggatttgcctctccccaggctagtgtagcaggcctggggctgcttagatttcaatgcgcctgctctttgattgctgcccttctactcgcgttgttatccgttcctcgcgggtgcccgactcgtcatgcctgccatcactgttcttctgctggtctgcctgcggctgggcggtctaggcaaggcagagtctctgtgtacccgctcgctcaaggctgcccatggcctgtggatcagcatctcgagcagagtggtcaggatgacgatggggctgaggccagagtgaagtcaggtcagccttggtgcgtctttggagagctgcttctcagcctggaccccctgtgagaacacccacctaaatgctgccaggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagntannccannnnncacctcntaggacagctccagccacaggttgataaatctattgattgattgtgatagtaa

SEQ ID NO: 672033 - DNA, 602 bp, Homo sapiens
  misc_feature (17)..(17): n is a, c, g, or t
  misc_feature (19)..(19): n is a, c, g, or t
  misc_feature (22)..(22): n is a, c, g, or t
  misc_feature (132)..(132): n is a, c, g, or t
  misc_feature (136)..(136): n is a, c, g, or t
  misc_feature (143)..(143): n is a, c, g, or t
  misc_feature (397)..(397): n is a, c, g, or t
  misc_feature (459)..(459): n is a, c, g, or t
gcacgagtgtggaatgncnccnccacaaatctctgattgggaagaaaggacaacagaagactgtctaaaggatgcctggattccttgttatctcaggactctaaatactctaacagcagtccactggaatcnccancactggncagctgttagagtatttagagtcctgtatctctgtgaaaaacacaattttgcctttttgtaattctatttgagcaagttggaagtttaattagctttccaaccaaccaaatttctgcattcgagtcttaccatatttaagtgtactgtggttcaaagaagctattgattctgaagtagtgggttttgattgagttgactgttttttaaaaaactgtttggattttaattgtgatgcagaagttatagtaccaancatttggttttgtacagacattatttccactctggtggataagttcaataaaggtctatccnaaaaaaaaaaaaatcgaggttttgcggggggagaagggtttaaaggccatgcatgtgtctaaccgttttaaagggacatgcgggccaatgggttattcaccgtatcttgctattgaagaagcagaaggaagagaaaaaagaat

SEQ ID NO: 672034 - DNA, 1177 bp, Homo sapiens
attatggatttagtatccaaaagacaagtgtttttaaaaagaacctattaccatacttcgtgtatctgttctatagagttaaaccttttaacttccatgagccaccatgcccggacccttattttactttatcctcctgattatttgaattatgttacactaagcatgtattttataatcaaaaataattaagatttaaaaccaatgtatttgactactaagaacagcaaattatataaatcagttgcacatcacataatgttgttaacagaggctgtttagcactaatttgaccaaatctatagtcaaagtttgcattctacttgaatttatttggaaatttgctgttgtattacttattctttgccttgttctctgtgaagtcctttcctaaaaaagaaacttatacaatttagttcacaaaactaacgttgaccgtctttctctgtcagcaaatgaaaactaaatcatctatcacttgagaaataattctgatactcttcattcctataacagtacttaccgcatagacctcataggatggtcgaacttatgctgccacatatcagtacaccagtaaccacagctagctgtaaacattcgaacaattcagttcagtcaaactagccatctttcaagtgctcaacaggcactggtggcctatcggttaccctaactgacccagccaattcataggctaatggcccgtcatcatagaaaaggtctaattggacaaacatcgggtctaggacactctaatgtagcacttgacccgttaacaaacaatccattaaggagttatatgcgcaaggtaaacgtgactaaatttgacataacgtcaggctggcgacaaaaaggcaaagctgaagtcgcaccagacacacaagaggtatcacaggtaccgcacagagcaacacggaggcgcacagggaaaaacctgcccacgataccgtgaaaacaccaagacgtcgaaaaaaaccaaacaggggagcagctaataaatctcaaggaaaacagacaacgagccaccacgcaggtcaacggcccacaaggccgacatagcgcggcacgacacaaggcggagacatgatagtgtagcaccatggtggaagcaaccatgagacatcaatacaagcgaggcacacgacccagtacagacgagaagccacagacgagc

SEQ ID NO: 672035 - DNA, 500 bp, Homo sapiens
agggctagggatcgctccggagctaccggttaacatggaagtatacatgcactctggaaagtgcactttccagaggtgagaaaacaaaaaagacatacacaatgctgagattatcaccaataacatcccagacctcaaatatgagagggagacagtcctggagccacagagaagtgaaaaacccagaagcagataataagagaattggactttctatttcatttattttgagagagaatctcactttctatctgcagtgcccctcccagaaatctgcccaggaccacacttacccaccaacttatggtttctactacactggaaaaagtaagatcaaggtggacaaccagcttccctaccacctggggttaactggcaggagatctatccctgcctcaactgacaggaagcatcaggaacacccaaagggagacatatccctgaggacaggcagacacaaaggacgcagagaatgactaccatccccagtcctggaaact

SEQ ID NO: 672036 - DNA, 1075 bp, Homo sapiens
  misc_feature (870)..(870): n is a, c, g, or t
  misc_feature (932)..(932): n is a, c, g, or t
agcggcgtggatgagggaacattctgcagtataaagggagcaggaaggcgggagacagcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacataccacacaaccacttaacacacaaaaaaaaaaaaaaaaacaacattaatcactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaccatatttaagtgtactgtggttcaaagaagctattgattctgaagtagtgggttttgattgagttgactgttttttaaaaaactgtttggattttaattgtgatgcagaagttatagtaccaancatttggttttgtacagacattatttccactctggtggataagttcaataaaggtctatccnaaaaaaaaaaaaatcgaggttttgcggggggagaagggtttaaaggccatgcatgtgtctaaccgttttaaagggacatgcgggccaatgggttattcaccgtatcttgctattgaagaagcagaaggaagagaaaaaagaat

SEQ ID NO: 672037 - DNA, 1429 bp, Homo sapiens
  misc_feature (138)..(138): n is a, c, g, or t
  misc_feature (165)..(165): n is a, c, g, or t
  misc_feature (171)..(171): n is a, c, g, or t
  misc_feature (180)..(180): n is a, c, g, or t
  misc_feature (191)..(191): n is a, c, g, or t
  misc_feature (194)..(194): n is a, c, g, or t
  misc_feature (206)..(206): n is a, c, g, or t
  misc_feature (1224)..(1224): n is a, c, g, or t
  misc_feature (1286)..(1286): n is a, c, g, or t
caaagaggtgctgaggcaaaagatatcaagtgctgtaacacctgtcacgatgtgctgtaggcatatagtggatgggggtgtgcgttcaagaacccagatactcccgagcagtgccggagagagggcttcagccagaanatgcaggagcagaagaatgaaggctgnccaggntgtatggcnttcttggaagntcnaataagcgtggnccgagaaacttcccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggaccggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaccatatttaagtgtactgtggttcaaagaagctattgattctgaagtagtgggttttgattgagttgactgttttttaaaaaactgtttggattttaattgtgatgcagaagttatagtaccaancatttggttttgtacagacattatttccactctggtggataagttcaataaaggtctatccnaaaaaaaaaaaaatcgaggttttgcggggggagaagggtttaaaggccatgcatgtgtctaaccgttttaaagggacatgcgggccaatgggttattcaccgtatcttgctattgaagaagcagaaggaagagaaaaaagaat

SEQ ID NO: 672038 - DNA, 153 bp, Homo sapiens
ccggacctctctgctccagagtgctggattcgaggctgacccaccagcctggccactgaaaatattcaaattgactaaaactgtatttacaaagatctagagatttcaactataacgctcacaggaggaaactcaggaaaaggtagtatagtg

SEQ ID NO: 672039 - DNA, 229 bp, Homo sapiens
gggcccgggttttaaaaatttaacctttggggtttggggtccccccccagggctcccgcccccctttttggttgggttttgggacctttttggggtttcggttttggcccaagggttaaaaaacccccgtttggggttttttttttttttgggaaggggggttggggtaaggggcccccggttcttttttttttttttggcccttcccttaaaaaattttttgagggga

SEQ ID NO: 672040 - DNA, 265 bp, Homo sapiens
attgctgctgttcttgaggttccccgacggcaggtccagctatgactggtagccctcacacgataactagtagataataacatatatccaacccttggtaaatgccaggactcatcctaagagcctacatcgataaactcctttaatcttcacaacagctgggaaatatatatatatacttatcactccttttacagggtgagaaaacttaagggacagtacagattatctcccttgcccgtaggctcagagaagcttgtaagcc

SEQ ID NO: 672041 - DNA, 699 bp, Homo sapiens
  misc_feature (277)..(277): n is a, c, g, or t
gaaaccagcaagccaaaagacagcatgacaaaatagagaaattcagtcacgtagggaaatgcacagtgaaacagcaccctgagatacctcttcacacccaccgggattgtgataactgatcaatagtgacaaggacccatacaagtgtgtatgaggacatagagaagctagaaaccttgtacacttgctggtgggaatgtgacactatggcaggcactgtagaaaacactatggaggttccgcagaaagatcaaggctctagaatcaactatatgancctagcaagttccattgtcgtagggaatataccccaaaacagacttgcattcacaacagtactgagaacaaatagcacatacagtgcagcatgttcacaggcaggcgttcgtttacaatagcgaaaagctgtggacaacagctcacatgtgtcatcactgagttaatggataacgccaatagtcggcgattgtgcatcacatgcacatattatctcagctattaaaagaaggaactgacgtactggatacagtggtgacaacctggcatcaactctgtaacaaaacaggtgctatggtgaaagaagacagaagctatcaccatatttgatgggaagtgactgcttcactgtgtacaagtcgctcttgaccaggtgaaacgtgcggaatacgaaaagtgacctagacaccatgggatagccag

SEQ ID NO: 672042 - DNA, 860 bp, Homo sapiens
  misc_feature (1)..(1): n is a, c, g, or t
  misc_feature (221)..(221): n is a, c, g, or t
  misc_feature (229)..(230): n is a, c, g, or t
  misc_feature (300)..(300): n is a, c, g, or t
  misc_feature (305)..(305): n is a, c, g, or t
  misc_feature (309)..(310): n is a, c, g, or t
  misc_feature (312)..(313): n is a, c, g, or t
  misc_feature (316)..(316): n is a, c, g, or t
  misc_feature (324)..(324): n is a, c, g, or t
  misc_feature (331)..(331): n is a, c, g, or t
  misc_feature (333)..(333): n is a, c, g, or t
  misc_feature (341)..(341): n is a, c, g, or t
  misc_feature (346)..(346): n is a, c, g, or t
  misc_feature (348)..(348): n is a, c, g, or t
  misc_feature (360)..(360): n is a, c, g, or t
  misc_feature (371)..(371): n is a, c, g, or t
  misc_feature (378)..(378): n is a, c, g, or t
  misc_feature (389)..(389): n is a, c, g, or t
  misc_feature (402)..(402): n is a, c, g, or t
  misc_feature (413)..(413): n is a, c, g, or t
  misc_feature (420)..(420): n is a, c, g, or t
  misc_feature (553)..(553): n is a, c, g, or t
  misc_feature (587)..(588): n is a, c, g, or t
  misc_feature (670)..(671): n is a, c, g, or t
  misc_feature (694)..(694): n is a, c, g, or t
  misc_feature (738)..(738): n is a, c, g, or t
  misc_feature (761)..(761): n is a, c, g, or t
  misc_feature (792)..(792): n is a, c, g, or t
  misc_feature (796)..(796): n is a, c, g, or t
  misc_feature (838)..(838): n is a, c, g, or t
nctttttgtacattaaactttagcagcaagaacattgttttctcttagatttgcagtagctttggggcaaatgataaatcctctggaactgccattggtaactcaacaatgatgaaaagaactaaacaacaaatgaataaattaacctcaacatagcaatttccagtccacacaatatggggcagtttgtaataagactcggtgaaaatcctgtctctgcnacttggcnngctgtgcagctatgggcaagttattcaactctcctaacctcaatctccccatctaaaaatggggcatcgnggggntgtnncnnggnttacgtgngtcggtntntacgaagngcttngntcagtacctggnacacagtaaanggttgtnactccacaganacttttatttgtnaatggtaaatnctctggnaacggtgactatgctcacttgccccattatcagccaaaaccaaaatgtgacaatattggtcttacctatgtggtttctgttttattgagaatagctagtgcactgcttattattttttccacgttttaagctnacagctttattgagctgtaattcatataccaaannattcaccctcttacagtccagtggtttttagctctattcacagcattgtgcaatcaccaccatctaattcagttccccccgnngcaactcagtgcccactaaccgncactcctcaccctagccctaagtgaccaccaatctgctttttgnctttatgagtttgcttattaggncctttcatatacatggaatcctacaacatgnggcnctttgcctctggcttctttccctggcacaatattttcaaggntcatccatgttgcagcatgtgc

SEQ ID NO: 672043 - DNA, 196 bp, Homo sapiens
gcatacagattctctgtctcacaattcggagaccatcagagctgtgaatagtgttacagtgaggcggcatcatagtccgcgtatcacgtctgaccagtatgggctcaattctgctaagggatatatgacgtgtgatgagctgacacagaggcagactgctgaaagagaacgcgtggtgggtcgagctcgatcgtaa

SEQ ID NO: 672044 - DNA, 377 bp, Homo sapiens
tcgtgtctatgccacgatcctacctcctctagactatggagcagacccagagcctctcacctgtaccatagcctacctcctatgacattgacagactcagatcctcataccagggccagatcctacttcctcagatattgacagatccagatccttatacccatgctcagatactacctcttcatctactgacagacccagatcctcataatcctaatgggccagatcctgccttctcagacatgaacagacccagatccttatacctgctccagaccctacctccgcagacatgaacagacccagatcctcatactcatgccagatcctacctcctcagacacggacagactcagatcctacctcctcagatatgg

SEQ ID NO: 672045 - DNA, 809 bp, Homo sapiens
  misc_feature (97)..(97): n is a, c, g, or t
  misc_feature (104)..(104): n is a, c, g, or t
  misc_feature (207)..(207): n is a, c, g, or t
  misc_feature (222)..(223): n is a, c, g, or t
  misc_feature (265)..(265): n is a, c, g, or t
  misc_feature (267)..(268): n is a, c, g, or t
  misc_feature (270)..(270): n is a, c, g, or t
  misc_feature (372)..(372): n is a, c, g, or t
  misc_feature (382)..(382): n is a, c, g, or t
  misc_feature (390)..(390): n is a, c, g, or t
  misc_feature (422)..(422): n is a, c, g, or t
  misc_feature (504)..(504): n is a, c, g, or t
  misc_feature (560)..(560): n is a, c, g, or t
  misc_feature (568)..(568): n is a, c, g, or t
  misc_feature (571)..(571): n is a, c, g, or t
  misc_feature (585)..(585): n is a, c, g, or t
  misc_feature (621)..(621): n is a, c, g, or t
  misc_feature (646)..(646): n is a, c, g, or t
  misc_feature (665)..(666): n is a, c, g, or t
  misc_feature (720)..(720): n is a, c, g, or t
  misc_feature (745)..(745): n is a, c, g, or t
  misc_feature (805)..(805): n is a, c, g, or t
ggctccgggcttcctgcaagccgaatttagctctgccaagccacgtggaccgcagcgggctcggcagaggccgagcctgggagacgccggaggcggnctgcggngcggggacctgatcggcgccccgagaggagctccccgctctactggacgcggccctcaagctggcggggctaaggaaaaacgcccgggaggcccgggagccantggggtccgtttcannaggaagacgggcacgcaccgagaggatggccgatgccccgcngnncncgagtcgggggcacggtggggagaaggggccgatcccctgctggcgaccgggcagagcacccacttcctctaagggcgcgggactcgaagtgggatttaggnagggggaaangaggagcntgggctggaagactcttgcggccagaaccgcnttcagagccacaaagccgggcactgcggccggccctggtcccggccccggccctggcccagcccttgccctgagctcgcctnccgccgctttttccttaccagatgcggaggctgcggctggatacttggggtttgcngattacgnttncatgttattcagcnctccctcttttacagggaagcgggggcggtggaganttcttttgctgaaaggcagagtgcngcgctttttccttgctccnnctggagagagatcaaccttttgcagtggaaggggagagtcccccagcctttgtntcatcagacggctgctgtagtacanggattcaggccagggcccgcatggccggacttcttggttcaaatcctgcactgccactcnacgg

SEQ ID NO: 672046 - DNA, 836 bp, Homo sapiens
ctccgtgtggggtgcgcaggagtgtcgcccggcgcgtcactgtctgtggtctggtgcgagccactgtgtggtgccgccgcagcaccatgtgctgaccaccgtcagcactcagcgcgggccggtgtacatcggtgagctcccgcaggacttcctccgcatcacgcccacacatgcagcatgctggcatgtgtccatgctgtgactgcccatgtgctgttgccagcgagctgcaatgtactgtgaggtgctgcagtgtgtgcacctgtggtgtgcctgactgaacatcactggtgtgtacagtgcaaagtttggccaatgaattactgtgcatgaccctgcatggacccctactgcctgactgctgcctgtgtgctaacgctgggttgtacggaagactgcccactggcacacaattgtgctgccaagaatccccgcttgtgaactaatggtcatccactgcacgtgtgcccccgagtgcgtggacctctttctatctctgatgatcttctgatgatgagagcccttctccatgtgacgacctgcattgccttggacccacatcaccatcccgtgagtccctgagtgcatgggctatgggtgtgctgtgaccaagtcggtacacgccttgagcagcgtcagtgccaggggtgtgactcaacaatgtgccttggcattgatcaaacctcgctctatgtctcttactggcgcctgctttccagccttgccactggtgattgccaaccccagccctgtgtgtccttgactgccaaacaggtgtaccagcactgggctggtatggcgtaatgtgcccatcacagggatgccggtgctctgta

SEQ ID NO: 672047 - DNA, 338 bp, Homo sapiens
ccgtttccccctaaaaatcaatcactccctactttgtaatctcagtagtaactttctatctctcacattctgatctacattatgtgtgaagttcattttctacacctccttaaaggtggaaaatgtctcagtgcagtatctagaaaaatcactggcataatgtctaataaatatttgttaaattacaaaaaaaatgggattcaccattcacttctccccgaagtgtcttgatcttatgttttaatcagatttatacttacagcaaaactataatgttcttatatgcccattattttctaaagcagtattaggacttgtaagacaagatggggccggct

SEQ ID NO: 672048 - DNA, 628 bp, Homo sapiens
agcgggtcggcagcgctgctcctggagccgctggagggtgcgggtttgtgctgcggtggtttctgtggcggttgctgtggcggcgtttggcggttggagacgaaatccaggtacttcactagactggtaccttctgccaccatgggggagcttttccggagtgaagaaatgacactggccctagctttttctacgagtcgatgaggctgcttagttgttgtgtcagtgaattagtaggaacttggcacggttcaggtttcgtgacttaaactccagatgtgaatgctttgtccaacggtaacactttgtgcactgacagcttagcacgatgtgcacaggacaatggaatcgaacgcttcgatttgtggagaactgagatagagcaaagctaacattccgattatggacaccggtgaataacccagaggttcccttcccccgggacatgattgacttagaggccatagttttgacgaagattgacaatgaactgaaggaaatcaactacaaatccaggaagctctgaagagaaacttcctggaactggccgaattacaatttatacttcgcagaactcagcaatttgttgatgagatggcggatccagacttgttggaagagtcctcat

SEQ ID NO: 672049 - DNA, 100 bp, Homo sapiens
tcatcaacccttcatcaatcccggaacactctattaaacatgatttacttatatgactaaaacaaataaatgaatgtccatgtggatagggtttcgatga

SEQ ID NO: 672050 - DNA, 552 bp, Homo sapiens
cgcggtggctcacgcctgtaatcccagcactttgggaggccaaggtgggtggatcacagggtcaggagattgagaccatcctggctaacacagtgaaaccccatctctactaaaaatacaaaaaaattagccgggcatggtggcaggcgcctgtagtcccagctacttgggaggctgaggcaggagagtttcttgaacctgggaggtggaggttgcagtcatgcgactctaccccagcctgggtgacagcaagattctgtctcaaaaaaattacaactaacaataaaatacaaatacacagacatcagtcatcggctttagggcccaccctaatctattcactgacctcatcttaacttgatcgtatctacaaagcactctatccccacaataaggtcaccatttctgagcgttctagtggcacattaaaactcggggtacaggcggaatggctatctaaccccagtaccacttcgaggttcaagaattcaacctaagcctttacctgtacagctctccgggccattcaaggaccattacaccacaacgact

SEQ ID NO: 672051 - DNA, 141 bp, Homo sapiens
cttgggtaagttactggacctcttggaggcccagggtctttatctgtaaatgggatgaggatggactcttcatggggctgcaatgtaacaacacatagaggcgacacggctggtccatacgaggcgaggcactctcctaaa

SEQ ID NO: 672052 - DNA, 461 bp, Homo sapiens
catctctccccctttcctggagcctccctattccctgagacataccatatggaaattaggccaattaataaccccacaatggcctctaagtgttccagtgaaagaaagagttgcacatccctgactgtaaatcaaaagctagaaatgatcaagcgtagtgaggaaggctgaaacaggccaaaagacaggcctcttgcaccagttagccatgttgtgaatgcaaaggaaaatttcttagaggaaatcagaagtgctaccccagtgaataaaaaaatggtaagaaagtgaaacagccttattgctgatagggacaaaatatgaatggtctggatggaagatcaaaccagtcacaatagtcccttaagccaaagcctaatccagggcaaggccctaactctctcaactctatgaagtctgagagaggtgagaagtttgaaagtagcataggttagttcatgagg

SEQ ID NO: 672053 - DNA, 375 bp, Homo sapiens
gagaaacgctgtgacgttgatatgtactacagatatataattatgcggacttaagagctacaagagtagtttagagagaacggatatctaagtgcgctataaggatgttacagcaagtgagtaccagaagcttcacattctctaataggagaggacttagagaaacgatagatgatgctgccagaaaccagatgtgagcatagctgagtaggcatgactcgcacctgcgcaggagaactatgtatccgccagctctgatacagatatgagttgtgattagaggacgcctagctgtgtcagagagaccataatgagtagagaattcattgggagcagacgatcatgcttataagctctggaagcctatcatcgttt

SEQ ID NO: 672054 - DNA, 185 bp, Homo sapiens
tgcactgtagatcgctctgcacctagatcgctctgacctgtagatccctcagcacttaagttacagttagtctctaatgtgctttgaagcttgctttagcagttccaggtctcttctgcggacaggggtggctcggggacaaccatattcgtccagctgcaaaggtatggagcgatctacagggg

SEQ ID NO: 672055 - DNA, 270 bp, Homo sapiens
  misc_feature (63)..(63): n is a, c, g, or t
  misc_feature (96)..(96): n is a, c, g, or t
  misc_feature (111)..(111): n is a, c, g, or t
  misc_feature (115)..(115): n is a, c, g, or t
  misc_feature (119)..(119): n is a, c, g, or t
  misc_feature (123)..(123): n is a, c, g, or t
  misc_feature (165)..(165): n is a, c, g, or t
  misc_feature (181)..(181): n is a, c, g, or t
  misc_feature (184)..(184): n is a, c, g, or t
  misc_feature (193)..(193): n is a, c, g, or t
  misc_feature (197)..(197): n is a, c, g, or t
  misc_feature (200)..(200): n is a, c, g, or t
  misc_feature (205)..(205): n is a, c, g, or t
gtcctgagtcccggagagagctccagcaataggggccatgtcgccatagccccagcctctcgntccgcagcctcagcagcgtcccagccggctggnttcatagctcgggtncatngcancatngttcctgggttgagggggcaatcgggcacgctcctccccatnggttgccatcatgttnatnggatatcgnactntgnccagnacctcaatgaccttaggaggggacttcagctcagctgcgatttacttccggagggcgcatcacca

SEQ ID NO: 672056 - DNA, 467 bp, Homo sapiens
  misc_feature (13)..(13): n is a, c, g, or t
  misc_feature (38)..(38): n is a, c, g, or t
  misc_feature (63)..(63): n is a, c, g, or t
  misc_feature (69)..(69): n is a, c, g, or t
  misc_feature (289)..(289): n is a, c, g, or t
  misc_feature (354)..(354): n is a, c, g, or t
  misc_feature (455)..(455): n is a, c, g, or t
  misc_feature (457)..(457): n is a, c, g, or t
aacccgtctcctnaaaaaaaaaccccaaaaaaattaantttttctttttcccaaaggtgcccnaggccnacccccctatgtcacgccctgaaagtagttattgagaaaagtcgtcccctttcccccttttcctataacccaaatagacaggaatggaagattctccctcggggcctgaaagcttgcgggatgaataactcctcctcctcaggcccagtccccaaggtacaaacttgcacccagcagcaagatagcagaggcaggaagagagctggctggaagacacgtnccccctgaagatcaagagggaggtcgccctggtactacatagcagtcacgttaggctgggacaantcctgtttacagaggactataaaacccctgccccatcctcacttggggctgatgccattttaggcctcagcctgtctgcatgcaggcgctcattaaaaccnantgttgctcca

SEQ ID NO: 672057 - DNA, 104 bp, Homo sapiens
gtcgtccgaggctgtccgccgcttgccaccattcacccgagtaccccgggaccccgccgcgtcctgcggggagaatatgttgcttgaagttctgctgattaggg

SEQ ID NO: 672058 - DNA, 374 bp, Homo sapiens
tcgacctctccacccagaaacttccaggcagctcagccttcaggcaacagagagttattagaaaccccacaaagttctcctgccaggagcggtggctcacacatgtcttcccagcactttgggaggctgaggcaggagaatcgcttgaggccaagagttcgagaccagcctggccaacatggagaaaccccatctctactaaaaatacaataattagccgggtgtggtggcgcccacctgtaaccccagctactttggaggctgaggcagaagaatcgcttgaacctgggaggcggaggttgcagtgagccaaggtcacaccactgcactccagcctgggtgacagagcgagactccgtctcgtcgacgcggcc

SEQ ID NO: 672059 - DNA, 247 bp, Homo sapiens
  misc_feature (11)..(11): n is a, c, g, or t
tgtgtcaaatnagactggagttacagcaaaggacttcccacattccttgcactcataaggcctttctactgtgagttcttcgatgctgaaggagagaatggcttcagctaatttttaccacattccttgcactgatctccaggatgaactcatgtgtttcttgagactggagctttcagcaaaggatttcccacattcagtgtgctcataaggcttttacccagtgtgaattccttggtatgaacac

SEQ ID NO: 672060 - DNA, 893 bp, Homo sapiens
  misc_feature (628)..(628): n is a, c, g, or t
  misc_feature (763)..(765): n is a, c, g, or t
  misc_feature (767)..(767): n is a, c, g, or t
  misc_feature (803)..(803): n is a, c, g, or t
  misc_feature (859)..(859): n is a, c, g, or t
tggctgctgcgtgggagtaggagggcgcttccggtggcggactgcagtgccgtggcgggcggggtgcggggctgcggctgcggtggcgcagcaggcaggtcagcgggactatgatctcctggtgtgtctggcggggggatctggtggcctggcttgtgccaatggatgtgcctgctcagctgggaacggaatggtgtcctgtggtggactacgttggaaccttctccccaaggcaccctgtgtgggtgcctctggctggcaacctggctgttcaactgttggtgcttgcaatccccaagaagctgatgcaccaggctggcactgctgggaggcctgatccaagatgcccccaactatggctgggaggtggccagccgtgccgcatgactggaggaagatggcagaagctgttcaaaatcacgtgaaatccttgaactggggccacgtgtccagcttcaggacagaaaagtcaagtactttaacatcaaagccagctttgttgacgagcacacggtttgcggcgttgcaaaggtgggaaagagattctgctgtcagccgatcacatatcattgctactggagggcggcgagataccccacgcacatcgaaggtgccttggaatatggantcacagtgatgacatcttctggctgaaggaatcccctgggaaaaacgttggtggtcggggccagctatgtggcctgggagtgtgctggcttcctcaccgggattggggctgggacaccaccatcatgatgcgcannncncccttccgcggctttcgaccagcaaatgttcctccntggttcataggaggcacatgggcatcttcatgggcacccggtttccttgagggggntgttgccctttccggcgggttcagggaggcttcc

SEQ ID NO: 672061 - DNA, 468 bp, Homo sapiens
  misc_feature (82)..(82): n is a, c, g, or t
  misc_feature (242)..(242): n is a, c, g, or t
  misc_feature (306)..(306): n is a, c, g, or t
accatattgatattggaaactatttgattgctgtggtactggcgattaggcttacgctacggtgactattagacaatatacngtttattagagaattgctttggaattgttgctgatatgcggcggtgctgggtataagagcatgtgctggagataagtaccttttgctgtggaaaatgggaaccgggtaaattgttgcaaagatagtgatgtgatggggtgacacccggtcaaggggtgtncctggcaaaatgggcacgtggcacagcctaattggcgcgtttgggtgccggatagaatgccgtnaaaaaaaaatatgcacgaggggaggggtggtaagatcgatgaacggggggcaaaaaagcgatatttgcatttagcgggcggtaaacagagggtataataagcttgagccttgagagtgcttaggcagaagaatcgtgctagaacgaggggtaagatggagac

SEQ ID NO: 672062 - DNA, 329 bp, Homo sapiens
ggctcggtacctaccttcctgctccccatagtaaccttgctcgtgtaatccgtcaccgcagttgtgagaccgaacatgaaggattgcatccacccgagtgactggtgccatagtcctatccttggtgcatcaccccaagtccttcgacgtagtcctcataggtgccctggtgcctagtcctcggcgactgtctgcagcatgggcagaaagtgctcaaagtccagcaccttcacattcatctcatcactcttggggttccccaggaccttgagcacctcggcgttggtagggttctggcccagggccctcatcacatccccacactggct

SEQ ID NO: 672063 - DNA, 424 bp, Homo sapiens
tacatggtcggacattaacaagcagtgagtaaggctggttgattccaatgcagttaatgcgctatccacgtctccgaaggacaactggaacagaagacagccatgtcactcctgtagaaagtcctatccccttgttttgcattgctaaaggaactgcattccagaagccactgagaaatacttaggaggaacagacgacactttcaaaaagaaagacctgttcctggacttgatagcagatgtgatgtttggtgtcccatctgtgattgtggcccggagccacagagatgctggagaacccacctacatgtatgagtttcagtaccgtccaagcttctcatcggacatgaaacccaagacggtgataggagaccacggggataagctcttctccgactttgggggccctatatttaacagaggg

SEQ ID NO: 672064 - DNA, 465 bp, Homo sapiens
cctcaaggtccttagccccaagggctttaggtggtcagaatggcaaatgagcattctcttcaacatagtcactagctgcatcaatctctaacattaagagtccgcctgcccttttaagccaggcattgatttctcctctctagctattaaagatttagatggcatcttcttccaatagaaggctgttttgtctacacactgaaaatctgatatttaatgtagccactttcaaatcaatgaccttagctagatcttctgaataacttgctgcagcttctatattagcacttgctacctcaccttctatttttatgttatagagaaggtttctttccttaaacctcatgaatcaacccctgctagcttcaaccttttctgaagcttcctcacttctctcagccttcatgtaattgaagagagttagggtcttactctgaattaggctttggcttaagggacccttgg

SEQ ID NO: 672065 - DNA, 154 bp, Homo sapiens
ggggttaaaaaaattttttttccggggccgcccccgtttaaatgaaaatttttttccccctgggccccttgccccttaaaaaaaaccacctggggggaaaaaaggggccaaaatttccaaaaaaaagaccgtttttggggggggggtgtcctta

SEQ ID NO: 672066 - DNA, 138 bp, Homo sapiens
tctagaggatctcgccacggtaattgccacggagattaacttgtgcttcaaggcagctggagcagggcaattacacttactccaactgatttctgggtgtagaggatgcagaggctacaagatggagagcaggagggg

SEQ ID NO: 672067 - DNA, 546 bp, Homo sapiens
gtgaggtgcataaggctatgtatagatgaggtagtctggctttaatatcgggtgtggaggccacccggcaaagtgtttggtaacaagattaggtatatccaaagcagagtaaattggacagtgtaatcggacaggcaaagaagtctctggaattcagctttagtgggtgtctctcagttggtatgtaatgtggactctcagagccagcagacaggccagggggccactagtgaggtcagggggggggagggcccatcacaacacaaaggggggagggacggctcatccggggcgggagggaggacagggcacagtctcattcatttacagccagtgagagctggagtatagcaatggcccaaagaggaagatgggccaaggctcctagagagttttatctggagcccgcagacctgagtggtggatccagaacggacgatttaacaggacgcagcatcagctggcagacagcagcccagagaccagtatagtgtggcaacctacttctgaaaactagcttgaggccagagagtccttatgtgccag

SEQ ID NO: 672068 - DNA, 1163 bp, Homo sapiens
  misc_feature (29)..(29): n is a, c, g, or t
  misc_feature (147)..(147): n is a, c, g, or t
  misc_feature (157)..(158): n is a, c, g, or t
  misc_feature (228)..(228): n is a, c, g, or t
  misc_feature (241)..(241): n is a, c, g, or t
  misc_feature (251)..(251): n is a, c, g, or t
  misc_feature (287)..(287): n is a, c, g, or t
  misc_feature (313)..(313): n is a, c, g, or t
  misc_feature (315)..(315): n is a, c, g, or t
  misc_feature (320)..(320): n is a, c, g, or t
  misc_feature (410)..(411): n is a, c, g, or t
  misc_feature (784)..(784): n is a, c, g, or t
  misc_feature (795)..(795): n is a, c, g, or t
  misc_feature (804)..(804): n is a, c, g, or t
  misc_feature (823)..(823): n is a, c, g, or t
  misc_feature (872)..(872): n is a, c, g, or t
ctgctgatttgctgctgtgagtgaccccnctgctgtgtggtgctgtgctgtgctgtgcctgtgatgcccctgagtgatgtgccctgatgctgtcccctgtgcctgctgctgtgcatgctggcccccggcccgatggagaccccgccngtgggacccnngcccgcaatgactcgctgccgcccacgctgaccccggccgtgcccccctacgtgaagcttggcctcaccngtcgtctacaccngtgttctacngcgctgctcttcgtgtcatctacgtgcagctctggnttggtgctgcgttaccgccacaagcngntcagntaccagagcgtcttcctctttctctgcctcttctgggcctccctgcggaccgtcctcttctccttctacttcaaagacttcgtggcggcnnattcgctcagccccttcgtcttctggctgctctactgcttccctgtgtgcctgcagtttttcaccctcacgctgatgaacttgtacttcacgcagaactctctgaagaaagtaccggtattgtccccattttccagaggaggaaactgaggctgagaggtcgtagatgacttgctcaaggtcacactgtcagtgcatggtggagctggcgattcaacacacatctgtgctgtctgagtgtgattttcaaagccaagtcaaaatattctccagaattactcaaataccggttgcccctctacctggcctccctcttcatcagccttgtttccttgttggtgaatttaaacctgttgcttgtgctggtaaagacnggaaatggganaggaaggtnatcgtctctgtgcgagtgnccattaatgacacgctcttcgtgctgtgtgccgtcctctctctccatcntgtctctaaaatctctaaggatgtcctttagccaacagtttactttggagtccaaggggctcctccgtgtgtcaaggtgacttgcatcgggtgttcaccgtgattcttgtttacacccttctggcgcctgtacaacgctgttaatcctgtcatttcttccagaaacaggaagcgtccattcctgtgaattatgactgctcccatgtttcagcccggcaaattttgacaactcacgtggaaatgcggaaaacgattatgggagggcgcacatgaagggaaccttacacaact

SEQ ID NO: 672069 - DNA, 409 bp, Homo sapiens
gtgtgccaccacacccagctattttttattttttatttttagtggagatggggtttcgccatgttggccggagtggtttggagctcctggcgtcaagtggtcctcccacgttggcctctcagggtggtgggattgcaggcgtgagccaccacgtttagctgagtataattttaaatagccctatgtgtccagtggcccctttattgggcagtgtagatctaagattaattcctcccctgtttcgcattcatcaaagacatacctatgagttggcaacccgcagggtggataacgggccagtggtgataaaatcaaagaataggtaatgtgactctcatccagttaacaatcagcaaggttcttcagagcctaattaatgtttaattctaaataaattgcaacaattaag

SEQ ID NO: 672070 - DNA, 990 bp, Homo sapiens
  misc_feature (117)..(117): n is a, c, g, or t
  misc_feature (127)..(128): n is a, c, g, or t
  misc_feature (198)..(198): n is a, c, g, or t
  misc_feature (211)..(211): n is a, c, g, or t
  misc_feature (221)..(221): n is a, c, g, or t
  misc_feature (257)..(257): n is a, c, g, or t
  misc_feature (283)..(283): n is a, c, g, or t
  misc_feature (285)..(285): n is a, c, g, or t
  misc_feature (290)..(290): n is a, c, g, or t
  misc_feature (380)..(381): n is a, c, g, or t
  misc_feature (611)..(611): n is a, c, g, or t
  misc_feature (622)..(622): n is a, c, g, or t
  misc_feature (631)..(631): n is a, c, g, or t
  misc_feature (650)..(650): n is a, c, g, or t
  misc_feature (699)..(699): n is a, c, g, or t
ggctgagcgcgatgcgcggagacccccgcgggtgcggcggcgtgccgtgagccccgatgaggcccgagtcgtcccggcctgcgctggagcgcccccggcccgatggagaccccgccngtgggacccnngcccgcaatgactcgctgccgcccacgctgaccccggccgtgcccccctacgtgaagcttggcctcaccngtcgtctacaccngtgttctacngcgctgctcttcgtgtcatctacgtgcagctctggnttggtgctgcgttaccgccacaagcngntcagntaccagagcgtcttcctctttctctgcctcttctgggcctccctgcggaccgtcctcttctccttctacttcaaagacttcgtggcggcnnattcgctcagccccttcgtcttctggctgctctactgcttccctgtgtgcctgcagtttttcaccctcacgctgatgaacttgtacttcacgcaggtgattttcaaagccaagtcaaaatattctccagaattactcaaataccggttgcccctctacctggcctccctcttcatcagccttgtttccttgttggtgaatttaaacctgttgcttgtgctggtaaagacnggaaatggganaggaaggtnatcgtctctgtgcgagtgnccattaatgacacgctcttcgtgctgtgtgccgtcctctctctccatcntgtctctaaaatctctaaggatgtcctttagccaacagtttactttggagtccaaggggctcctccgtgtgtcaaggtgacttgcatcgggtgttcaccgtgattcttgtttacacccttctggcgcctgtacaacgctgttaatcctgtcatttcttccagaaacaggaagcgtccattcctgtgaattatgactgctcccatgtttcagcccggcaaattttgacaactcacgtggaaatgcggaaaacgattatgggagggcgcacatgaagggaaccttacacaact

SEQ ID NO: 672071 - DNA, 224 bp, Homo sapiens
tgtgatgcatccacaatagtggacctaagggattgctgacatgctattgtgaggctttaaagacagcagcatttatatataacgtgactgctgtgaggttcattctcaccgttttgcttgcatctttttgtattctagttgtgtccccaaggaaggatgagactagctctgaagtaagttgaaattcctgctcaaaggttaaagcatggatgtcccatgatacg

SEQ ID NO: 672072 - DNA, 106 bp, Homo sapiens
ggataaagaagctttcagaagtttctaacttacaacctagcttcagattttttgattccccagccaccaagtttaaattcattttgggagccttaccttttccatg

SEQ ID NO: 672073 - DNA, 329 bp, Homo sapiens
gaataggatgtgtctttatatagtagctgcagagtctgaggacggtgggagagcacatggtcagactgagattgaatgactaaacagtaggaaattaactttggtggggcatcatttatctattcaagtggacactggagaccatcatttggttggagtgagttttttgtttttttgcattgtgtgggaggtagtgagaagtgaagccagctggacttctgggtcgggtggggacgtggagaacttgtctgtctcacaaaaggattgtaccaggcgcgaatcagcactcggtaactaggatggtaaaatgcaccaatcagtggtctgtc

SEQ ID NO: 672074 - DNA, 182 bp, Homo sapiens
aggttagctgatccgcttaagcagcaggatccgtatagcacaggagtttgaggttatagtgagctaactgcaccactgcacttcagcctgggcaacagagcaagaccctgtctcaaaaacaaacaaacaaaacaaaagtaaacaaagtatgaaaattctcttagtttttatcttgtatttga

SEQ ID NO: 672075 - DNA, 828 bp, Homo sapiens
  misc_feature (151)..(151): n is a, c, g, or t
  misc_feature (295)..(295): n is a, c, g, or t
  misc_feature (312)..(312): n is a, c, g, or t
  misc_feature (360)..(360): n is a, c, g, or t
acccccagcatgcctgtttccgcacaatgttcagcatgatccgtgcccctccaggccccacacctgtttcttggcatgtcttttgtatgcagcccacaagtttcctggctttcatgatattcatgtgctgggtgggtgactttttccctgnctggccgcggctagaaccaaagcagtatccttacaataatctgtacctggaacgaggcggtgatccctccaaagaaccagagcgggtggttcactatgagacctgaggaggcttcaagggttgcgtggttctcaaactaggacnccctcactcctacaaancgagggcgcgccccccccataataaaactcattgcttgtaaattactnaaaatccccggccgcctttggcctcacgtgggggagctctactgcccgctccccttcagcgaccgcttaacccatgcaccctgcgctactggcttcgctgctcttcagtctactggcctaccgcgcgcggtcccggcatcactccaaggaagttaacactgtgcatcaccccactcaatggagttagccggcgagctcccccctcatgattcccggcaattcccgagtcagccccaccttagccatgccgccatgccgcgtatacactcccgaaccagttatcgaacctagcccgagagaagaaaggcccacattccggatctgacgcacccagtcacataacctattcagtgggaacacctccccacccgccccgggacgtacccatcataaccacagatggaccaccacgctctctctttcgccacacgagacgatatctgtacccacccctgtatatgtgctagg

SEQ ID NO: 672076 - DNA, 167 bp, Homo sapiens
tatttgtgtaaacaacctagcgcagttgtgggaacccggaacaaaagttggggggggggcaaaggggagggaaaaggacaaaaaacccactaaatacgtccttccgacctttgctaatgcagatgggcaaatagggaaaatcctggttcttttatttagcgccggaa

SEQ ID NO: 672077 - DNA, 1057 bp, Homo sapiens
agaaactgggctcagctcagtacttcgactactgtgattatctatattggtatgactcagtctattaaaactccattagggtagattctgtttataccacttgaatgtctccagtactcgtgccggtacctgggacatttaatccgcgtgtgcagttgcacccctgggagtatctgtagacagacctcactatagcccaaattgttccatatccatctatccttattctcgacttatctcgaagaactgaggaactaataccagaaatgtacgtttaattcgggataacatgatttgcaatacgtgtcgtgagatccaactctcactggcaatggctaatgtcatacaaacaaataggggggacatcggggatcaccttagaagacaacacacgaaactcggtgttgaactcctctatacgagactaaccgcttgccccttgcagacaatgccactaacccgccaattggcttatagcttgctctgcgtcgactatccgcgctcacgttatagttcacttccttttgaaaacttttagcaccgaattaaaccctctttgggacacactcggtaccaagctagcaactatacttgggcttggctctgggggggtattcacagggcagattttactagcgtttgctaagtccgaccgaaaagtctcgtgtaaattgtggttaaagagaaagcggggcatacactgaagagtaatatgcccttgtaatttggggacatgtgtgggtaagaggccttggaagtacgtacctctggagcttggtctttcagaggttaacttaacttcaagggggtggtgacaaaaataggtcgtgacgtttatatgagacccgaatagtttctccacgttccaggaccaatgtggtgccatagggcggtaattcccccgtttatcggcctgataacccaggatttgtcctgttataagcgtttctgctatacccctgtacagttgaacacctccatggttatagcatggggtacacactgcggatgttagaacccaatcgtttacgctggcaattaccatgcttcgcggggg

SEQ ID NO: 672078 - DNA, 250 bp, Homo sapiens
gttgttgactctagtaggatcccctattattgtatgatgttatgtttggggtaatttatgttacacagtaaaataactaaccaataaaaatagctgagaatattctgagaagtacaatcaagaggcacttgccatacactgctaaaatatgtggctagaattaccctcacagaaaaaaataagatctttattatacaccatacacaaaaataaaatttagacagacaaagattacacacttaaaaaactg

SEQ ID NO: 672079 - DNA, 190 bp, Homo sapiens
ctctcctccatgtcagatcagctacacagcatctgtcgtggttggcagtctccgtgtactcgcctctcttacttcccctggtggagtcagtcaagaaaagcatgtggatggatcccttatgaagcagctataggcaaactggacccaaccgatggtttcttcttcacgaaccaacagaccggtcttaccg

SEQ ID NO: 672080 - DNA, 193 bp, Homo sapiens
agaagcgacgggcaacaaagaacttccctgagacggggtaatttataaagcaaagaggtttgaattggactcagagttccacatggctggggaggcctcaggaaactgacagtgagtggcgtgaagggtaagggagggatgtcttacatgagcagcaggcaagacgagagcatgtgaaaaaggaactgatcga

SEQ ID NO: 672081 - DNA, 190 bp, Homo sapiens
tctagaggatctccagttccttctctaaatttccagtaaggtaatgcttattttaacaacttatttaaaactcgaattcgcttttttttttttgggaactttggtggcccgggttagattacgggggggcattttgggttcatggaaccttccccttcccgggtccaggtgttggtctggtttcggcttc

SEQ ID NO: 672082 - DNA, 1962 bp, Homo sapiens
  misc_feature (14)..(14): n is a, c, g, or t
  misc_feature (553)..(553): n is a, c, g, or t
  misc_feature (765)..(765): n is a, c, g, or t
acggtcccatcacnaataaggtgatgtattggtttgtacttacatcgtcggtagatgtgtcgtgctcgttgcttcatcactgtcgtgtgggttcacccactcactattgttgctggatccgaggtggtttgtcgtcatatgcgtcgcctcttgctgctcccttcctcgtgggagatgaatatgcttggtgatcatcgatttggttgtgttatcacgacgggccttcgctttgtagtatgttttctgcgtctcactcattgtgtgtggttggtgacccaccaccaccccccactcctgcggtggggtgtgtgtttttacccccacccttgtggtgctggcgcaccacatccacgtgatgtgggggggtgtctaccaaaccaaactgtcgtcgtcctcagtgttctctcgctgggtggacgccaatgtacagtaaaatgatggttcgttctgtctgcgcagccagttgtgggttgcgaccacgtagcagaatagaggggtggtcccaccctgcttttcaccgacgactgtgtgttccacacactatgttgtgtgngtgtattatacagcccgccggcggatggttgttgtgccactccccatgttgctttactacagacccgccccctctggtggggggtatgtctcccctccctccccgcgagttgttttggatgaggggctggtcgtctcgtcaacaacagcggctgctccgtcctggggagtgattgttcttccttcaccccacaccacaacaaggggtggttntgtgtctgttgatgaggttcgcccactacataggaagacacatagattagtgttggggtctgtgctccctcctcgttggggaaagacctccccccctcgactccactccctcgcgccccgaagttatttagcacctctccaccacacgcgctggggggtggactagctggtttgtgcttttatccacaccggcggtggtggtcgcggtagaggggtggctccacccccactactaagagcgagaagagtaggtttctctgctgcagtggagaggcaccccacaagagtgtgggttcgtgtgtattatcatccgcgtgtccgagctatgatcaccacatcggagtaccacaggacgcgcgcagtatactcttttttgtgtgatgagaaagtggaggagtgttctcctccccccaccacactactgctgttcttctatcagcagagctacacacgcgcgctcttgtgtggtgagaggacaacacttccaccccccctgcttcggcggtgtggtcactcaccacagcagcagtgtgtcgacacgctcgtctcccctgctctctgctctggcgcccacacaagtcccacaccccctcttcccacagcgagagtctctctctctagcgggccactctctctcgcgagagacacactgctttctctctctgcacacacacattttgctccccgcgccgagagagacactctcttctctctcccactcggtgagacacacacacgcgcgcgcgagggcactctctggaccagagagagtgagagagtgtgtctcctccgcgcgcgctctgagagagagaccacacactctgggcgcagacctctctcttctctctctagagttatctaccccgcgctctccccgcagagagcccccccaccacaaagagagagagggagagaggtgttttcgcgctggagagggaggctccgcaagagaggggcctctaagagccagaacaccccctcatcccaccccgcaggtgttttccgcagttcaccctctaacactgcttttatactccccagccccctcttccctctctccccccgcggaaattgtgggtttctcgccctctctatattttttttttgttttttttttgcgggggggtgtttaaacaaacagccccgcaacaatatagagcccccccaaaaaaaaatttttttttgaaaaaaaaaaaa

SEQ ID NO: 672083 - DNA, 730 bp, Homo sapiens
  misc_feature (538)..(538): n is a, c, g, or t
taaaaaaaaaaaaagtgtttattataggcaacacccccaatggaaacgggtatttgtctacaccaagggagtcgcaattttccatctcccaattgggcgggcctcaaccttgaggcagaatccacttgggcagaaaagatgcctttctagagaaggcaagagctcccctgacggggcataaagataggtctcagattggatcttagtgtcaagtggtaaagaccatatgtagtccatagaaggctctagtggcttttcaggcgcgtggagctcgcccaacaagcaagaatgtggacaacggattaagacggtgggaggagcctccacaaaaatctccccgacaagaaccatctacagcgcaggctggacagaaaccagaccccccgtgcgcgacatataacacgcgtttgatatctccagcgtgcgaacacccaactcaagccagcaaaaacagcactgtgcacaaaacgaccccgtgagaacccatttccgagtggctcaccacaacaagaatctcgcatatttccctcagagaganacacacatattttctcgttggggggtctcccccccgagtgtgtctttcattctggcagacagaggagctttccttgtcacgccccctctttgacaccaggaacttgagaggattggatccatactttactaaacaaacggggtcgacatagaataaatctcccgagggtgctttttcaatcatctcgcttcg

SEQ ID NO: 672084 - DNA, 550 bp, Homo sapiens
tcaattctgcaccacagccaacatcatagtgaataggcaacagctggaaacattcctcttgagaactggaacaaggcaaggatgccctcttttaccactcctattaacatactactgagataaaatgcatccaaataggaagacaggaaatcaaacttctctgtttgcaaatgatatgatcctataccccccaaaaacccacagtctctgttgaaaagctcctgataaacaactttagcacagtttcaggacagaaaataaatgtacaaaaattaggagcatttctatacacgaataatatccatgcagagagccaaatcaggaaggcaatcccattcacaatagccacaaaaagaataaaatatctaggaatatagctaaccaggagatgaaagatctctacaatgagttacaagatgctgctgggaaaaaaaaaaccaaaacaacaaaaacagagatgatacaaatgaagggacaacatttccatactaatggataggaagaatcaatatccttaaaaggggcctactggccaaatcaatttacagat

SEQ ID NO: 672085 - DNA, 553 bp, Homo sapiens
  misc_feature (553)..(553): n is a, c, g, or t
cgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacggagcgagactccatctcaaaaaaaaaaaaggtaagaaagaaaaggactcccttaaaatgggaaagaaaaatcataaaatattggagctgatgcctgtatatagaatattaagcgtttctcgaaaagctgttctatgtttggctggtaatttaagtcttatatctcttccttaaggtggagaaacaaagtaccaatttggaagggatttttttaatttggtctttagggttcctggtcagtagaaaataaccattatgtgctaaccaaatttctggtgaacaaatggtttccatgggtaatcattaatatctaactataacctcccccaatagtttatgaacgagtacacctgaaatgccactatggtggaaatcggatactcggtactcggtgcaaaan

SEQ ID NO: 672086 - DNA, 1220 bp, Homo sapiens
  misc_feature (1220)..(1220): n is a, c, g, or t
ggcaagaatgtggacgagtggaaaatcagtgaaaatgtttccaacctggtgattgaggacacagagctgaaagcaggtggcttacatatacaagtgtgtcaacacgacattgcaatatcaagggcaaaagttaactccattacatgtagataatctgtgtaagcaaagcttgagcctggatattcgcatgacgtggtggagcattgtggagataatcaacaggtaaggatgtcaaactttcaggtaatgggtaaagtgccaaccaatatccatcaactaaaacagatggcgtgccatgcgtatacctgagcaatgaattccctggcattgtgaagatatgtcagtgccaacatcgttccgaggatgacatgtcctcagttcctacagaaggcggatgactttacatgaagttcccagttcctgagcagttcaatgaccctatggaacgggcagaagttggtctaccacagtgacagaagattgctggatgagcgaagtgccactgggttctttgccctccgcttcacaccatgggataaatctgtatcaagacggttcttttctagatttcctctacttttggctcttaaaactgcttctctgctctgagaagcacaggtaccttgacttcactgaaatatacctcaggctgaacatttgggtgggatagcacgtcagttgatcttctggaggaaggtgccagttatccatatcaggtcaaacaagccgcaggtccattccttaagaaatgccgaactaagactgatgatgccttttaagctctgagccttggggggggttattgtacccaccaaaagtccctggtgacgaaacaaggccctgggaataaaagattcgcacgtttgtccgccggggtatcctctgttcgtgccacagagcggtaaggtgaggcacactcgtggttgttccccaggtctttctatccagcccaattataatcggcgtgagaaaaacgggcacaaggggtggttgtccaaccaagagaagggggcctttaaaacaaccacgggggtctgtagcaaccaatataatataatagagtggggtcgggaagaagaaaagacgaatccatgatgagctcccaaccaagaggagcagccttgctccctaggcgtacaacagcaaacaagagatgacgagtgctaagctcaagcgatctgcaaaaatcttgtatcttcctattactatcatcattgcgn

SEQ ID NO: 672087 - DNA, 557 bp, Homo sapiens
catatcttagacagatagagaacatatgtatactaaaaccaaagtagcctaatgaatctgatcacttaaaaggcaaataccagcaacataaatttcattgatagtatacacatatagcatctgtgtatgcatattacatatatatatacacacacacacaaatatgtagacataaatcccgttgaaatgtaggcaggaaatccttccgtgaattataaatgaacaacttcacattaagaattacatataaagcttatagtaccaggacatatgcaactgtcaaaattaaactagcacatatgatgtcaaaacagacatatcaaaagcacaaaccggcaagaattacatcaccacaagtttgaaaatattaggaatggcttaccttctaatattcagaataatgtgtacaaaactgagtgtattagcgactaagtgtagcgacaattgaatgaatatacgcctacaaacattgatctaagatatcagtggtccactataaccatctgactgaacattatttaaatgactttataaaggatagtactgtatactgaact

SEQ ID NO: 672088 - DNA, 239 bp, Homo sapiens
acgtggagtggtgctcatagaacttgtactcggctcctggaagcgcagcattcccgtcggcttgagggctgtcgtcgggctcgcgcacgatcgtacctctggggatcttgcagatccagtccagctgtgtgtcgcactgcatgggcacccactgcagggaggccaggtccagcaccgcacagcctcggatgtcgtcgtcgtcgtgccggctccggtcgaaattgtggtattgtgtttgc

SEQ ID NO: 672089 - DNA, 207 bp, Homo sapiens
gactcacaggatcccgtgacgcggtttgtgtatcgagggagagtgacggatatcggagtctggggcacgggtggagatggggagtgctagatgtgcggtggtggccttaggagttcatgggaggggtcgattggccggggcgcgagagcgtgatcgcaggcaaaggaaccgatgtgtccggggctgacggatacacaagccgcttca

SEQ ID NO: 672090 - DNA, 184 bp, Homo sapiens
tgaggggactgtccgtaagctacaggacagcgagatggtcctatctgccacttattacccactcacatgcacaggaagacctggttactgatgatacataataaatgaattgctaacatattaaacagagaatgaagaaaaaagaaacatggcaccagaaaaatataacatgatgattgggaaa

SEQ ID NO: 672091 - DNA, 119 bp, Homo sapiens
cgcacgtcaccgacatgggtgctgcctgtgccccgtactcccaattcattccctagcctgcaaacctttccaagttctcacgtcaggcctttgagaattctttccccccctcgcgccat

SEQ ID NO: 672092 - DNA, 225 bp, Homo sapiens
taatcgagctcggcccactttgactgggcattagagctggggtgatagggtgcctgactgctgtgtgagaccctgctggaagccgtggctgccagcgtggagtctgctgtgggttaagtccggcagtttcacagcctgcctgctgctcccgacttcagctcagtgctggcccagaacaggtttctcctggagctacagatgagctcttattgcccaggctggagt

SEQ ID NO: 672093 - DNA, 640 bp, Homo sapiens
  misc_feature (119)..(119): n is a, c, g, or t
  misc_feature (185)..(185): n is a, c, g, or t
  misc_feature (221)..(221): n is a, c, g, or t
  misc_feature (255)..(255): n is a, c, g, or t
  misc_feature (282)..(282): n is a, c, g, or t
  misc_feature (284)..(284): n is a, c, g, or t
  misc_feature (293)..(293): n is a, c, g, or t
  misc_feature (295)..(295): n is a, c, g, or t
  misc_feature (300)..(300): n is a, c, g, or t
  misc_feature (302)..(302): n is a, c, g, or t
  misc_feature (305)..(307): n is a, c, g, or t
  misc_feature (310)..(310): n is a, c, g, or t
  misc_feature (313)..(313): n is a, c, g, or t
  misc_feature (353)..(353): n is a, c, g, or t
  misc_feature (358)..(358): n is a, c, g, or t
  misc_feature (366)..(366): n is a, c, g, or t
tggaaatggagtctcgctctgtcgcccggctggagtgcagggtgtgatctcggtcgctctaacctctgcctccagggttcaagcgattcttctgctgcagcctcccgagtagctgggantccaggtgtgcgctaccacgcccggctgattttcgtatttttagtagagacggggtttcaccatgntggccatgatggtctcaatctcttgacctcatgatncgcctgccccggcctctcaaagtgctgggtttgnaggcatgagccactgaacccggccttnantaggttagntntggtntngtnnngtnttntggcactccagcctgggtgacagagcgagactgcctcaancaaancaaacaanaagagacagcctgtgtattagtaagattacttacagtcccaaggggcaaaacccagttcatactactttaagcaaacagtaagaacttactggccaggtgtctggagaggccaggttagtgcaggcatggctggatgcaggcctcaagggtgctgtaagaatcagctctccagatcatcagtctggtgacttgagtggtcatctggggtgctttatatatgccaacggttggtcccctcccttggacttgggtggttctgcgattacaaccgtg

SEQ ID NO: 672094 - DNA, 252 bp, Homo sapiens
aatgactggtgcatagatatagctacgcaagggaaagatgaaaaattataaccaagcataatatagcatggactatcccctataccttctgcatgatgaattaatctagaaataactttgcatggagagccaatagctaagacctcccgaaaccagagcgagctatctaagaagagctaagagagcacacccgatctgatgtatgcaaatagtgagaagattgctaggtagaggcgacgaacctaccgagcc

SEQ ID NO: 672095 - DNA, 159 bp, Homo sapiens
gtcccggagagctgagcagtcaaggatgtgtgacttcaaccgaggacaagaccgagagttcaaggaggccttccaagctgtttgaccgaacaagtaatggccaaggatccctgttcaaggccagtttgggattggtatagggccctggcaagaacccta

SEQ ID NO: 672096 - DNA, 162 bp, Homo sapiens
cccacaggcagtagcacagcagcaggcagtcagtcttggcagaggacgggcataaaagacaccgaatggtcagattccaggaagacccgcaggcagcagcagcagccaggatggaacgatggtcagactcacggcaggacgtggccatggtacgttaacagg

SEQ ID NO: 672097 - DNA, 1056 bp, Homo sapiens
ggacgcgtgggtccccactccaccttactaccagacaaccttagccaaaccatttgaccacaatataaatgtataggcgatcgaaattgaaagcctggcgcaatagatatagtaccgcaagggaagagatgaaagaatctataaccaagcataatatagcaaggactaacccctataccttctgcataatggaattaagctagaaataactattagcaaggagagccaaagctagggacccccgtaaaccagacgagctacctaatgaacagactaaagagagaccacatcccggtactatgtagcaaaatagtgggaagatttatacgtagaggcgacaaacctaccgagcctggtgataggctggttgtccaagatagaatcttagttcaactgtaacatttggctccacaagaagacctctaaaaatccccttgtaagattgtaactgttcagtccacagaggaacagctcttgtggacactaggaaaaaacctggtagagagagtaaaaataatgacatggacccatagttaggtcctaaaacacgtcgaggcaccaattatgaatgccgtgcaagctcaacacccactacctataaaaatcccacaaatataactggaactcctgcacacaccaatttggatgcaatctatcgacctatggaaagagctatatgtgagtataaggtaccgtgaacacttctcctccgaataaagccgggtcggataagacacccggacgggacaatgaccagcgcaagatctacaatcagcccaaccaaggtatataccctcactggcgaccaacacaagacatccccatacggaaggttaaaaacacgaaaagggaccggcaaaacttccggcgtacaagacaaccccacagccccgataagccgcgggccgaccagctacccgcgcggggcccaccgcaggggaacaacgatctcaaagacagaaagcacagagcaacacaaacaaccccgcaagcgacacaagaaagaggataggacacagcaacgaaggaggaccccaaaaccaagaacgccagacg

SEQ ID NO: 672098 - DNA, 620 bp, Homo sapiens
gaggccgccgctttggagaagttcagcgggtcgatggtcacgtcctggtaaatcgaggagacgagcacctcgtagccgatcgcgttgccgagggtgaccggggtgccgaactcgccggcagccttgatgaagacgatcagcgcgccgagtgaatagggcccgaccaccgcggggacgaccacgcggctgaactgctgccaccggctggcgcccgccacctgcgccatctccagctgcgaggcggggatcgacgcgaacgcgttgcgcaggatcaggtagagaaacggaaacagctcggcggccatgatgaaacccataccccacactgagttgatggcggaccggacggcgtcgccaagcatggggcccaaaagcatgtccgccacgccgcgcaggcgggtgaagtccatccacgccatcgccgcggcaaacggcggggtcataaacggcaccatgaccagcacttccacccatccggcgcgacgcatgggcgtccaggagcggaagaatgccagcggtgccgcgaacagggtggcgaaaaagacgacgaggacggaaagccagaccgtgttgcggatgacccgcagcatctccggacgcacaaggctatccagggcgga

SEQ ID NO: 672099 - DNA, 112 bp, Homo sapiens
  misc_feature (49)..(49): n is a, c, g, or t
ggcaccaggcccggaatcggctgagtcaagcgtctcgtggaggtctcancacagcttgggttgttgggtcatcatccaccacgggctgctgtaggggctggtcatagaactg

SEQ ID NO: 672100 - DNA, 187 bp, Homo sapiens
ggaggatgtcatctctacaaaaagcaaaaacaaaagtagctgggcatggtggcacacatctgtggtctcagctactcaggaggctgaggtggaaggattacttagaacctgggaaattgaggctgcagtgaccccatgatggtgccactgtattccagcctggggtacagaacaactactttgtctc

SEQ ID NO: 672101 - DNA, 1522 bp, Homo sapiens
ggggggaatctatggctgtgtgagggggctctgctgtggcgtgggacattcacatcatttcactctggtctgagtggtgggctgataaccatggtgggatggagcaccgctcatctatgctgatctccaggccccatgtggaacggatgtggagaggagagaagctgttcaagaccatcgttaagtgagcacaggggtcaggtagacgccatgggtgctcgtcaccttactcttgtcgcttgcagatgtggacgtgaggtggtcgtggctgttccagcaccctatttttgtttgcacgttcctgctgaagacagggatgatggctgaggccaacggtgcaactgtgcaacgtggcgatgggcatggagggcttgtagcacgggattgaatgtgaaggcacgaggatcatcaagtttgcaggttaaacaaaatgaaagacacattaaacagaaagaacaagacaaaaaaaaaggtgagaggagcgagcgcgagcaataaaaagaattatccctctccgagcggggccgcaaaaggcgaatcgaatgcgaggatgcccacaggagaatacacgaatggggaatgaaaatgaagggaagggcgccatgaaatgacaagtgaggaagacagaacaatgaaaaaacagtacgagaggacaaagggggaacaaggaccatgtgagagacaaacaggaattggaacaacgtggggcgacacaatgaagagagaaggaagcggggggacaccctttaggcatgaaacggcgggaccagcctgaacaccatccccacgtgggcgcggggtgtcaccccacaaacgatggggacaccagaaaacaatcacaacgaacacagggccggaaattcagagagagcgaaccagtcgacgcagcaaaaaaacacgtaacacaaagaaacgacacaggcgtgaccaagaaggggggctggaacgaccaaagcacggaaacatatggagcaagccgagagcaggggacacagattcagaggacccccagcgagtggatcacaaacaagaacgatcaacaacgaactcattgaccggacgggcaacaaaggagcgacaaaacgggcacgcgagatcgaagacacgcagagacagagagcgccacccacacaccacgcggacagagccctggacaggaagcagcacaaggcaccaaaaacacgagatgaccacacaccaccagcaaataacactagacaggaagacacacaaggaagccacacggcaagaaggaggagacggagcacacccagagacaagtaggaccaacgaccccgatagcggacacaacaaagagccgagcactacccaacacgcgccaacacccagaaaaacacaacgaacacacgacaggcaaggccacacagagccaaaaccacacgacgcggacggagagaggaaacgacgaggaggtacaaactcgcagtagacagaaacagaacgacaacgacagcagacgaagagcgacagaagaacacaaagcacaaacagcaaggaagag

SEQ ID NO: 672102 - DNA, 556 bp, Homo sapiens
caagtgaggtgatctcgaagccagcgtgttcacattcccacagatgcaccactccctacagcttcaggctgaagaatataccgcggatcagaggggcattgacaaacctggcttctgagtcaactcctgccttgaatcttgccatcaaggaacttccttcccggtggctccttgatcaagctagagactggtggaaccccaggaattttccttcccattctggcgtggctctttacactcttggattttactttattacttttactgcttctgtttcaccccagctgcctctcttgtcctgagggtaaggctggagtgacagtttccggccaacccccagcccaagaaagaggctgccggaaagaaaatgctgaccattggaggtgcccaacagtagaatgggctactgtgaggggtagtaagagccccatttctggaggtatgcaaatcttgactggacagccagctctgagattttatcagggcacttctatacctctgggacattggactggatcagccctgagccagattccactcctagcttaaatgagaa

SEQ ID NO: 672103 - DNA, 128 bp, Homo sapiens
tgagtgaagcgacattgacatgtctgaacagtgaaaacgcgtaaggcgccgctgcgggcgcgaaaccgggcgttgccgcgcgggcgggaaaacagtgctatgcccgtcgggcattaaaacaaatgggg

SEQ ID NO: 672104 - DNA, 330 bp, Homo sapiens
gtgagctgcaaagacgaacacccacacctcagctctatagtaacctaattctaattacctaataattctacttaatacagattatcgacaggacttacaccagttaataaaaatgatgaggctgggcatggtggctcacacctgtaatcccagcactttgggaggccaaggtgggcagatcacaaggtcaggagatcgagaccatcctggctaacacggtgaaacctcatctctaccaaaaatacaaaaggttagccgggcgtggtggcgggcgcctgtggtcccagctgctcaggaggctgaggcaggaaaatggtgtgaacccgggag

SEQ ID NO: 672105 - DNA, 307 bp, Homo sapiens
  misc_feature (245)..(245): n is a, c, g, or t
ggcctcgatttcagatccgggggctgagcttcggataggggggtgggaggcacaggaagcgccaggtcttgtttggttgaactgtgattccggggaaatagggcgtggggggcaattcccagaggtgaggcttgagggggggctttgccttcgggggggcccgggcctggaggtgtggggccctttattccaggtcccgggcggggtgaggccccacggggccgcgggggtccgctccccagatnacaacctccccacccccacggctccctcattacaggggcctcccccatggaaaaaaaaaaaa

SEQ ID NO: 672106 - DNA, 1340 bp, Homo sapiens
  misc_feature (214)..(214): n is a, c, g, or t
  misc_feature (1340)..(1340): n is a, c, g, or t
taaaaatttttaatctttatatttttacaacacgttgttacataataaaaaaccataaaaaactcaaacaattttaaataccccaataaaacttgtttgaatctccatttgtgcaaattttaaattttgtgtaaaaaatagccgtgctcacgtgccctccattatatatctctaagggtgtgccaaatgtgtgtttatatatatctccctattnttgtgtggcctcaccagatatactctcctctcaagaaaaaaacgaagattctccggcggtgtgaggtctctatacgctctctcaggatatttatgtagagactctccccaatataaatgcgcgtttgagagagagagctctctcacagagagggagagaaaaaaaacacagaggatatctctactacactataggggggggtctctactacgctgtagagaaatatattttatctctacacctctcacacaaaatgtgttgagaggcggcatagagaggtttatattatctcacacctctcccacaaaatataaggtgtgctgctctcggagagagcacctctctcaaaaaacaaagaaaacaacaaaagaagaaagaaaaacacagaagaaacacaaacaacaaagacagaacaaaagaaagaaaacaaaagaaagacacagaaagacaaaacaacaaacaaaaagaagggaggggggggggcgccacaaagagagacatatcccctcgcgcgagggggggggccccacaaaaagtgagagacaacaacacccaccagagaatgtgttgtaaaaaaaaagggggcgcgccccacaaaaaagagaggggacctatatatagaaacaagaggcaagcaggagcggcgcgaggccaataacacacaacgcaggaggggggagcggggagacaacacagcggtgtgagagtaggagcagctaccataaggggagggagaaggcaccccacaccacacggggggggggagcgggagagcacaaaaagaggggggagaaacacaccaccaccaccgaagagaagaaaaaaacaacgccgccgcggaggaggagatcaaataaacaaaacacagacgcgagcacagagagggctgagggaaaaacccacaacgagacgcagcaacagaaacgtcgcgcgagcgacgtagaagaaacagtggggcgcacaaggaggagaaaagacaggaacaacaaaccccggggcgggcaggcaagaccacgacaagcatcagcagagagaagcgcagagaaacaaaggacaaccagcgacgaacagcgagacgcgacgacgcgaacagaagaagcagaaacagcgcagccgagcgagcggn

SEQ ID NO: 672107 - DNA, 182 bp, Homo sapiens
gatcggtctgggcaggcctggaagaagtcattgcacatgagatgtgatgagtgccaggaaaacagcatactcctggaagtccaccgtgctggccactgttctcatccaggttgcccatcagcttcttcagcccctcctcatccactttctcccccacaaagctgggcagctccttggccgaa

SEQ ID NO: 672108 - DNA, 1144 bp, Homo sapiens
  misc_feature (382)..(382): n is a, c, g, or t
tctgtgaaggaacttgaagtgatgcatgtgtgaatttaaaataccgaagtcttaaagtgtggacctgggacgtgtagaaggagaaaaatgtaaagatgagaagaaataaaagaaacgcctttggtaagggtgggtttataaaacgccttatttcgcaaacctttataatctggtggttctctggcaatgtgccactcctttgttacgaggtgtttaagaagggttacacgagtgggtttacctttgtgccaccagcttctcgaggtgtttaagctctaacccgtgttctctttgtaaagccacccattgttcagatattataaaaagaattaggccagacagttctccttatagtttaaccattatttgtttgggtgacaantatatttttcccgtggtaccctttttgtgggtctccattataaattttgtgctcagttattttacaccaccaaagcgtgtgtttgtggcaaccaaaaaaaattttttttgtgggcattctcatttataattttaaagggctcacaaataaccattttttatttatagtggtggccctcattttatatatatttttccataattttaaacttatatgtctccaataacgtggatagtgtggtaccagcatattataataggtctctctcaagtatttattaggacttaatattttatacgttacacaaagaggggaacctgtgagcgttggcaactcatctgtgcggggcgccacacattctatagcgctataaagagacagaaaagagagccctctttctagtgggggtggtttctgcggggaccaccccttaacatcgtggggcaccacagcggcaattttttccacacaatcttccactaacatttcacaaatatgggggggttatctttcccccacatttatgggggggaaatcttcccaccatcgcgggggagaaccctttgggaataccggaactctgttgttggaaaacccggcgggattttttcgagagtggagaaaatccccaccattttctatcaaccgcggtgtgcctttaaggcgataaaaacgaggagggcgcgcgggtaaaaccaagcgggttgctgtgttacacccgtggaaaaaaaatctttctccgacaagggtctgtgttaaaaa

SEQ ID NO: 672109 - DNA, 103 bp, Homo sapiens
aagattgctacattagacggataactaccttgagagcaagctgaccttgggccagaggacgacataaaacacccagtgacactctagtggcccatagaattag

SEQ ID NO: 672110 - DNA, 403 bp, Homo sapiens
aaggtatgctctctcctcctgaacaggtgtgctcatcattgctgtgggcagaaagagccattctctcacctttcacccctagactctaccggcacagatgatagagatatggttagatagagacatggatagagcatgcacaggcaggacacagataggctctccaccacctgtgtccaaatatctcagatagtcatgtgtgttagcacgctctgaagttatgacacacgtgcagcctatagagcacttctggttcctctcgtgcatcttacatctaggacctggaagtctgcacaacccttgatatttattaacatttactgctcacctgttgtgtgggaagtcctatgacatgcatgtcgctcacattaacgtgcgcaactctcatatcaactctcgtgcc

SEQ ID NO: 672111 - DNA, 1201 bp, Homo sapiens
gatttctccacatggtcaggctggcctcgaactctcgacctcaggtgatccgcctgcctcggcctcccagggtgctgggattacaggtgtgagccactgcgccgcgacgatcccaatttgttaaaagtagttgatactagtgtcaacgattttcagaagcgatacgtggtagtagcagtacgtagtacgtgtgtcttccgtttgtatcgcgcgcgcgatttgattcgttaggattcgtgtcacacgtagtactacttttgaatcgacatgtggcccccccaggttattggatttatcgatactgtatgtactttggaccgggacgcgcaagtccgttgcatcctgatgtggcctcaagagacctggagcacgcatgcagagtgagatagtagacgtcatataggggcgatacaaggctggacaaaactacgtacagcgggacagctattcgacgcgcgagtaatttgccaacgagcgtgtaaaattgtacgatgtcgccggttgaggcacagtacaagggaccgccattaccatacccgaaaaggattaaggcaccatggcggagcaagttgtgacgcgagcacggggattggagggcaggaccaaaccgacactagaagcgaccgcacagctcgacaccgccgcccgagtatgggcccagctctaccaagacgatcgctggggactaccacgggcaataccacaattcagacgcgacgagagacacaccaggaggttagagctcgacaacacggagcacaccttacggatcgcgagcgcacatcacagacagataggagcaagcccagaggtatggaggtcagataggagcggaaccgaccccaacgaggggggacgaccgctctgggagcgatagacttgtatcatgatacaggagaaagcaaacgcgcgtttgaccacacgctgtcaaggcggaaacagcgaccacatacgaaccataacagcacgtggagctgataggggaaatttcggccgacgccgaagagcgcaccagttacgggggtgtctagggagtctactagatagggtgagggccaccccagtagcaccgaccgagttgcaaaaagaagacgagcgaggcgttgtaaacacgctttcatagggggaggcagcgcgaacaattgcgcacggtagaagccacgagacgagcgagcggtagaggcgagtaacggagctgagg

SEQ ID NO: 672112 - DNA, 144 bp, Homo sapiens
acgggatctacaactgcctggtggcttttcacaaaaagcagatgttcttcatgtactgtgatgtctgatgcaatgcatgctagaacacactggccattagctagtttactcgtaaagactaaacatagtcttggtgtgtgtggt

SEQ ID NO: 672113 - DNA, 935 bp, Homo sapiens
cccactaagtagatatgggtgaatcacgagtatgataataatcatataaagatttatgtgtggacgtggctcgtggcatagttctctgaaagttgcccagtttacgttgtggaccggtgtggctcagaataaatctgctggcacacactagaggtaatgtgatataaaatattggggtaagaattcggtgatcgtggagcacgtgagtacgatgaagtacgtgaaacaatagattaaagtcttagtgtacaagaaagaagacccaatggacgaggattttattacatgttagttcttggttcacatcaggataaagtataattaggcttacgtgatggggcatggggatgggatgttttttgctaacttttcttgcaacccctgtggttgggagtgttccggtctaacctgaaccatctggagaggacagtaagagggggtagtactcgaagataggtaactgtcaagcgctctggaggacctgtcgatcatactcggtgaaagtcctcatttgcgtcgagacgcacatagtgctagccttgaatacgcaagggtgtaccgaatgacaatgagacccttccagatgtcctctccatggttcagaactcgggaccgcattgttctggaaactgtacgccatcggccagagttccggccgtctgcttgtccgtggagccgttgatgcacggtgacagtcaggccttgttgcggcttgtcccggcaaacattggacgcactgagcatagccaatggaggtgttgcagaatagtcctgatcgacaaggaagctgtccttgcgacgggaaatcccgattgaggtctggacaccggcccgaaactcggtattccgcgcggagttgccactcacaagtggcagaactggatacaaacaacctgccctgcaacaaaaacagcgcatcgcgcacgaactagact

SEQ ID NO: 672114 - DNA, 431 bp, Homo sapiens
  misc_feature (3)..(3): n is a, c, g, or t
  misc_feature (31)..(31): n is a, c, g, or t
  misc_feature (122)..(122): n is a, c, g, or t
ccnatctagatgtgcccaactattctagganttgataaagggctaggagtaggaagttgggaagaaggggagggcgtagagctctagcatctaacaggccaattctttgctctgaaatgacnagccaaatgaataaaaacttgcttttacaatatttctgagctatcacttttttaagagaggattgggaggctaagagggcggatcacgaggtcggggttcgagaccagcctggccagcatggtgaaaccccgtctctactaaaaatataaaaattagccgggcgtggcggcgcgcgcctgtagtcccagctactcgggaggctgaggcaggagaatcgcttgaacccgggaggtggaggttgcagtgagccgagatcgcgccactgcactccaacctgggcgacagagcaagactccgtcctccgtctc

SEQ ID NO: 672115 - DNA, 155 bp, Homo sapiens
  misc_feature (9)..(9): n is a, c, g, or t
  misc_feature (128)..(128): n is a, c, g, or t
cgagtgtangggggtatcagcctctccacagctgacttatactggctttaagtgaccaggcagacgggacttccagaagtcatggccagtgctgacctctagctctcgccagtctctctgtgtcaccngcagactcacgggcacggggcctctca

SEQ ID NO: 672116 - DNA, 395 bp, Homo sapiens
  misc_feature (19)..(19): n is a, c, g, or t
  misc_feature (23)..(23): n is a, c, g, or t
  misc_feature (56)..(56): n is a, c, g, or t
  misc_feature (137)..(137): n is a, c, g, or t
  misc_feature (179)..(179): n is a, c, g, or t
  misc_feature (276)..(276): n is a, c, g, or t
  misc_feature (285)..(285): n is a, c, g, or t
  misc_feature (295)..(295): n is a, c, g, or t
  misc_feature (374)..(374): n is a, c, g, or t
cacagggcgtcccaaagtntttnttgaacaaaggcatgatcagtgttggtattgcnctgagactcatgccctcagccccgattcgggcacatggctcatgtcaaccactggaagtccctctggggcccacaaatgtntctagaccacaggaagagtcggcctggctccatgtgcctggngcctggggcagaaaggtggacggggcaatcagagtggtcaccatcggggagtacactttgcactccactcgagtctccagggatataagtcactggntcctaagtntcgctttctnagggccgttcttagagtctcctgtatgaaatcaggctacatccagagaaagttccagaaataagaaaagatgagatcgnctactgaccctcccatttttt

SEQ ID NO: 672117 - DNA, 220 bp, Homo sapiens
gccgctgctgctgcggtcgactctagacggactccccttatctgcctcgcctcccaaagtgctgggattacaggcatagccaccgtgtccggctgtatttcattttttattgctattacacatgcactatatgtatttctgtttctgattgtttagtgctgtatagaaatacaatttaattttgtgtatagatcttatatgctcttgtaaactcccatct

SEQ ID NO: 672118 - DNA, 345 bp, Homo sapiens
gtcccccgaatttaaaagtgtgatgtttgggttgaaatcgtgaaatccccacccgagaaattggggtgggttggggtttgggtaaaacatctttccccaaaaaagataaaccccaaatccctttccggggggtgggcccccattaaaaaaaaaagcccaaagttttcagggctttcgaggaaaggggttggccccgggcccccaagccctgtaaaaatcccccccctttttccctgggcccctcccccctccccccccctgattttttgggggggaatagggccagagggggttttttgggccccccctaggggctttcagggaataaaagctttttctccctta

SEQ ID NO: 672119 - DNA, 234 bp, Homo sapiens
cggacgcgtgggtcgacggacgcgtgggtcgacggacgcgtgggtcgacgaaatcgtgggaataccggagcgtcaccacgctggttttgacccaacccgtccgaattaaaggacacatatgacacctaagttcataatattaaaaaaaaacgagcggggccaataagaaacaaccaaagctgggaaaaagtaacattgtgcccctatttttaataaaaaagagagaaagaaatg

SEQ ID NO: 672120 - DNA, 171 bp, Homo sapiens
cctgtttaacttttgctttggaaaacacctgctgcccttttacatgctggagagcaccactgggctgtcctcagctagcaccagtggagggtgaatatagaccagacctagccagagtgaaattgcccaaaccagcagtctgaatctgacatccagcacgcctcacttgcc

SEQ ID NO: 672121 - DNA, 149 bp, Homo sapiens
  misc_feature (59)..(59): n is a, c, g, or t
  misc_feature (142)..(142): n is a, c, g, or t
atttcggcgcgagggagctcaggtggaaaaggagggagctgctctcaggctgcgtccanaaccagtgcccagggtctgatgagtctctcatcgcttgtaaagcctgagacagctgcctgtgtgggactgagatgcaggattncttaaaa

SEQ ID NO: 672122 - DNA, 756 bp, Homo sapiens
tgacgccggtgcagctggggtgtgtgccctggagtgccctgtgtggcccttgtgatggggaacctgcggtggcttcctgcggagtgtttcgtgcagtggcattcggggccggggtcgcggccgtggacggtggccggggccgaggccgcggagctcgctggagtgcaatggcctgaggataaggagtggatgccctgtcaccaagttaggtgcctgcttggtcaaggacatgaagatcaagtaccctggaggagatctatctcttctaccctgcccattaaggaatcagagatcattgatattcttcctgggggcctctctcaaggatgaggtaaagaagattatgccagtgcaagaagcagacccgtgccatggcagcgcaccagggttcaagggcaatagtagctaatcggggactacaatggccacgtcgggactgggtgtaaaaggtgctaccaagggagagtggccacacgccatccggtgggagccatcaatccttggccaaggatctccaatcagtacccccggtgactgcagaatgaggtaactcgggggggaaccaacaggaatccgggaaggcccacaacactatgtccccatttgcaatggttagaacactggccgggttagtcgatacctgtagtggaaccggccttcaaatcccttgcaaccacagagggcactgtggaattcggtataccgagacacttttagcctaagaaacatgaccacatcaatggagggaatagagta

SEQ ID NO: 672123 - DNA, 173 bp, Homo sapiens
  misc_feature (1)..(1): n is a, c, g, or t
ntgatgaggaacgtactgggatgaggaacgtcaccgggatgaggaacgtcactggtatgaggaacgtcactgggatgaggaacgtcactattctatctattttgtttgttttgttttgttttcctttccggttctgaaggacccacaaagtctacttttattgcttctgacaa

SEQ ID NO: 672124 - DNA, 214 bp, Homo sapiens
  misc_feature (178)..(178): n is a, c, g, or t
  misc_feature (198)..(198): n is a, c, g, or t
gtggttaggaagcaatttcccaatgtacctataagaaatgtgcatcaagccagcctgaccaacatggtgaaacccatctgtactaaacataaaaaaattagcctggcatggtggtgtacgcctgtaatcccagtgacttgggaggctgaggcaggagaatcgcttgaacccgggagcnggaggttgcagtgagctaanatcatcgcccccagtg

SEQ ID NO: 672125 - DNA, 135 bp, Homo sapiens
cggcgtacagcgggttggtgtcgttcgtcaacgcgctctacttcgccggggttcagcggggtgatcctgtcgatcatgccgatgctgatcctgcgcggcgcacgcaaacatggcgaccagacgccgcgctggcag

SEQ ID NO: 672126 - DNA, 165 bp, Homo sapiens
aatacggtggtgctgatggtgatgtctgctcccgggattaggaggcagaaggagatccttccgcggtgctagcgtgagatggatcctctcagtgcccaacagctggctgcggatgttggagttggagatgatggccgatatgtacaacagattgaccattgcttg

SEQ ID NO: 672127 - DNA, 770 bp, Homo sapiens
ctagtcacatgcctatgcagatgagtcaaacccaggcccatgacccgtatacacgggccctatcaggccctcttaagttgacctccggccgtagtccatggtgattaatcaagttccactcacataacgctcctcatactagtctctactataccgacactcgaaccatatatccaatgatggcgcgatgtaagcacgagtaagcacatgaccaaggccaccacactaccacctgtccgtcaaggcctgtcgatgacgggataatcctatattaattacctcagaagttttgtttcttacgcaaggatttcttctgagccttgttaccactccagcgtagctccctaccccccaattaggagggcactggcccccaacaggcatcaccccgctaaatcccctagaagtcccactcctaaacacatccgtattactcgcatcaggagtatcaatcacctgagctcaccatagtctaatagaaaacaaccgagaatccaaagatgaattcaagcactgctcattagcaatatttagctgggtctctattttaccctccgtacaagcctacagagtagcttcgagtctcccttcaccatttccgacggcatctacggctcaacatttgttgtagccacaggcttcgcatcggacttcacgtcacttaatggctcaactttcctcactatctgcttcatccgccaactaatatttcacttaatccaaacatcactttgttcgaagccgccgcctgatactacattatgtagatg

SEQ ID NO: 672128 - DNA, 198 bp, Homo sapiens
cagctgggacagctattaggtgttgttgatttggttaaaaatgtaagggatgatgctaataattaggccggggtgggtggatcacctgaggtcaggagttcaagaccagcctgaccaacatggagaaaccgtgtctgtaccaaaaatacaaaattaactggggtggtggcacatgcctgtattcccagcttgctcaga

SEQ ID NO: 672129 - DNA, 185 bp, Homo sapiens
cacactcaggaaacaagttataacggggcatcgtccaatatgaagatacatttgaatggtggcgcctgccatctgctaatagcagttcaaactaaagcgcttgtatcaagtccccaacacagtcaggagcaggctgtagtcacatctcttagacctaagagtacacagctgtcaggcaaagtcct

SEQ ID NO: 672130 - DNA, 156 bp, Homo sapiens
tggccttggggacaggggcccagggttaaacaagggtgggccgtttgctttggttcccacaaaaaaagcccctccccccagcccagtgccccccctgtttatttggggtgcctggcaaaaacccttgctgtttacaattaaaatgtttttccccca

SEQ ID NO: 672131 - DNA, 133 bp, Homo sapiens
ctcggcctatccggaatggcccgacggtactcggactcacccgatgcatacaccagatgataggatgtttcatgtgtgtgtatgcatcggggtagtccgagttacggcggggcatttcggataggccgagaca

SEQ ID NO: 672132 - DNA, 1004 bp, Homo sapiens
tacccagcaggtaagtcttaggccatcgcctgcggtgtctgtgaccctgtggagcagctgaagatccaatgattgcatcaaagcgttatgcccctgtctcatgcatactgtgacatggactgtgaagtgattgctatcatattttggcacctgcccttatccctgtctcagtgtacgaactgtaatacacattgaacgaaacagtccctttcccgaagtacagacataggcacgccaacatggtagcaacagaacgataaacctaagtcttgcagttccgcccatcgcactgaaactgcgtggtgggtgtaggcggcaggagctggcaacaaggcagtaagggggacggacgtgaacgtggtgcagcatgcttgcaacgaacgctctttacataccatctcttgccggtatcctatgtgtaaaccggcgactcagatgtccttgaagtactgtgaacgtggacattaatgaaatacacggaagaagactcaagaactaaacccggggccctctaacactcaactaccgcgcgttccatcaccgttaccaccgacatgcatgggggaggttacgaggaccggctcctgctcgtgaggcgccgagcacgtcgtagaacagacacggggtgaaggcagccgagagccgatgcagggcggtgtgagacccaatccgtgggggtggccagggcgccaaaggccaccccaaccctagaaaccccgaggagcctgcatagcaacccatggggggacatggagatacgaacccataaaagaaggaagtacgattgcgaaggagaatccgagacccgtccacaccaaacaaagccggctaaccagaagtgacaacccggcgcgacaaggcgccaaagacaacatatgtgcgccccaagggcgcggcctgagcagcgactaccagaagccactcggaaccacagagcacggccgggatagccaacaagaccagcagcccgacgcacagcacaagagtagcccacactatcacgg

SEQ ID NO: 672133 - DNA, 546 bp, Homo sapiens
aagcagtatcattactgtgtcttctagccagcaggcattggatcatcattaacaactatttcctacgtttttcctccatgctaggcttgggctggatacaggacattcagagctggcctgatggtctgtctaatgggaaagacggttcataattgactctggcgggttgtgtactcacttaaaaggttttttttttttttttggaacacagttctccctattgttgcccaagcttggaattgctaggttggcaatccttggctcacttcaaccctttggcttccgggggtttaaggggttttcctggcttcaggctcccgaaaaaaattaggattaccgggcgattaaccccgatattgcgcggcaaaacgttttttagctaaaaactctggccagttgggggaggttccgccctcctttgcgggaaaaaaacgggaagacgtcccatacttcggcggccggagggtacacacatatccgctttgaaagaagatctgcgattatcagatctctataaggcgtgggattcaaccgcgtgcttgctct

SEQ ID NO: 672134 - DNA, 1468 bp, Homo sapiens
ggcgcctccggttgtcgtacgtgattgctgcgctgcgacgtggtttttctgggcgaatcatctcgttcgagcgtgcgctccggtgacgttctgtgcagtctttgtgcttcgacgctttactctctgtcgtggtgacaccacttggacccgtggcccctccgtggctcttcgtgagggccgtggggtgcgccacaactcgttcttcttttttgggaggcccccggtttcccctccgggtcgcctccctgggttgtgtgtaaccagacccgcgggttgttgcaacgcccccggtgtggtgcgccggggccaccaccccaccgtagtgggccaatgggccaataagcctttccccccacaagtggaaactgtgtttccctgagggccacggggtggccgccgagggacgcgtcttcccatgttgtgcgccgcgtttttgggcacgccatctccgggtgtggcaccgctcgccccaggtgggtcttggccaagagtttccgcaaggtgctgcaacgcctggctgtgagaggtgaatccccgcgccccccccgcttggtttttccccgcacttgcagaacgagccgtgccgcggtgcctgtgttttttaaagcaacactttggggttttttcctccccatctccagggatttcttgtttcctctagcgattcttgttgccctctgtgtcgcaagatgggtgttcccgcggaggaggccccccggggaggcctcgcttcgcccctctgcgggcgcccccctcctaggtgggcgttttgcacgaccttcctgggcgttctgaggtcccacttgggcccccgggttgtggggcccggcaccaccgcctttttctgcgcacctctgtgcccggaggtttcacgtggccccacgggtcccctctgggccccctctttttgttcgtgaacagagttcaccacaggtgcacacacacgaagagggggcccccgctgctcctcgccctcggcttctgaaaagccccacatcgctgttctggcttgcgcccactcttttcggtgctttttaatgctttacaattattatatgaggagagcccacacgcgaggtccgttgctttcgagactccacgccactccacggggagcgaactgtctgacactctcttgggcgcacacacgacggaacttcacacttggtcccaacacacccgaaggcgcgagaccccgttcaaccacgccctctcacagtgcaccttcccacaagccccctcgccttgttctgtgccacttccgcggggcacagctcttgcgagggggtttgtctgtgggaatctggcgccactcgtccgggatcctccacgaaaccgcagaagcctctcccacgctcacacccctggaggacggccggctctttaatatgcacccacagggactcacacgctgggaacccccctcccacccacccgcccaccaattaagatcgcccccacctcacca

SEQ ID NO: 672135 - DNA, 497 bp, Homo sapiens
  misc_feature (14)..(14): n is a, c, g, or t
  misc_feature (416)..(416): n is a, c, g, or t
  misc_feature (423)..(423): n is a, c, g, or t
  misc_feature (431)..(431): n is a, c, g, or t
  misc_feature (453)..(453): n is a, c, g, or t
actggggcatggtnggggggggggtgaaagatacacttggacagggccaagaggcatttcactgccatgaaacaaggcagggaggggttctaatacacacaccagggggccctcctgcccctcagaggtcaaggggctgatcctatattggtatgaggaatggctttttttctgatgaccacatgtgggactatttcaaccgccacaagaaaccccagaagggtttttgttttgtttttttttttctttacttttttaataaaagtaaattaacacataacgaaattcagggttggtcccaacctagggccagatcctctggggtcggggggggaacagttgtcacatcaccacgcaggttacattcgtcttccactgggatgactagggcccccaggcagtaggcagtgacctgnctgcagnagagcagngggcagactccgctcatggggncagacaggctctgttgcttctcctcactggtcatggctttgcat

SEQ ID NO: 672136 - DNA, 190 bp, Homo sapiens
taacagttaagggtatctgggttcatactggaaaactaaactccatgcttatggctaaatgtggtctttgccaattaattttaaaatgcacgcattttataagaaattttacattatcaatggttccctacacgtattggttcgcgtaatttttgaaagtaaacgtcatgactcagtggtgctttggtgg

SEQ ID NO: 672137 - DNA, 812 bp, Homo sapiens
caaaaagacgtcggagaaaaagtgccgcgaaaaaaatggatgagttgcaatttctctcgggaagtggcgcgggtgtgggtgcgtggtgttgttgttcccaacgggccccggaaggcccaacttccgcggaagggcaacgcggcgcggataggcgaagcgccgtaggcccaagcggccgggggaaggacgacctcgttatcccgcgttccccgcacgcgctgtggactcgggaacgtgagtgtggccggggcctgtgcgggaacggtggcattggtgcggggggcctgtggaacttgtgcctataggaatttcccggaaccccggttacaaacaccaaagttgtgcccttcttccgaagcttaggccgcgggccgaagaagacgcccataagacttcgaagttgcggaactcgcgggattgggcgagacgggccgaatggggaatagtggggggggaagcgggtgcccccccgagccccaggaactcgggccacaccaagggagaagcccggaaacagcgggggccccccgtgggatgcaggcactggggaaaaagaagcacctcagcattggtgcccccgaggagccccccgggggaagaccctataatactaaacaggggcccacgggaagccgagaaaggcgggggcaatgtgcgcgggggccttggggcgggagaagggtgggaggagactgtgacccactactcaaggacagcacaccccaaaggacgatagtgagagccaataaaaagtcatgaggaatgggccccaaggagccccatgcatggcaatcagatggcatacccccggg

SEQ ID NO: 672138 - DNA, 554 bp, Homo sapiens
  misc_feature (15)..(15): n is a, c, g, or t
  misc_feature (20)..(20): n is a, c, g, or t
  misc_feature (62)..(62): n is a, c, g, or t
  misc_feature (510)..(510): n is a, c, g, or t
tgctggctagaccantttgnttccctggcttcagccccttttccaggagagtgaatggttcngtcttgctggcattccaggtgtcactgaggtatgaaaaaaaaaactgcagctagctcagtgtctgcccaaatggccacccagatttgtgcttgaaacccagatccctggtggcataggcaccggagggaatctcctggtctgctggttgcgaagacttggggggaaaagcgatagtatctgggccagggtgcactgttcctcatggcacagtccctcatggcttcccttggcctaggggagggagttcccagaccccttgtgctccccaggtgaggtgacaccctaccctgcttcagctcgctgtctgtgggctgcacccactgtctatccagtcccagtgaggtgaaccgggtacctctgttggaaatgcagaaatcacccgccttctgtgttgatctctctgtgagctgcagaccggagctgttccttttttggccatcttgcccntggttcctagtcaagcattttttaagagaggattttcatatagt

SEQ ID NO: 672139 - DNA, 1240 bp, Homo sapiens
agctgccgaagtcagttccttgctggagccgtgagctgggcgcggattcgaccgtaggcaccgaggacacgtcagaggaggcgccatgtcagaaccggctggggatgtccggtcagaacccatgtctgcagcaatgggctgccggcgcttctcttcggccgcagatggacagctgagcatgatgatcctgctgactgtgattgcgctaattggctgggctcgcgtccaggacggcccgtgactcgatgtgaacttcgactttgtcaccgagacaccactggagcgcggtgacttctgccttggtatgcgtgatggcgtggtggccttgtgggcatgttgccgaacgcgtctagcctttcccatcggtggccccggactatgccctggggagtgaggtctggggaggtaggctacggctgtccctgtctacccttcagcgctgtcatcgttgcttgtcgatgggtgaccaaggcagtatggtgacatggaccgattcgttcgggagctccattgctttatcttggtcactatagtttaacccgcgtttcgtttgcgcttctgcgatcaacagtcgcgagactgcccaattgtgcccttagagaatggtgtgttcactcacaatgtggttgggacccccttttgcgatggaagcttcgttcgaatgtggggttcgtggaagaaacaccgtgggacgtggggctaggtaacctcgaacggacgcaattttgcatgcgactggaaagttttcttcagttaaacgcagaatgtttcccctatatatattcccgatcgccgtgggtggtccggtcgcacgtaccttatttcattcgccaaaaacgggatgctggaacacatgtccgctcggttaaaagttcgcctgggccgcctaaccattagcggaatgattacccgctttggcgatcgacatcccccgttgctgcactacaactgtccgcggcagtgatatgcgggttagctcaccatatcatgagcagagcgcgtgtccgccgtcagtgtctatctatttaaatcgacacattcgtttatattacgatttgtgcccgccatttttagagggggttccgcatttccgcacggatgtattacattgtggcgttgtgattttggatatacgtcgtttttgtacgaatgtcgttgcgaaatttttacaacactatcgatcgtgtgtgtttgtggctttacatctcggcttaatacgtattggtgtcaacacagacac

SEQ ID NO: 672140 - DNA, 844 bp, Homo sapiens
  misc_feature (508)..(508): n is a, c, g, or t
gggagttttatatacacgccctttattttgtgttttcttctctattgggcggttttttttctggagcgcgggcactccgggaggatccccacacataaagggcgcacacctctatatttttttttttttttcctctccctaattggcccacaccacaccacgacgttgtggggaaagggagtagagagagaggttttgcacaaaagactgtccccacagtgtttgtttgccccccttggcgcccccttctttaaatgtttccgcacaaagcgtccgtcctttggggggcccccacacgtaattacaagtctgtttctggggaaactctctctttggcgcaccagagttttcctctgagagttgtctctgcgcctataaagagtggggcgccctccccaacgcgcagcactgtgtttgtgggggcaaaaagagagcgccccacaatggggggagcacacaccacaggtctagatgcccctagggacaccctgggggcgccacacataanacaccgggggcgcaaacacactctctgggcgtacacagagggccccacattgtggggcccctccccccacgttgtagaagagggcccccctgttttctggcccttgttccgcgtccagggccgccagaggcgcctggtgcccagaagagtggcgagagtggaatctcttcccgaggatttctttggcccgggcgcctccctctcctgccctgtttttggcgtttcatcttgcgctctccccaggtttacatgctccccttttcttggattttgggggaacctccccccccttatttaagattttttttgtgcccccttggggccgcatgggggcca

SEQ ID NO: 672141 - DNA, 674 bp, Homo sapiens
agccggaagaagcgtgcggttgccatgtaatatcctggccgctgcgggcgcgcgagcggctgagtgctggcgccggtggcgggcgcggagctggcaagcgggtggcggaggctgtgctgcctgactggtgactgcttgagtgcgctgcatcatgggtcgcgcggcgcccaggggagcctgtcgcctggctgcggtcctggtgcgtggatgtgctcgcgctggctgcgcgcggcatgtcatgtccggtgcgccgcggcatgaaatggaaggcatgcttctacaatggctgagtccatgcttggtcatgtgagaatgtgtcggatggggccgagggggaccaaggctggactgatgacttcaacaggatgactggaccgaatgaacggtggactgtcagccagccatatgggcggtgatcatgaagctgcttggtccacggatccagtcggagtacctgctaggcccaaagcccctaggtcacttcagcagtgagctaaaacggctgaaccatggccttcaagcaactgtgtggttcccaaatgaatcccagcggtgccctaggggttggaagcaatccccctgggtcgtatcgccagtcaaggtcggcggacgggggcatttcgtgtggcgatgttgcagttgaatccttgccactggggaacgggatgctgggg

SEQ ID NO: 672142 - DNA, 609 bp, Homo sapiens
gggcgagggggcggtcgccgccgccggccgcctccccgacaccgtcggaggacgaggagccggaggacgaggaggaggagagcggcagcggctgaggaaggtgaagaggagacggtggcgtcgcggggaggagtcggctgggcgtttcctgtcgcgaggctgcctccctggtgctcgggtcgggccttggacatgcagctgcctctgtgatctgcgactcctggatcgtgccgcctctcctcgggcacgtcagcgacttcgtagttcctctggactactgctacctcccgtggttaccgagatgagtcgcggggtgactgtgctgcccgtcctagcatcggcactactctggttttcagccgtacgtgaggcccatcgcgttcagccgtggtgcgctgcacgcaccctcagaacgcaagcctgtattacatagccatgcgaaagtccacggtagcttgaggggacccccttcggggaatggccggatggccttgggctagcccccaatcgttcccctgtcgccaggggcttgacaccgttccctgggcaccagtgaccaatcggcccggccgagaataccgatgctcacaagggtttcgccaggcacgc

SEQ ID NO: 672143 - DNA, 491 bp, Homo sapiens
gaaagtagcagagcatatatggacagtttgagtttttgtcgtcttagtgaggtgaatagatggggggaggagaaatagggtgaaggagtaggtaggggggcgcacacttgatatggaaggcttggtgatgagatgtcagaatttcttgtgttctgctcttaggggaggacgagcttatgatttttgactatccagtccctttgaaaggaggctccttgctgtatagcaaagcttcctcggtggcatgagttctggggtaggatggctgggatagcaggacggcgaggggcagagtgcagaagacagggaggcttctttggctgtacaccttcctctttagtcaaccgtgacagatacataaattcgtgagacctcgacctcgtccctagcacccgaaactctgtctctgctcccaagccaccagttttttccagctacggcggtctcctgataacggagagggcctgcgggttaagggtaccagtccttgg

SEQ ID NO: 672144 - DNA, 274 bp, Homo sapiens
actggccgtggttgaacagcgagatgacggaaagaccagcattcttaagaccttgggatgtgttacactgcgggtaagagaagacactatatcagagaccattataaatctatgattcactctcattattaaccaaaacttgttcacctttatttcatgtattatgggatccagcaaaacccatttatgggaccaaagaccctgcctgtattgttattactaatgcggattaggctgtgaaagtcaccaaatccccgccatggagtaaatggca

SEQ ID NO: 672145 - DNA, 1740 bp, Homo sapiens
gccgctttttttttaaaaccacagaaaactggaagtgggaaatcgacagaaaagaagaatcagatacttgacttaggaggcaaccctatctcttgagatttctctgaagagactcagaacagagattgagtttacctcagattcacccaagtataggccaaaatcgcgggcttctggaagagaaaagagttgttcattactatttctcttttgttagctggtattggcaagccaaggaaagaccaaaactgtcaaggtaggccgagaaaagtaaacatcttttagcaaggcttttattttcaagaatattgtcgcatgtttcttttgcttttcttttgttgtgtaacaaaccaccccaaaacttactggcacaacaaccaccattttatttggtcataattctgcaatctgagcagggctcaactaggcagttcttacagtcatcttgctggtggtcattcatactactgctttcagccagcaggtgagaaatgagatcagctaggatactagcatggctaagcatctctctccatgtaatctcagaaattctccctctccatgtggcctcttttccactgggtctctctaggagaacggtcagattcttacatgatgatcctctctctcgaaaacacaaaagcataagttgtcgggcctttttgcacccagacctggaagagctttaatccctttgcattctctttgttaaaacaagctacaggcccaacccaaactgaaaggaaagtgacttcacacgagcatgaatgccatcaatgtaatagacaactaaaacattcaggccaatgttcagatgactggaatggacacaaccacaagaaactataaaatggctaaagcttgaagactgagcaattatagtcagattctattctctgttctttcccacaatgagagtcaatctacgttcaccaggaatcttaattataagtggaacctgttaatcacttaaaggccatatgaccttagacaagtcaattaatctctctaagcttcagctgctgtattgtaaaacaggaaaaattatacatgccctgcctgtcttagaggaacgctgtagaataaataagagctttgaaagctgtaaactgctatacaaatataaggaaatattatttagctgacaggatggtaagtataatcaacctagctaggctccattctcctccctattaataaaattataaccatcatcaattaccctatatgctaaatgactaccacagcaatattatatataatagcaagctaaaattacattatgttttgttactatgaagaataataacactaactacaatttattattgtccaattatatgtcaggtgctgttggttactttggataatctataacccttacaataactcaatacggtaggtattatccctcatttacaaataaagaaactgacacttggctactttaagtaacctgcccatagttacacagccagcaaatgaaaaatccattcttagcatctaatgcctaataggcacttgataaatatttgttggataaattaaagaacaaataaagccaaggctatctggctttaatgcaacgttgttcaaatatatcaaaggatttctctctcacaatccttatttttatatacagctattaaaactgtaatcatagcaaacacatctaactaacatgaacaatttaaccttccacatcaagaaaatagtttcccatctgaaaagtacattttt

SEQ ID NO: 672146 - DNA, 836 bp, Homo sapiens
ctcggtgttaggacattgcaggcttgtgtcgcagtcttgccgtggctggggtccgatgtggtccccggagcgggaggccgaggccccagccgggggacgaccccggcgggccttctgccccccgagtgggaggaggacgaggagcgcatgtccttcctgttctccgctttcaagaggagtctgcgaggtgaacagcaccgactggtgacagcaatgatggtgcttctgggctgcctgttgtgtgctgatgccacagcctgcctgccatgggtgtgtgttgtgctgcctgctgtctgctgtggacttgcagtgaggcctttcatgcgcaaggggagctgtccctgctggtggcttggccaccgtgttgctttgcagtgacctgcttgctgtcgatgtgtggagctgcagctgtggatgtcagacttcatggccagtgtagacagcagctggatctcctgggggtgtttggggtcttcctgctgaagcctctcaagtggactctttctaacatgctgggagataataagtgttccagctgaggaggtccttgtcgctgtggagctgttgaaggaaaagtgctgaggaggtgtatcgtctgtatcagaactcgcccctctcctcccaccccgtggttggccctgtcagagctcagcaccctactgtgctaactcctgcccagatgaggaggaccttctacttggtgttgctgcagctgcagaaggagaagatggtccagtcctcgagcaaacggggagaagattgggaagttgccaagggcacgtgccaggttctccagtcattgaacttaatttggggtgtccgtgttcaatgaaatc

SEQ ID NO: 672147 - DNA, 349 bp, Homo sapiens
tgccttagcacctttgaaaaaaatctcttggctattctggggggaagctatttctgaatcctgttgggttccattgatctatgtgcctatcccaccagtaaggcctgggttatcctgtttggcttggttgaaaaggaatacctgaggcaggataattaataaagaaaagaggtttatttggctcacggttctgcaggctatagaagaagcatggggccagcatctgcttctggggagggcttcaggctgtttccactcatggcagaaggggaaggggagtaaacatcccatgttcggagagaaggaaagagagaggagggaggcgccagattctttctaacagccagat

SEQ ID NO: 672148 - DNA, 315 bp, Homo sapiens
  misc_feature (306)..(306): n is a, c, g, or t
cacggcaggttgtactcgggcctgggggcttcggggctcaggtcccaagggagggtctgggtcaggccctaccattgaggaggtggattaggggcctttgttctttacgtatgtttgtctttagaggtggactgtgtgggactcaaggactttgctggctgttttccttatgttcatttctggcttcagtctgttggctggcttcacattcttggtaacagttaacgctgtaaccctgatggtaattacgctggcttcattatttttggtagtacaacgctgccgggtgggggtaccggagctcgnatattcgta

SEQ ID NO: 672149 - DNA, 503 bp, Homo sapiens
aagaactcttcatcttcaaactaaaacaatgtgcccactaaacactgattctccatatcttccctctctcaggcgcaacacccagcactctattttgtgcatcgtatcaagtgtattttaggtacctcgtgtaagtgaaatgagaccagatcatgctaagcctcacaacggtgatacgctctgagaaatgcatcattagacagttgtgtcattgtgtggacatcatagagtgtattcacacaaacctaggttgtgtaacacttacctcacacgtaggctatatggatagcctttggctcctgcgttacaaacctgtacggcattactgtactgaatactgtaggaaattataacacaatggtatttgtgcatctaaacacagaagaggtaatgcactgcactacaacattatgacagctatgatgtctctagacaataggaattttgcagctccatcataatcttatggggcaaccatggtatattcagtcccttattgactg

SEQ ID NO: 672150 - DNA, 157 bp, Homo sapiens
atccattgaggaccctgagccccgaagcaccccaggaccgggaacaacggcaaccatggtacaagatccgaatgactgatggggttacacacactgacatacaagaatcacttcctcattgtgcatcaaacctcgtccattctcggccaaaggtgta

SEQ ID NO: 672151 - DNA, 169 bp, Homo sapiens
gggggggggggggcccccccccccccccccaaaaaaaataggggggtggttttttaaatttttttttttcaaggggaaccggggggggttttttttggccccccccggttggggggcctttttttccccctataacccccccctttttttccccggggttgggggggga

SEQ ID NO: 672152 - DNA, 2180 bp, Homo sapiens
gtgaaattctgctccggacatgtcgggccctcgcgccggcttctaccggcaggagctgaacaagaccgtgtgggaggtgccgcagcggctgcaggggctgcgcccggtgggctccggcgcctacggctccgtctgttcggcctacgacgcccggctgcgccagaaggtggcggtgaagaagctgtcgcgccccttccagtcgctgatccacgcgcgcagaacgtaccgggagctgcggctgctcaagcacctgaagcacgagaacgtcatcgggcttctggacgtcttcacgccggccacgtccatcgaggacttcagcgaagtgtacttggtgaccaccctgatgggcgccgacctgaacaacatcgtcaagtgccaggcgggcgcccatcagggtgcccgcctggcacttgacgagcacgttcaattcctggtttaccagctgctgcgcgggctgaagtacatccactcggccgggatcatccaccgggacctgaagcccagcaacgtggctgtgaacgaggactgtgagctcaggatcctggatttcgggctggcgcgccaggcggacgaggagatgaccggctatgtggccacgcgctggtaccgggcacctgagatcatgctcaactggatgcattacaaccaaacagtggatatctggtccgtgggctgcatcatggctgagctgctccagggcaaggccctcttcccgggaagcgactacattgaccagctgaagcgcatcatggaagtggtgggcacacccagccctgaggttctggcaaaaatctcctcggaacacgcccggacatatatccagtccctgccccccatgccccagaaggacctgagcagcatcttccgtggagccaaccccctggccatagacctccttggaaggatgctggtgctggacagtgaccagagggtcagtgcagctgaggcactggcccacgcctacttcagccagtaccacgaccccgaggatgagccagaggccgagccatatgatgagagcgttgaggccaaggagcgcacgctggaggagtggaaggagctcacttaccaggaagtccttagcttcaagcccccagagccaccgaagccacctggcagcctggagattgagcagtgaggtgctgcccagcagcccctgagagcctgtggaggggcttgggcctgcacccttccacagctggcctggtttcctcgagaggcacctcccacactcctatggtcacagacttctggcctaggacccctcgccttcaggagaatctacacgcatgtatgcatgcacaaacatgtgtgtacatgtgcttgccatgtgtaggagtctgggcacaagtgtccctgggcctaccttggtcctcctgtcctcttctggctactgcactctccactgggacctgactgtggggtcctagatgccaaaggggttcccctgcggagttcccctgtctgtcccaggccgacccaagggagtgtcagccttgggctctcttctgtcccagggctttctggagggcgcgctggggccgggaccccgggagactcaaagggagaggtctcagtggttagagctgctcagcctggaggtagggcgctgtcttggtcactgctgagacccacaggtctaagaggagaggcagagccagtgtgccaccaggctgggcagggacaaccaccaggtgtcaaatgagaaaagctgcctggagtcttgtgttcacccgtgggtgtgtgtgggcacgtgtggatgagcgtgcactccccgtgttcatatgtcagggcacatgtgatgtggtgcgtgtgaatctgtgggcgcccaaggccagcagccatatctggcaagaagctggagccggggtgggtgtgctgttgccttccctctcctcggttcctgatgccttgaggggtgtttcagactggcggcaccgttgtggccctgcagccggagatctgaggtgctctggtctgtgggtcagtcctctttccttgtcccaggatggagctgatccagtaacctcggagacgggaccctgcccagagctgagttgggggtgtggctctgccctggaaagggggtgacctcttgcctcgaggggcccagggaagcctgggtgtcaagtgcctgcaccaggggtgcacaataaagggggttctctctcagaaaaaaa

SEQ ID NO: 672153 - DNA, 434 bp, Homo sapiens
ttagcatggtttctctaaggagctcattttttaaaattggacaatggtattagaaaccaagatctaggaaaccgtcattctcagcaaactaacacaagaacagaaaaccaaacaccgcatgttctcactcgtaagtgggaattgaacaatgagaacacatggagatagggaggggaacatcacacactggggcctgtcatggggttgggggctagaggacgggtagcattagaagaaatacctaatgtagatgacgggttgatgggtgcagcaaaccaccacagcacgtgtatacctatgtaacaaacctgcacattctgcacatgtaccccagaacttaaagcataattaaaaataataataataataggcaaggctctgagggaggcatctgtctaaaggcacgtgaccagcatttatggggagaggagaag

SEQ ID NO: 672154 - DNA, 475 bp, Homo sapiens
aggcagctgctgcctgcactacagagggcgacggtagcttgggcgcccagatggcggacgcatggtttgtggtggcctctgtgaagtgtgtgtgctccatcgcctgagggtcaccctggctggggccacataccccggtcttcctctgtctggagcctggatcagctggtattggacactattcagtctcaggtgatagagttcagttttcttatcccacccatgcacacaaaaaggtaactattctgtgaggtaataaacgtgttaagttgacttcattcatgtccactctgtcatccacaagtaaggctttcataacaatgacacagaaaattaatgttgctaaggatgtggagaagttggaggccctcatgatctggctgctatgactagaaaatgatgcccttgctgcggaaaacaatttggttgttcctcacagaatgagcgttgggtgaaaaatgacatcaagatgtcc

SEQ ID NO: 672155 - DNA, 755 bp, Homo sapiens
  misc_feature (251)..(251): n is a, c, g, or t
  misc_feature (254)..(254): n is a, c, g, or t
  misc_feature (279)..(279): n is a, c, g, or t
  misc_feature (286)..(286): n is a, c, g, or t
  misc_feature (301)..(301): n is a, c, g, or t
  misc_feature (304)..(304): n is a, c, g, or t
  misc_feature (308)..(308): n is a, c, g, or t
  misc_feature (338)..(338): n is a, c, g, or t
  misc_feature (345)..(345): n is a, c, g, or t
  misc_feature (354)..(354): n is a, c, g, or t
  misc_feature (360)..(360): n is a, c, g, or t
  misc_feature (370)..(370): n is a, c, g, or t
  misc_feature (394)..(394): n is a, c, g, or t
  misc_feature (422)..(422): n is a, c, g, or t
  misc_feature (437)..(437): n is a, c, g, or t
  misc_feature (504)..(504): n is a, c, g, or t
  misc_feature (515)..(515): n is a, c, g, or t
  misc_feature (582)..(582): n is a, c, g, or t
  misc_feature (595)..(595): n is a, c, g, or t
  misc_feature (642)..(642): n is a, c, g, or t
  misc_feature (689)..(689): n is a, c, g, or t
  misc_feature (693)..(693): n is a, c, g, or t
  misc_feature (695)..(695): n is a, c, g, or t
  misc_feature (697)..(697): n is a, c, g, or t
gatcctgagatcacgctctatgagaagggacataccacacgtaatgtatccacacacagagacccatgcgtacacagacgacacatactagacgactgagaccgagtgtgtacagtaggaccagcactcacacccatctagaagaagggagcccccggtataccaagcgagccacacgtgttcagacacacacatcacagaccttgactcactacactgaggcctttccatagctccacagcttcccaccnccnccccaccaaaccggggttctagagntaaggangggggagggtattanacngccncagtctgactcctcaacccagcagcaattngaggggntgagggggnagaggngctgcctttnggaggcccccttcacccgcagctntgatgcccttccccatcccccctgtccncaccatatgccttanccccattctacccccctgctatgcaagtgcccctgtggcttgtccccaaccccctcagcaacaaagntcagctggggnacgagagtaatttgaagaatgcttgaagtcagcgtcttccattccagaaagacccccattcttcctntgggggtatgatntggaagctggtttcagcccaggacccaccactgaggagaggatctanacaggtgggcctaattccaaggggcccttcctggcctggagaaggcntttnananacacacaacacataaacacacacacacacacacatatcacagttttcacacagccctt

SEQ ID NO: 672156 - DNA, 291 bp, Homo sapiens
  misc_feature (100)..(100): n is a, c, g, or t
ttttttccctaaaacccccccccccccttttttaaagggggggaaaacgggttccaaaaccttttttttcaatggcccccttaagtttttggggaaaaancgggtttttttaaccaagccctggtaaccccttccaaaggaaaggaaaatttttttgggccccccttggttttttttttgggggggggggttttaagtttttggtttttaaaaccgggcctttttttggggaaccccttgccccaaaatttttccccaattttttggccccctttaaaaagtttttttgga

SEQ ID NO: 672157 - DNA, 1021 bp, Homo sapiens
gctggaatgccatggcgcttatgctggcggtgctctttcggctgggccttcactacgctgtctcgtcttcagagcaatgaagattactttaaggatctgtgtggaccagatgctggggcgattggtaatgccatagggcaggctgactgcaaagcccaggatgagaggttctcagctcatcttgcaccctgggggtccttcatgaagcaacttcttgacattccccagtggctacatctttgaccggttcaagaccaccgtggcactcctcatagaccatactattttcgtacaaccatccgtcacatcgtcattcaatagcctatacaccgtcttgacaaggctacaggcgcgtggctggatccttcactgtgccatgctcaatgtcctcaacgcaattggaggagaactccgtgattctctccagtacagccaagaccttgacgagattggggaaccgtattagagccatacactgttcgagccatcatcgactactagtacagatggcagcaattatgacttcattccttcgcgtacgtcttccgttatcaattaacgctctctttgatgaaagaagtgcatcagccctcagaggcgctccttcatccttctatctactgtcgtgacagtacccttgggattgtagacacagcactattccatcctgaatgccccagggggtcacatcccataaccactgaccccccaactacagctattgggtctgtgccctgggaatggcaccacaagagtgaagcgcaaggaacacagctgagcattgaacaacagggagctaaaggtcacaaggagcttcctttccagcgaaggaagagaccccatgggcaggggccatgaagcaggaactcccgctcctttctggcagcttccgctttctctccggcgctttgccttggcaccttggtgtgggtgcctgtgcattccacgttggtgggcctaccgtcttcatttgggcactcctcagtcctttcttgacccagccatggccggtggtgccctt

SEQ ID NO: 672158 - DNA, 409 bp, Homo sapiens
gcctagtgactgctccggtgatgtactgtcttctggcaggtgtgctgctgctttctgcctggggtgacggctgctttcttggctggtgtggcatgtgcaacctttttgtgttggggaaacgaccaccttctttgctgaggttgcagcagccttcttgcccttatcttctgaggtatgacgacctcttctccactgctatcatcttctgcatctgctgacatttcctcatcttcactatcttcttctacctcctttggaggaggagccatttgcttggggtcaccttgattttgacctgccttcgggagctacaaccatgatggcggcggagtgtgaagcggacaagtggcgcagatgagtccagaagaagccaagcgacggcgatggcggccgcgggtgttgaagatcc

SEQ ID NO: 672159 - DNA, 292 bp, Homo sapiens
ctgtgctctacctggagctccttcggacagggtagaaagccgtttggtcgcgaatctgatgcgcttttccttgagctttttttcggggggcctgtgcgcccttgatgggcttgttcagggcttgcttggcgatggctgcattggcggaatcacaagatgagggaggagtttctggagcttctgctgcttcagatatttggcttggaaaaggtaccaggagaccttacctgtcgcctatcaacttctgtacctcggacttcatggcgctccgtactgcgttcccagaatttat

SEQ ID NO: 672160 - DNA, 393 bp, Homo sapiens
gctttgtctgtctgtccatccagctcacctgggctctgccctcccccctcaggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtagccagaca

SEQ ID NO: 672161 - DNA, 363 bp, Homo sapiens
tcctaccccacgacctcctacccctcctgcctcgacacctccgtggggtcttactttctccctcccaactatctgcagtcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacaggtgcccagatggggctatgctggggggcctgcgggtggcagggctggagtgaagagcatctgtggctcagacccaggcagggagtttgactcctgacttcacaagctgcctgctctcctggaatctccg

SEQ ID NO: 672162 - DNA, 163 bp, Homo sapiens
aagattcttttcctgtgtatttctaccgccgcactcgtcctctcctttgctcgctcagccgcatttgttctgtacgtggtgatcgccagattattgctccaccgccggggcagccccaagggctcggtgctatttgtaacggaataaaatttgtagccagaca

SEQ ID NO: 672163 - DNA, 2387 bp, Homo sapiens
  misc_feature (180)..(180): n is a, c, g, or t
tctttttgacgctccagggaccgcagggtctgggaaagttcctggttactccggcgaccggccggccgtcacatgacatgtgagccctggcggaacgcccaagaggcttccgtagtcgggtggcaggtcacgtgtcgaaggcttgcccgcggggaccccttccaccctggctccagcgtnacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtagccagaca

SEQ ID NO: 672164 - DNA, 2421 bp, Homo sapiens
  misc_feature (180)..(180): n is a, c, g, or t
  misc_feature (1268)..(1268): n is a, c, g, or t
tctttttgacgctccagggaccgcagggtctgggaaagttcctggttactccggcgaccggccggccgtcacatgacatgtgagccctggcggaacgcccaagaggcttccgtagtcgggtggcaggtcacgtgtcgaaggcttgcccgcggggaccccttccaccctggctccagcgtnacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggagtgggcactgatcgtagctaagctagtntgcactgaggtatgttgcaaggagaagccagagcaaaggaggatgccagtagagatgcagtccacatccagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtagccagaca

SEQ ID NO: 672165 - DNA, 139 bp, Homo sapiens
ccggaagtattggacctctctagatctaaattattaacatttgccacattcttatttcttatctctggtgtatgtgctatgtgtggagacaggggtctcgctctggtgcctagggggtaccgagactcgcaaattcgta

SEQ ID NO: 672166 - DNA, 2691 bp, Homo sapiens
  misc_feature (180)..(180): n is a, c, g, or t
  misc_feature (2397)..(2400): n is a, c, g, or t
  misc_feature (2589)..(2589): n is a, c, g, or t
tctttttgacgctccagggaccgcagggtctgggaaagttcctggttactccggcgaccggccggccgtcacatgacatgtgagccctggcggaacgcccaagaggcttccgtagtcgggtggcaggtcacgtgtcgaaggcttgcccgcggggaccccttccaccctggctccagcgtnacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtagccagacaccaaaaaaannnnctcgtctttctctgggtggcctctgatcttgcaccccgtcttcaccccagggctcctgaagactgtgggtcattcctcagggctctgggtgagtctctgcccttctgggctgggcgactgagatgggggactgctcttctccgagtgagctggctgagtgtgacccgtgagtcacacacccatgctctncctggagcctgtcaccttgcctcacaaggcctggctgaaggttgggggttggaactgcccctttcgtacccccagacgtgtctgttataacggatccgctaa

SEQ ID NO: 672167 - DNA, 125 bp, Homo sapiens
cccgactagcccgacagctgccctcagccaggcctgttggttggtgtctccatcggcctggtgacccccaatgtgccctggccccaacccgtccttcttttcagagtctgtctggctagtcgggg

SEQ ID NO: 672168 - DNA, 480 bp, Homo sapiens
agcaatcttggaaaggcccctaatctacctcctcaatgggggggcctgacccaaaccctcccttggtaccctgagccccgaagcccccaggcccgggaccaccggcaccctggtacagtccgctgatgatggggttacacacctgctccagctccttactcttgtgctcaaactcgtccttctggggcaaggtgttggcgtccagccacgagatgacctcttgacacttgttcagcaccttctttttgtacgcctcgctgatcttgcccttgagccccttatcctccacagggctcttcatgttgaaaggcgaagactccagggcgttttgggtggcaccctctttggcctgcaccctttcctcccgtttgttacttgtccccctcctggaccaaggccgcaaatttcttccttgtcaggcgggcctttttggttggtgggggcgaaattttcgtggctggcgcggcttttattccaggc

SEQ ID NO: 672169 - DNA, 2150 bp, Homo sapiens
  misc_feature (180)..(180): n is a, c, g, or t
tctttttgacgctccagggaccgcagggtctgggaaagttcctggttactccggcgaccggccggccgtcacatgacatgtgagccctggcggaacgcccaagaggcttccgtagtcgggtggcaggtcacgtgtcgaaggcttgcccgcggggaccccttccaccctggctccagcgtnacatgaccggctttaagcaacatggcggctgccgtggtgcagcgcccgggctgagcgacagcaagtgcagcgggctcctaccccgggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtagccagaca

SEQ ID NO: 672170 - DNA, 2231 bp, Homo sapiens
  misc_feature (180)..(180): n is a, c, g, or t
tctttttgacgctccagggaccgcagggtctgggaaagttcctggttactccggcgaccggccggccgtcacatgacatgtgagccctggcggaacgcccaagaggcttccgtagtcgggtggcaggtcacgtgtcgaaggcttgcccgcggggaccccttccaccctggctccagcgtnacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtagccagaca

SEQ ID NO: 672171 - DNA, 490 bp, Homo sapiens
  misc_feature (364)..(364): n is a, c, g, or t
  misc_feature (451)..(451): n is a, c, g, or t
  misc_feature (467)..(467): n is a, c, g, or t
  misc_feature (483)..(483): n is a, c, g, or t
tgatggagaccgggtttcgctgtgttggccgggctggtctccactgcctaaccgccgagtgatccgccagcctcggcctcccgaggtgccgggattgcagacggattaggttcactcggtgctcaatggtgcccaggctggagtgcagtggcgtgatctcggctcgctacaacctccacctcccagccgcctgccttggcctcccaaagtgccaagattgcagcctctgccaagccgccaccccgtctgggaagtgaggagtgtctctgccgggccgcccattcgtctgggaggtgaggagcccctctggctgggctgcccagtctgggaaagtgaggagcgtcttttgcccggccgccatctncattttagggaagttgaggaagcgcctttttccccgggccaccattcccattttagggaagttgagggagcgcttttttgcccgggncaacattcccttttanggaagttgaaggaagnctttttt

SEQ ID NO: 672172 - DNA, 421 bp, Homo sapiens
  misc_feature (108)..(108): n is a, c, g, or t
  misc_feature (223)..(223): n is a, c, g, or t
  misc_feature (414)..(414): n is a, c, g, or t
  misc_feature (418)..(418): n is a, c, g, or t
aaggtgttaggttccaaaaggctgcggaagagaataggctactgggaaaaacccaaaccccaacagaattcacgtcccaaaaatcccacattctcccatcgcttcctnaagccttttggctaagattaaagtattaaaaaaaaacccagctctgcccaggcgcagtggctcatgcctataatcccggcactttgggagtctgtggcaggaggattgcttgagnccaggagtttgagaccagcctgggcaacatagcgagaccccatctctacaaaagattaaaaattagctgcgtgtagtagcatatgcctttcaacgtagctactcaggaggctgaggtgggaggatcccttgagccgaggagtttgagtctgcagtgagctatgatcgcaccactgcattccagaccccatntttnaaa

SEQ ID NO: 672173 - DNA, 2218 bp, Homo sapiens
  misc_feature (180)..(180): n is a, c, g, or t
tctttttgacgctccagggaccgcagggtctgggaaagttcctggttactccggcgaccggccggccgtcacatgacatgtgagccctggcggaacgcccaagaggcttccgtagtcgggtggcaggtcacgtgtcgaaggcttgcccgcggggaccccttccaccctggctccagcgtnacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtagccagaca

SEQ ID NO: 672174 - DNA, 104 bp, Homo sapiens
acactacaggtgcgctgattcttttaagttttttagcagaaatgggatccagtatgctggccagactggtccccaactccgtggactgaatgcgatcctcccac

SEQ ID NO: 672175 - DNA, 2209 bp, Homo sapiens
  misc_feature (180)..(180): n is a, c, g, or t
tctttttgacgctccagggaccgcagggtctgggaaagttcctggttactccggcgaccggccggccgtcacatgacatgtgagccctggcggaacgcccaagaggcttccgtagtcgggtggcaggtcacgtgtcgaaggcttgcccgcggggaccccttccaccctggctccagcgtnacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcatggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtagccagaca

SEQ ID NO: 672176 - DNA, 228 bp, Homo sapiens
ccagggccgtagcccccaggaacccccagggattcccctttgggtagaggggtgtaggtgtcaagcctgagggcccctcgttggggttggagggagaccaggcctctgcggctgacctgcagataggccaaggctgtgggatgagtgactgactcagctctggggcttagtccgggatggggatgccccgccagcccaagcctcccctgcccctctgggagagaggaa

SEQ ID NO: 672177 - DNA, 523 bp, Homo sapiens
ctgatatattcttgaatttgcttgaacccggtaggtggtggtggcatggaactgggattgtactactggactttgtccagggtgacatggacaaactccatctgaaaaaaaaattaaattaaaaattaaagttaagtggctaatgccattaaaatgcacgctttgaatctaaactgccttggggaatctgaataggttctcctttgtataaataaaggttgttataaccttcttaaaaactcttttgatttatgatttcactgtgattattattctttgtaacaaatgctaactggtgaaaatgtaacataatacttttttaaaaaatttataatttaacaggaacgagggggaataatgtcacttacggaggtgtactgtttactaaacccagcttccggaatgggaattaggatagaaaaattaaatccttttttaaccaaattgtaaattttttaatacaaaatccctcaatttgaggaagggttgtgaatatcctttttttagaaccactgtggtactt

SEQ ID NO: 672178 - DNA, 225 bp, Homo sapiens
gcatggctgaggagtcggagaggctctgaggagtgttattcgcttgggagtctccaggccctccgaggtggacgcgtgcagacgggcactgaaccctgagccaggagtccgtcgtgcatgccgaaggctcctcgtactcaccccatgtggggtcttcagctactgaagaattctccctcgttcctgggccaggaagcgccacatcggtgaatctcgaaggcatgg

SEQ ID NO: 672179 - DNA, 742 bp, Homo sapiens
  misc_feature (2)..(2): n is a, c, g, or t
  misc_feature (61)..(61): n is a, c, g, or t
  misc_feature (106)..(107): n is a, c, g, or t
  misc_feature (113)..(113): n is a, c, g, or t
  misc_feature (124)..(124): n is a, c, g, or t
  misc_feature (427)..(427): n is a, c, g, or t
  misc_feature (440)..(440): n is a, c, g, or t
  misc_feature (449)..(449): n is a, c, g, or t
  misc_feature (458)..(458): n is a, c, g, or t
  misc_feature (464)..(464): n is a, c, g, or t
  misc_feature (737)..(737): n is a, c, g, or t
tnttcatcttttctttatggttcttcagtagaagccagaatcttgagttgcccagttaggngccttctgaaccttgctattcttgtttaaagtttctttcttcaannattcantggccaaccantcctggctttccacaagggaacggcgttttggtcttttcaatcacttgctgatagggtgagactgcattgttacccataaccacatgacctaatttagaatcaatcttggcatccagtcttgcatttctaatcaaatttacaatccaccttttcagcctttctttctggagtcatgttcaatttatctgccaacagtgtttaagtgtcgtgagtacacgtgggtggagtgcgacagaaaggtcttcaaaataatgaagagacgggcattttcaatgaaatcctcaagacaagccaccagagantcattcccagccntgattcacnttcccgcgnttttgngagcccctcaaagtcaaagtaacatataaacattcaacaaattctgtaattgggtctttatatgtgtaagactcctgttgaataactttaactagatcttttagaacctgccgacgttttcgaacatccttgtttgttatgactgctgtagtacaatagcgaagaatgtgtggacacattgtctgaattgcattaagatattgtggctgataaaggaagaggtcataatattatcgcgacctttggggtgattgaagaaacaaacagaaacantgaat

SEQ ID NO: 672180 - DNA, 468 bp, Homo sapiens
tttgcgctccatgtatgggctcacatgctcacagcatcatggtgtcagccactcttctcttgaaaccccgtgagtcgcaggacggccctgttctggtgctcctcatttcaatccctgggatcagtcaatgtctggagccaaggagtgcggttcacactgggtcttccttggaagtgagagggcgatccgaagaagttcctggcccagctcttgctgcctccctccagggccaaattcagccgatcgctcccggaaagtgacgcagacgctgtgctgggcctcgatgtgtctgcggtggatggcttgcttccagtggtgccttgccgcccctgactgggagagcttccatggggtcacggtccatgagccgaaccaaattcggtttcttcctcccgggtcacaaagtcctcgatcagcatcccctcctgggaatggggacatgtgccagccctcaaatcagactcctct

SEQ ID NO: 672181 - DNA, 923 bp, Homo sapiens
  misc_feature (545)..(545): n is a, c, g, or t
ggtcagaaaaacacacacacacacacacacacacacacacacacacacacacgaaaaacaaagaaaaaaggtgcttgcgctttctctaacttccccttggcgtctgttgtgtgagcacggctcgtgtattatcttcctcatatatatttagtgtcatgtattacttctctttgatagtgggatcgtgtaaaaaatagtgtatatcacagagatgtgccaatatatcttgaatagtgccaaagagggctattatgatgtcttctttcttctcgtgtgcctctgatgctccaccgtacagggatagtgcttgggagtgtcttctcgtgttatatataagggacttctcttttagagggcacaccacgtgtgcttcgtgttgtggtagtggtagttgtgcaaagatagtgtctctctgctgtgagggaatcctcttttacccattttgtgtgtgcaatcgttgtgggccctcagagagggtttcccccttcccttcccgctgttcctctcttttcttaattcatatatttcctgtagtgttgccaccngttgagccacgcacaacgagggtctatttctcccattgttgtacaaatagaacgacgatatttgtcgctcgttggttgttcttcaacaaagaagaagagcaaaaaaaagaaacagcaaaaaaacgaagttgtttgcgcgcgggccacgatccttgggtccaagaagagaagaaggtttttttaaaaagcccaaacttgtggtgtggggagccgcggggcccccacaataggtgttaatgatgcagacactgggtgtcaaaagggtgttcccccagaagggcaaccgctgcgggaacagcacatgggttggtgtgcgttctcctcaccaaataaaaaaacaccgcggggggacacgcgtggcttgttgaacccaactcg

SEQ ID NO: 672182 - DNA, 161 bp, Homo sapiens
ctcataccagaggcgacacagcaacactcacagctcccaccgtcagttcctgcccagcggctcacctgagcccctcctcctccaggttctggatagctcccagatgctgcctgtctcttcctcaacatcaaaagctgctcaggaaatacttttatttttaa

SEQ ID NO: 672183 - DNA, 187 bp, Homo sapiens
ctcctcgaggtctccagggtggcttgcctcgttgactctttcttcccgtcgtacagtagtgtgtggtgtcgtctgtgcatgctcattccatcaccctttcctggcacactgccaattatccagctatttccgggggagtcggccgtccgtgtcttgtgctgtctaatgaagagtacgcaggcagcag

SEQ ID NO: 672184 - DNA, 1181 bp, Homo sapiens
tgacagaagaatagaaaggcccccagtcctgggcaacatgtgtgaaaccccgttgtctacaaaaaaaaaaaaattgccaggctattgcattggtggggttgctccttgttggtggttgcaccaaggtctacttaggagacagaggcagaggacatttaccctgagcccaggaagttcaaggctgaagcgagcctgggtcatcacaatgtacaatgggactccagtccgtgggttgacagtaggagatactcctgcttcgtcaaacacaataaaaaataaagaagagaagaaataaaggcacccccgaggtggaactttggcctcggaagcgggcagagtttccccggggatgtgttgccaccgtttggtgcgctgcgtgagaagttcatttgttgcgtaccccgatgtgggtgtggatcgccagaacaagcactttgtggttaaccacggtgggaagacttttttaatcgggggcgaaactttctcacccagagggggttaaagaaaggcagtacgcattatcttgggggaacaagagtggggggcgtcccacaccgtggcgccacggagaccatttaccctataatgcacaaaaaaattttcctccaaaggtggtcccacaaggggacccgcctatttgtgacagagctgttggcgccctgggattgggcgtgacaacaccgtgtgtacaacagcattcacggtgtcaacccccatatctgcgtcattatgggcacctgtgtaccactacgtgtgtccccccagaagaacctccgtcggcaacagcccaccaggtggtcgcccgagaaggctgaataccccgagcaaacacgtcgggtacatacccgtgcaaaaatgcccctggagaaggccttgcagcaccgaatcaggggcccacacacccgtgttgatatatacacgtgcgcaccccgatttactcactgcggcgaaaatctaacgcaccgagcgaagcacacagtgcgcgcgtacacccccacgagggccccgccgcgccccccctaacgagaaagaggccaacactgcgaccccatggcggcacagagacacaccaacaaagagagcaccacggaccctccccaaaggccgagcacggggacgacaaaccgcgacccaccaagcaaacacatggcatagcacccacacaccaagaccaccaaacg

SEQ ID NO: 672185 - DNA, 539 bp, Homo sapiens
agcataatccttaggccttagagtcttgctcagacattttctggagaggatatttcccttccaattagtgaagtattgcaacagctgtgagagctagcccctaaagcccttctgggtcccattctcattcatgtaggctgtgccatgttaatggtgcccagtgagccttctagctcacagcactctgttagtggtcctgagaaacagatccatctccttcgagctgccgttgcccactttcttcccttcaggccacagcagacttttacgccacatgcttccattctccctgctctgcagggacaggacagaacctaaggaggctcagggaagggacctgggagggaacattgcaaggaagagatgggccatggagaggaagtatacaaaagtgacccagacaaagagattctttgggctttcatccacgtgaatgtgctgcttttcctctcctacttcgatacttccttctgattttacacatgttttgggattattcatgggcctggatatgatataaaaattaaagatttaaacca

SEQ ID NO: 672186 - DNA, 193 bp, Homo sapiens
tgccatatggacatctgagcagacaggggcgcggaggagagggcaggacaagaatgggagtgcagacagccgggctcccccttggttggaaaaggggcccagatgggcccagctgagaccacagtggcagcggggggtaataaccttgccccagcaggggagggaaggaacccccttggacttggcagcagca

SEQ ID NO: 672187 - DNA, 172 bp, Homo sapiens
actagcccctttttggggaaatacttttcctcctccctgtgttaactggggctgttggggacagggggtgatttttcagtgatttcctacagtgttgttccctccctcaagggtgggaggagataaacaccaacccaggaattttccataaatttttatttctttacctgga

SEQ ID NO: 672188 - DNA, 943 bp, Homo sapiens
aaactcgggagcagggtcttgaagaagtcgagccctaactgcgaagctcaccggtgtactggggcaagcgggagttcgtagatcacctggacaaagtggaccctgtagatggcgtggtgctgtgtggaccctgatctacctgaaggacgcgaaaagtgttggtgacccgtcaccatgcgacctctccgcgtagtgggcgtgaagaccgggatgtgctgggcgtgtgccttgcgcaaagacctggtgtcatcggccagctaccaggcgcgttcgtgcgcaggggcggcaggaagcggaggagcggagagacaaggaaggcgggtgaaggggtctgagcgggtactgagtggcccgcggcgtccgagggctggaaagggtgcacggtcacgcgtcataggggcagtcacatagtatcagcccaacgacgaggcagtgccgatcacgggcgtcgaaggcccggacgagaaagtgggagggaccaggtgagccggcgagactaattaggcgctggggtccggaatagggagtggccgattatccggcacgagggacccatcgaaggcgctcgcgggagacaagccatgagtgcgatggaccaggaggaccccaacggcgggggtcggcccgtcaaaagccgagactgtcgaagtgtgacgggatgccttgcaggaggccaagtacaggggccacacctgttccctgccggggctgaccggggcactctggccagctcgatgggggacgtaaccgaggcatcagggggtcggggagacaaaggaactgggggcccccgtggggcacgggcagcgtgggtgcagacctcgcaaggaagtgcgaacatcggcaaggctccccgcccaagagaggcgggggccgcccacaggcaggtgaaacagggcagggccttaggagaactccgcaccacctgtcgccccttgattaa

SEQ ID NO: 672189 - DNA, 146 bp, Homo sapiens
cggccgggctggccccggagggggtgctgagctggctggcgggcgggcacggctgctgctcactgctaccgctcctccgccagacagcgggcaaatgtgctggcccatttctatggggtgaagctggatgggcaaggtgcccatgc

SEQ ID NO: 672190 - DNA, 123 bp, Homo sapiens
  misc_feature (27)..(27): n is a, c, g, or t
gtgggtaatttgtgaaccttggagatncagcgtagagctttggtattaaaactgcaggactaggagaaaaatcaactgcttgccagatgttgtttgctatgctaaggagttaaaggaaggctt

SEQ ID NO: 672191 - DNA, 355 bp, Homo sapiens
acaaaaaacaaaatctgaagaccagtacaatttaattatctcatgagattttatattcttgacaaggtcaagaattgatgtctctatataaaaagctaagggtattctctagatctgattctgtgtaagcagtatcaaaccaacttagaattttacaattatgaaagcagtttcacccttgtgggtcccaggagcctctgggaccaggcagaatcatggaagggttaagggttacagttcaggggctgagggtgagtctatcatccactattccaaaagtttagttaaatgacctcaaagtatttctagagttttcctagtgaccctgcctcgtaaagctggggtcccgagctcg

SEQ ID NO: 672192 - DNA, 842 bp, Homo sapiens
ttcccccaaggctcagaataatttccggggcgcgtttgttcccccacgtttcccaacaagaccggttgaaaccattacaccattgtgtccgaaaaacagttaaccaatgtgccggattgttggttccctcacaagtttgaacttgtgttttcctccccgcccagttccccctctctggctaaaaagaccaccattggccccttaaatccttgcaagaaatgtgcccccctcttaaccccctgtacaaacggccgactaccacgggtcgctcccccataacaatataacggccgccaaattttacttgctttaccacgtaaaaaaagctgttgtcccaacggccccacccccccgcgagttttattctgttcttgccgtcaacaccccaaaaggatctttgtgctacatctcaccccacgcactgctgtgtccgtacacaaagttccactgcaccactcccccccaacctgggtctaagaaacactttattggctcgctcatccactgtggacactgtattcccccccccctttcagcatgcggacgaacaaatccatccgtcccttcctctcggttcacaaacagactgtatgcactccccctcttctctctggaccacagtagggcaccctgacttctaacagaaattgacctcttagcaaaaagtttataagtggctttttccggtgaacacgcgttaatcttctattcctccaaatggcccacaaccatttcagcacgttaaattttaagaacccgcctgttcattcatcataatgtgagccccaatactgggccgcctctccaaacaattcccttcaccccttcggcccccccccaca

SEQ ID NO: 672193 - DNA, 849 bp, Homo sapiens
  misc_feature (641)..(641): n is a, c, g, or t
tgcccgacgtccctttgggttcccctttttggggcccccccctggcccgggacaacagtttttacgccccggtactcttaccgggcccaaagtgggcaatcatcgacctgggttccctttattagggacctgtgatgaatgggccccacgagggggttcagctggtctcttacactttgagcccgctggcgatgtgaccctcgccccctgtgagaggcgggctctgtaccccgcccagtagcgggagagacccttttggagcgtttaaatattatttgatcgcccgaacccagtgtctcgcttcccacagacccccccagggtcgcgttgatacataccctaacacctggccattgtaaaaattccgggtgtgggggccgaccttcgggggccagagacacccccacctccgaccagccacgtactcatgcgtatagacattccacaccacgtccaagcgcggaacgtatctatacactccgattggatgcccattacattggcccacgcggaccagttacactagggagttaccagcgcgccgatccttatttttagagtgcacataatcgaaccatagggtgttacagacctcgatgttggatcaggacatacccgatgggcgcaccccgcttattaanaggtgtcgtttgttcgaacagatttaagtcctacgtgatctgagttctagacccggggttatcccggtcggtttttatttacttccaattcctccctgttcgaaaggacaagaagaataaggcctattctcccaagcgcctttccccgtaatgaaatcatttccacttagttttaaaccccccccccccccaggacagggttttttta

SEQ ID NO: 672194 - DNA, 972 bp, Homo sapiens
aatcccgccccttccttgtaaaaaacttagtgacaaaatagacaagttagcacatcttggctatgtaattcttgtaatatttatataggaagtgtcgaacgggaggtggcaagagtgtggaggcctgacgtgtgagggaggacaggcgggaggaggtgtgaggaggaggctcccgaggggaaggggcggtgtccacaccggggacaggccgcaggtccatgtccttattgcgctgctagcgtctgacttccaggcacgggtgggaaatattcacatcgcttctgtgtatctcttctcaccattgtatggctgctattggaggatcacgatgtacgtttaacaatgtcatatactgccatgtactagttgtagttgaactcttagacccatgtgtattacagatgcctattaacgtgtagtattgcatcacctacacacactgtgatcacagtgtatcgacctcaaggtgattactgctcctattccaaaacaggtggatgtaacacacacataccgtcatgcttcagttcagccatggtggacccagcggggccaggttctgccgtagcatgggcggcgagacacgcagggacgcgaacccaacaacaaggctggcagggggcaggcccgaagcacgagatgcgtgaacaaccggggccgggtgtcccagaacaaccagggctggagtcccctcacgatccaccccggcgcctgtggaatgctgggccttcacactggatcggggggcgaaaacacagcaaatcaaacaggcgggataacacgtggcataagcatgagacgcggcacataacacacagacccaccatcaccgcgtgcttcagggaccaccgggaggcccgaaggaccaacccgggaatcatggcaaacgcacgacacaggcacagcagaggacgcaacaccggcaccaacacagaacgcgaaacggcagacacaccacaaggcaacgaaaat

SEQ ID NO: 672195 - DNA, 188 bp, Homo sapiens
  misc_feature (62)..(62): n is a, c, g, or t
  misc_feature (128)..(128): n is a, c, g, or t
  misc_feature (136)..(136): n is a, c, g, or t
  misc_feature (141)..(141): n is a, c, g, or t
agctaatgcgagctgactgcattaggactgtgagctctgagcttcgatgccgattggctgantactcagtctactgcatggtcccctacgttttgcactgtgcaagtgggacgcatagtgcttacatntctttgcntggantgttccaatatttctgtcggccgctataacaaggcggggccgtgcga

SEQ ID NO: 672196 - DNA, 182 bp, Homo sapiens
ccccgatgcacagcctgctgccaaaaccacagctcactgccgcctccatagcccccagctgatcccccggacacaaacctgagttgaacatggtagagacaccactggcctcctacccagctggcaaggagccaccccctgaaaccacctaccatagcgtggcagatggagctactgcagtg

SEQ ID NO: 672197 - DNA, 133 bp, Homo sapiens
gatcttgcaggtaacacacagcgaaacgaaggtactgacccgtattggttttaaaaccttcacgaatgagatcggcgggcgatgcgccgggctcacagcggaagacgacggcggacgtggcgtgcatttgtcc

SEQ ID NO: 672198 - DNA, 612 bp, Homo sapiens
  misc_feature (10)..(10): n is a, c, g, or t
  misc_feature (79)..(79): n is a, c, g, or t
  misc_feature (290)..(291): n is a, c, g, or t
  misc_feature (300)..(300): n is a, c, g, or t
  misc_feature (308)..(308): n is a, c, g, or t
  misc_feature (313)..(313): n is a, c, g, or t
  misc_feature (315)..(315): n is a, c, g, or t
  misc_feature (319)..(320): n is a, c, g, or t
  misc_feature (322)..(322): n is a, c, g, or t
  misc_feature (327)..(328): n is a, c, g, or t
  misc_feature (331)..(331): n is a, c, g, or t
  misc_feature (340)..(340): n is a, c, g, or t
  misc_feature (358)..(358): n is a, c, g, or t
  misc_feature (360)..(360): n is a, c, g, or t
  misc_feature (376)..(376): n is a, c, g, or t
  misc_feature (414)..(418): n is a, c, g, or t
  misc_feature (429)..(429): n is a, c, g, or t
  misc_feature (434)..(434): n is a, c, g, or t
  misc_feature (442)..(442): n is a, c, g, or t
  misc_feature (500)..(500): n is a, c, g, or t
  misc_feature (505)..(505): n is a, c, g, or t
  misc_feature (511)..(511): n is a, c, g, or t
  misc_feature (514)..(514): n is a, c, g, or t
  misc_feature (516)..(516): n is a, c, g, or t
  misc_feature (547)..(548): n is a, c, g, or t
  misc_feature (550)..(551): n is a, c, g, or t
  misc_feature (600)..(600): n is a, c, g, or t
attgttcttngatctttccatcagcccttatagtgcccaacaaggctttgtgctgtctgacgacattatacaaaaaaanattctcaaactttttaatctttctgggctccattttatcaatatatccccttacacccgcatatataacaaccactttttcttcaataaccataaaaaaatactatcctttcttcatcaactcaattaaacgcacaccacaactcaaaaattattaaataacaacatcaaaatcaaaaccaaactaaacaaaaacaacaacctcacaatannaaaaaaatnccaacttnataananctannanctacnncanaaccctaanttaaacaacaaatccaananaaaaaaaaaaaaaaanaacattaattacaaaacaaatacctttaataaaaaaannnnntttccaaaaanatctntccgtcantgatggaaatgacatttgttggaatgtaaacagacacatcaccagcctgtgtttctanaactngcaaancantnaaagagccaccaccaaaaacatcgttcattnnanntgctctctccagcaaccgggagtgtaggtagaacacatcaccaggatangcctcacgacca

SEQ ID NO: 672199 - DNA, 284 bp, Homo sapiens
  misc_feature (46)..(46): n is a, c, g, or t
  misc_feature (87)..(87): n is a, c, g, or t
  misc_feature (169)..(169): n is a, c, g, or t
  misc_feature (184)..(184): n is a, c, g, or t
  misc_feature (204)..(204): n is a, c, g, or t
gtgatctagaggatctctgtggctactgctggagactgggggtganccagtcccgaaggcactactggcagtcctacaaacagtatnctcagagataccatcagagaacaaacactaatgttaatttggccaattgagtgcttcatgcctttatgatgtacaggcttgncagagaagattcccngagagtaaatcatctttccnatccagaggaacaaagccttgtctactctacccaaggggggtaaccggagtctcggaacattacggtacattcatggggt

SEQ ID NO: 672200 - DNA, 311 bp, Homo sapiens
  misc_feature (196)..(196): n is a, c, g, or t
gctgcaaggcttaattccagatggatgatgttgtacacagttagagttctgactaatgttgtcttgcaagagggaattgaattaggcaacatggtttgtcataattttggaccactggacatctgtgagggttggcattcaggtgttgtggatgactctttcctaataaaccaaaatatatctcaccgactgcagncatgtgtagatatgtaccaggacatggaagggatgatcaggggcaggctttggtttgggagagttgggctgtgggagtgagtagatgtggtgtggtgggatttcaaggtcccagt

SEQ ID NO: 672201 - DNA, 395 bp, Homo sapiens
  misc_feature (1)..(1): n is a, c, g, or t
  misc_feature (7)..(8): n is a, c, g, or t
  misc_feature (46)..(46): n is a, c, g, or t
  misc_feature (87)..(87): n is a, c, g, or t
  misc_feature (93)..(93): n is a, c, g, or t
nttccgnncggaggccctaaatacttatcgccgcccgaccaccccnccacctcgcattttttaaaataccagcggccccccccccgncataancgcagatcaacctgaactctacgcctcctacgtacctgccatgtcttactactttaccgcatgatgttctttaagaactttccaaaactttcttcaccaatctcatgacagaggaacatccgagaaactataagctgcaaaccaacagggcccgatcttccttaacaatcaaaaacagactcgatactctagagcgtctgaaccaacgacagtcattacattgcaaaaaagtcaacatcactactgcacccccaaactgccactgaccaacaaattgctcccaccctaccaacttcccagac

SEQ ID NO: 672202 - DNA, 365 bp, Homo sapiens
catgcagcttggctgtgttccacgcaggatcaggtagaatttagcatcttccatttatttgttgtcacccttataaaccaccagatctgtgcctcccatcctgcagagttggtgcctatccgggtttcatcagtcttcatcgaaggccacccacatatgctcgcctccgattttatcttctgcgtttcctgaagatgacctgttgtcggaagcgtaaatcttatatgaacagcgtgtgacttcttctcatagcaataggataccttgaccagtctcataccaacagggctgcttgacttggtaatagactactgatttgtattctgaaatgccttcatatccagcaccagggtgaattgctttct

SEQ ID NO: 672203 - DNA, 332 bp, Homo sapiens
  misc_feature (332)..(332): n is a, c, g, or t
acttgggaggctgagttgggaggatcgctggagcccaggagtttgaggctgaccaagccatgactgcacctccacactccagcctgagacagagtgagaccctatctcttaaaaaaaaaaaaaaaaaaaaaaaaaaaaaaaaaaaaaaaaaaaaaaaaaaaaaaaaaaaaaaattgttggggcgcgggcacgcccgggcccgcaaaaaaccgtcttttcaaacactactgtggggggcgcgcgggggccccagtagagagagacacggggatactacggttgtccccgagggacactggggacaaaacagggggggagttctccaatataan

SEQ ID NO: 672204 - DNA, 573 bp, Homo sapiens
agaaggtttgtgttcccgacgccttggatagttggcatagtgctaaatgaaaagtggatctcagccccgaggaagggtcaccctcctagagatagctactacccctgtctcagtgagaccctgtgtatttctagatgcactgcttatgctttcaccaagacccaatggatgtgtgacatgtgatgtgatgccccctgcacatgtgacctaaagaatgctgtgaccatgaatgatgtgtgatcgctggaacatgcatgcatgtgcatggatcctgggtcctggatgacccctccgatgtggcttgcccctgaagatggggcttgtgccttgcgtcgtgaagttgatgtgaatgatggaacgacagaggactgaagacttgttgcgatcttggcccatgtgtacttgtgcctaatctcctccgtcacgaagtgccaaatgtgatggtatggttgcagtgtgatgtgatgtgttgcatgcaacattttacaattgcattcatggccctcttgtgactcatgatgtgaaatgagatatgaccatggagcttggggatgggacggtcttgggggatcg

SEQ ID NO: 672205 - DNA, 410 bp, Homo sapiens
gtccaggactgctgagacacatggtgatccccatctcttaaaaatataaaaatagctgggcatggtggcaggtgcctgtaatcccagctactcaggaggctgaggcacgagagtcgcttgaacccgggaggtggaggttacagtaagctgagatcttcccactgcactccagcctgagcgacagagtgagactccatctcaaaaaaaaaaaaaaaggggggattttaagcggggctatgatggatatgcgcttgtattgccacctaatcgaggtggttgaggtggaaggatctattggacccaaggatttggaggtggagtgagagtatgatggagcttgagaaacagattgagaccttgtttctcaaaaattgtgggaatttgtctcaggaagcttggggggatcttct

SEQ ID NO: 672206 - DNA, 1085 bp, Homo sapiens
ggaggctgggcggacagtgcgacattgacctgcggcagggagcagaggagcgagatgcagcaatgaaccacagccagcagcaatgtcagcgtaagtggaaacctcatgagggtgggtagacgagtcagaaaaaaagaactctggggcccgtagaaaaggagaaccaaatgaggtgagcgatgggggctggctgcgctgaatcaggtgggcccagcacctgtcgttgctcagcacacctggtttttgtcttgttggcagcactggggagtggccatgggccatgagctctggacccctgggtgcctgcttggccctgcagggaccgcatacagcttcggctgcttagaactactccccactggtccattgtctacatccaaggagtgcagggcaggtgctcctgggagtgctgataggacttcgactggtagttatccgttaagacgctttttaacaaagcttgtgcgtttcgctcatctgggctgagaaagggtaaacgcagggcaaagagtggctctggttcaggtcttataccagataagagactgcagggccaagccgtttacgtttacgcgtgaatagcggcacagcgtcatgcgtaaaccgtgaggcttaccaggccctgttctgcaatccataagagctctcaatagcgcgtggtcgagttggcccaaggcgaaccacgagcgcagagtgcgccatttgacacaaagtagagtacggcgtacacgtaagcatagaagatctggaatccatgccaagcgagccatttggcgcttgacgctctcagcggacgagcataagagtacgaacgggataaagaaggtacaggacctcgggcggagcaagtaggcccgatgaacgccaattgtcaattagaggcggagcacacaatctattagcagatccaggacatcaccatgcactagaacacgtgggcacctacgcgatagtcgcgcaccccagcgcggtccactaacggggccccagcatgaccacgagagaggtatgagagaaacgaaggtagatagcgcgcgcgcacccacaccagaattgatgaagcgcacagcgctaagtggccactg

SEQ ID NO: 672207 - DNA, 282 bp, Homo sapiens
aagctccgtaccttggaggctgcagtgcagtggtacaatcttgattcactgaaatctccacctcccaggttcaagcgattctcatgtctcagcccctggagtagctgggtgtataggcatgtgccatcattcccacctaatttttttttttgtatttttgggtagaagaattgggttttcaccattgtttggccgtggcttggttctcaaatttccgtgcccttcaaggtgtgactctggccccaaccttcgggccttccccaaaggtgcgtgggaattcac

SEQ ID NO: 672208 - DNA, 300 bp, Homo sapiens
  misc_feature (161)..(161): n is a, c, g, or t
cacctagtatttcagcacggactacagagcgagactctatcttaaaaaaaaaaaaaaaaaaagtaacttaggtgcagggtgtcctctgttattcactgagaaccgtgccccggttatgaggttgtaccagaaaggcaagtatttcactattgcacactaantcacctgctcaccctaagcattgacagccgagcctgtagccttgaaaggcctttgtgctttgacgggcaggttcttctccccaaaattgcagaccacgaccggtgcatggaaattgctgacccccgtgcgtggaaattg

SEQ ID NO: 672209 - DNA, 284 bp, Homo sapiens
ccgcccagtgtagctggcccatcgcatttgtcgttatagatactgtatgctagccgggcatcgtgtggatctcatcgcgatgggtcctaacacatattgtctgagcggctgaatatgaatagatacagtagaggcgctcctgctatatgatttggatccatgcgtcagttccacccagccacgggtagcatcctaatacgataaacgccagaagctagagcggcagcgaggctgtgagtggggcgtcgacgcgggtacggggtgccgagctcgaatccgggatc

SEQ ID NO: 672210 - DNA, 914 bp, Homo sapiens
tgcaggctgaaaaaatggcgccacccagtacccgggagccagggtcctgtcggcgacagcgcaacaaatccgacggagagatggtgctgccaggttcccggacgccgacagcttggtgaagttggctctgtgggtccgtggtggcagtcaccaaggcatctgggggcctaccacagttggcgatgagtatgatttttaccgaagttttcctggcttccaagcatttggcgaaacacagggagacaggttgcttcagtgcatgagcaagagtaatgcagtaccattgggtgtcgcagaaacattaaggatcgaagtaaaagtgacgtgagtgggaaagacaagttgtgatttactagtggatgccaattgatgtaattctggagagagggggtattttactggatgaagcctcaggtgtaaaaagaatcaaagctgtctcccctgcggatggaggtccccaaaagggtagtgtccagctggaacgtaaggcagagacatatggcaaaaaagcaaaatctgaactttccggctggttcatggcaaaaaatatcatcgacctcagctcaagttcgacgagacagattggcacttccacacacattttttcctaaatttttattaaaccaatgttcaagaactgtaccataagttgtttagggaagggggaccgccacaggatcgctgaagattggaggtccccggcggggaatatcatagagaagaccacggtgtgcgactgttggatcttttaaattgcaaaaactatcacggaggggggtcaggcaacccgtttagatatgaagacagcttataccggaaagcagagcaccgagagatggagatgtagagggccaataagcggaggcgacaatcaacagacacattctgagtttaataccctggagacattagta

SEQ ID NO: 672211 - DNA, 374 bp, Homo sapiens
ttagccactaaatttaacactaggccgggcatagtggctcacgcctgtaatcccagcactttgggaggccgaggcaggtgaatcacctgaggtcaggagttcgagaccagcctggcaaacacagtgaaaccccatgtctactaaaaatacaaaaattagccgggtgtggtggcaggcgcctgtagtccctactcgggaggctgaggcaggagaattgcttgaacctggggaggcggaggttgcagtgagctaagatcatgccattgcactccagcctggataacaggcgcgaatctccatctcaaaaaaaaaaaatttacacctaaaaatagttaaccggtaaatttcactttctgtatatattttactgctat

SEQ ID NO: 672212 - DNA, 525 bp, Homo sapiens
caggcccctgccctactgctggggctcagccgaccgctccgtcctccgcctggccaccgcgactccggccacgcacgtgtccacagatgtccggtgaactcccacgtgtgcgtcccacacgggtcggcctttcttccttgggctcgggccccggacacccaccctcggggacacgtatgtgcggggagcgcgcccggaaccgtcggggccgagcacggcgtctcacgccagagcagccgcggatcggagcatccgctggtccaggaccccccctcccgcccgcaggcacgttgttcgggcagctgtcaccatccctcggccgacgcagcacctctcgacccccgcagcccggaccgcgttcggatgggcgcagcagaagggagccgccgggcagacactcaccacgctcgccgacgccgaccgcgctcgcctgcccgccccagcgctcggccagcacctaggcggggagggcgcgtaccgcatcaggagccagcagcgacgcttccagccctcggggctcctacc

SEQ ID NO: 672213 - DNA, 670 bp, Homo sapiens
  misc_feature (16)..(16): n is a, c, g, or t
  misc_feature (19)..(19): n is a, c, g, or t
  misc_feature (63)..(63): n is a, c, g, or t
  misc_feature (90)..(90): n is a, c, g, or t
  misc_feature (94)..(94): n is a, c, g, or t
  misc_feature (96)..(96): n is a, c, g, or t
  misc_feature (109)..(109): n is a, c, g, or t
  misc_feature (111)..(111): n is a, c, g, or t
  misc_feature (113)..(113): n is a, c, g, or t
  misc_feature (126)..(126): n is a, c, g, or t
  misc_feature (131)..(131): n is a, c, g, or t
  misc_feature (169)..(169): n is a, c, g, or t
  misc_feature (174)..(174): n is a, c, g, or t
  misc_feature (184)..(184): n is a, c, g, or t
  misc_feature (192)..(192): n is a, c, g, or t
  misc_feature (197)..(197): n is a, c, g, or t
  misc_feature (199)..(199): n is a, c, g, or t
  misc_feature (208)..(208): n is a, c, g, or t
  misc_feature (213)..(213): n is a, c, g, or t
  misc_feature (215)..(215): n is a, c, g, or t
  misc_feature (217)..(217): n is a, c, g, or t
  misc_feature (221)..(221): n is a, c, g, or t
  misc_feature (225)..(225): n is a, c, g, or t
  misc_feature (227)..(227): n is a, c, g, or t
  misc_feature (242)..(242): n is a, c, g, or t
  misc_feature (248)..(248): n is a, c, g, or t
  misc_feature (254)..(254): n is a, c, g, or t
  misc_feature (257)..(258): n is a, c, g, or t
  misc_feature (263)..(263): n is a, c, g, or t
  misc_feature (278)..(279): n is a, c, g, or t
  misc_feature (284)..(284): n is a, c, g, or t
  misc_feature (301)..(301): n is a, c, g, or t
  misc_feature (305)..(305): n is a, c, g, or t
  misc_feature (308)..(308): n is a, c, g, or t
  misc_feature (310)..(311): n is a, c, g, or t
  misc_feature (317)..(317): n is a, c, g, or t
  misc_feature (320)..(320): n is a, c, g, or t
  misc_feature (328)..(329): n is a, c, g, or t
  misc_feature (332)..(332): n is a, c, g, or t
  misc_feature (341)..(342): n is a, c, g, or t
  misc_feature (351)..(352): n is a, c, g, or t
  misc_feature (356)..(356): n is a, c, g, or t
  misc_feature (358)..(358): n is a, c, g, or t
  misc_feature (366)..(366): n is a, c, g, or t
  misc_feature (370)..(370): n is a, c, g, or t
  misc_feature (374)..(376): n is a, c, g, or t
  misc_feature (406)..(408): n is a, c, g, or t
  misc_feature (418)..(419): n is a, c, g, or t
  misc_feature (429)..(429): n is a, c, g, or t
  misc_feature (437)..(437): n is a, c, g, or t
  misc_feature (440)..(440): n is a, c, g, or t
  misc_feature (449)..(449): n is a, c, g, or t
  misc_feature (471)..(471): n is a, c, g, or t
  misc_feature (495)..(495): n is a, c, g, or t
  misc_feature (543)..(543): n is a, c, g, or t
  misc_feature (610)..(610): n is a, c, g, or t
  misc_feature (666)..(666): n is a, c, g, or t
taccttctcgaaacanaanattttcctacctgcttatacttggtaaccgagggaatttctaanacttcttgctcatttctgagttttgtntttntntcctgacactatnantnctacttggttgcntcttnagggtctcttctgctgggtccccatgatttgtggctgntgttntgcacaaacnagtttctncagtnanaggagttcnttctnangnagcnattncntcttcttttgctgantctctnctaggntgnnttctnttgttttcaccactnntcttnagttcacctcactgagntctnttntnngcttanttnctcttttnntcnttgtttttnngcttcttgnngatngncttcatcngctncgtnnnttttttctcctggttctccctttttctatnnncgcggcattnntattggactngctcggcntcnattccctcngctacagattctggcacttttnggctacttgtgccacttctggatntgggcttttcgaaggcctgatctggctcgccaactcagttctagaacntagatctgatcagaaggatctattctttgtgccttgtggccacatcagctagcctctgctgtgtgcncgtgtacgtgtgttctgggagtggaggcagctttctcacagtgccttatccatgcnataa

SEQ ID NO: 672214 - DNA, 226 bp, Homo sapiens
agaggaggccagcttactagggggctccccatagatggggggacacgaggaataagcagtagcggggagaaacaggtgagtcatcttggtgagaagaggcaggtcctagaagtgccttgaggcttgcctaagtcctggcctgggcaggagtctggcggagcctctgaggtgacgagaccacctggctgggtgaatgtccagagggggggcagctcgcccctgagtt

SEQ ID NO: 672215 - DNA, 184 bp, Homo sapiens
agcattactctctcaggactaatttttctgttactttatctccttcgggtactcccattatgcatactctgggtgtgcttactagtgccccacataatgtcacggccctgttttcttaattcttccttccctcggatcctttagaaatgttacactctctatcaacctactcggctgagtcttg

SEQ ID NO: 672216 - DNA, 190 bp, Homo sapiens
acgagcttggtgggagccgtgcggttctcaggagtatgtacgccaacaacctggtgtatgacacctcgagacgagcgatgactatcacctcctaaatggacctagaggaaggcagtccaacgcgctgatggtcaggctgcaagactggtagcctgccgtaactgagcacgatcctcaagcaagacctaac

SEQ ID NO: 672217 - DNA, 138 bp, Homo sapiens
gtgcgttgcagcatcactgaggtctgggagtctgagacagcctgaccatcatggagaaacccgcatctctattaaaaattgcaaattggctgggcgtgctgctgggcacctgtgatcccatgctactctgtggagtgc

SEQ ID NO: 672218 - DNA, 790 bp, Homo sapiens
  misc_feature (35)..(35): n is a, c, g, or t
cacaccaccgcgccgatgaagcatcgtaatatgtngtgactcgagtatttaatgttacgtaagtacgcacgaaccagagacacgataacgtgacagtgctatcatatagtaaaacccagcccatgacccctaacaggggccctctcagacctcctaatgacctccggcctagccatgtgatttcactttcactccataacgctcctcatactaggcctactaaccaacacactaaccatataccaatgatggcgcgatgtaacgcgagaaagcacataccaagggcaccacacaccacctgtgcaaaaagggcttcgatacgggataatcctatttaatacctcagaaggttttttcttcgcaggaattttctgagccttttaccactccagactagcccctaacccccaattaggagggcactggcccccaacaggcatcaacccgctaaataccctagaagagccactcctaaacaacatacgattactcgcatcaggagtaataatcacctgagctcaccatagtctaatagaaaacaacccgaacccaataatttaaggactgcgtaatacaaatttaatggggccctaaattacccctctacaaagcctagagagaacttggggtccccttaacactttcgacgggatatacgggttaaaaatttttggaggcacagaggttcaacggagcctaagggattataggcgtaaaatttctcacaatatggggtaaacccgcaactcaatatttaatttacaaccccccttgggttctgcgccggccc

SEQ ID NO: 672219 - DNA, 626 bp, Homo sapiens
  misc_feature (51)..(51): n is a, c, g, or t
  misc_feature (60)..(60): n is a, c, g, or t
  misc_feature (178)..(178): n is a, c, g, or t
ccagctaacctgcccaggacttaacgactcgctccaggtgccgaaaggctnacagagcantacagggaactgctgcagtctttccagtcgaaagatgctcaacacctcattccctgctggagcaagctgaacgaccagttcaaactgggtttcccagttggctaaccttcacacaggncgaagacaagtacttaccttcgggtctccaccgtgaccacccattcctctgactcagaggtcccctcccgtgtcactgaggtggtggtgaagctgtttgactctgaccccatcacagtggtgttaccagaagaagtctctaaggataaccctaagtttatggacacagtggcggagaaggcgctacaggaataccgcaggaaaagccgtgcggaatgagatagaagcatcaccttcctatatgtaggagtgtctgggagggaatctcccagctccccgaggtggctgcagacccctagagaactccacatgtctccaggcgagtaggcctcacccaagcagcctgcccttcctctggattctgtacactaatgcctgcacttgctgctctcgggaagaactgattcccccacgcaactaatccaataaaagccccttgcgatacgtga

SEQ ID NO: 672220 - DNA, 631 bp, Homo sapiens
  misc_feature (333)..(333): n is a, c, g, or t
  misc_feature (359)..(359): n is a, c, g, or t
  misc_feature (399)..(399): n is a, c, g, or t
  misc_feature (457)..(457): n is a, c, g, or t
atgttcccgtcttcactgaagagttcttggaccaagacaaagcgcgtgaggcggagcttgggcgcgtgtgcggaagagtgaatggtggccttcgaggagcagaacgcggtactgcagaggcacacgcagagcgagtgagcagcgcagcgcgagcagtctggagcaggagctggcgctggaggagcggaggacgcgtggcagctgagagcaaggcagcgtcccagtgccggatgcggccaagggctgctcgaccgtgcacaaggatatcggcctatctagcttggccgggttgccgtggtgcacgaggggcggataaacggcgcgcagcttgcnttgggggcagctctcatgtggggganccctgtcgataaacatcttgtggcccccgtgggtactttnctctaacggtgtgaggtcccaattcggaagacgaccgaaacgcactcggtcctcaagncaggcaggagacatggcttcactcggttcactgtctattcagtaggtaaaactcgcctgggaccgcaggggtcagtccgagcgaatgtcactcttggtggagggaggttgcggcgttgggccccacggatggcagaagggagcaaagacttgttgagagcggtcggaccccttt

SEQ ID NO: 672221 - DNA, 970 bp, Homo sapiens
atggcacatgcggcgcaagtaggtctacaagacgctactgccccgtatcatagaaagagcttatcaacctttcaggatcacgccctcactgaatcgaatttgccttggtctgctgtcctagtcctgtatgcccttttcccataaacactcatgaatgaaaatcctaaggtaactactaatgatctcagacgctcaggacctacaaaccggtctgaactatcctgcccgccatcatcctaggtcctcatcggccctcccatgccctacgcgtcctttagataaacagacgaggtcaacggagtcccgtcccttaggcaatcaagatctattggacgagcatcatggtactgaaacctacgagatacgacccgaggttaggcggactagatcctgcaatcgtcctagcattacttgcctcacgcattattcctaggaaagccaggcgagcggcgagtccttggacgtggacgaatgcgaggtgaggcactgccccgattgaagcccccatgtcgtgatatatagtttacatcacaagacgtgttgcatctcatgaagctgggccccactattaggttaaaataaacagatgcaattcccggaagttacagctaaacactattatcgtacacgaccgggggtagactacggtcaaatgcgctgactttggggagcaacgcagagtagatgccaacgtctggagtaatcccctagaatctctgaatgggcccgtgggacctatagaaccgtctacgctgtagagcaggaacaaacatccaaagaacttgggccgggcggcctagacggtctaacctgggtgcgggccaggggaggaagccgccggccaagaccgcggcagggggtcaccaaaaccgccgacactcttgaaccaacgggggaccggacaaagccagcaaacccgggggaaaacaaacaaacacccgagaaacagaacaaacacttcaggagacaa

SEQ ID NO: 672222 - DNA, 183 bp, Homo sapiens
tcgatgtgatgatgcaaggctgactaaatgcacggccttcctcccatcaggagtttctttagttagagcacaattatcccaatgtatccttaatattgcctagcagtcttcttgagcattccccaaccctaccatcactagagaacttatttcccacctgctgctcctccgggccattcaacg

SEQ ID NO: 672223 - DNA, 140 bp, Homo sapiens
ctctatgaggatccccccgccgtaccacgttgctgcaactgcatcggacagcgagcttgatgcggcagaaggggctggtgtgagtgacactgctgatgtgcagctggtggcagtgtggacggaggagatcctggcgctga

SEQ ID NO: 672224 - DNA, 613 bp, Homo sapiens
  misc_feature (503)..(503): n is a, c, g, or t
  misc_feature (506)..(506): n is a, c, g, or t
  misc_feature (549)..(549): n is a, c, g, or t
  misc_feature (567)..(567): n is a, c, g, or t
  misc_feature (595)..(595): n is a, c, g, or t
  misc_feature (609)..(609): n is a, c, g, or t
caggaaagtacctgtgcagatgctggcacttaaggcctatggagaaaacatcaggtgttatagagagtctgttgtagggaattaacgaaaagaccactgagttaagtcaaagaatggtctatttgagtttaggtggtctggtttatggggaccctggctaaggagcatactccaaattcttggtgttaaccctctcagtagtcataagaatagtctccctggtgcactgtattctctcaaaggttttaaatgtttgcatgaagccatctttagaacgtcagatggtctctcttcaactggaatgacaagagctgaaagaaatgtgtgaccacgaggacaccgaaaccgatgagtgacatgctgagactggaaatccaaaatgatagtaacggagagtggcgctaacatcctaagttttggtcacactcttgcctaagtgacaacctgacaaagggggaattttttaaactgatgggaggccatttgtttggactgagcactangtnccaacagaccccgaacccacatgggtcctagaatagaccaggnttttgttttctcttgcanacagggactttcagcataaggtggtatnctcctcgtccttgntccc

SEQ ID NO: 672225 - DNA, 1379 bp, Homo sapiens
gtaactcacgcgtccgctcggacagtcggtcggagtggtttcctgcttcaacaggtgctatggactggaatcctggcgctcgttcgctcgacacactagagacgggacgctgccgctattagcagagccacttctcgttgctagccctctatcaaccagtaaccacgtcgtgagctgcctcgctagagggaccgcccagtacgaacagttccaagatgccctgcggctaggcctacacagaactgtcggtcacgacactggccattcatcgcatttaagatcagctctgacacaattagtatctgtaccacaacagtttccaatacatactggcaatagatgacggtccaaagaaaagcgtatcacaatctctacggaatctttccaccgatgggcctctgacactagtttcaaaacacagacgcaaagtacttctataacgctttgaggtacgtctttctttatctgtcgcgttacacctaagccgtttgtattaaccccattgctttctcaagatagttgctttgttcaaaccttcagccttatgtttgtcatcaccaggcaggcacctgcgacttgactaggagggcattttattgtcatattgaaaacacccgtcttatatgacaccaacaaccaaagtatacgtataatattcccattttccaaggcaccaaggagaaatcctatcttaggttggtaaggcaggacgcgtcagcgtggccaataatcctaggattggtcatatttggtaagtgtaacacaagacggtggcgacattggaatgcgcccctttgtcttgatgtaaaaacccttatacgctgggaacgacgaccttgggtgcaccgtaaaagctactttttcaccttcttgcagcaggcactttaggtttcacaccgcaacaacatacaccatggcattccatagcgtggaacttgaattgcttggcgccgctacagcaacggaccgcgacgttccttggaggcatttgcctcggaacctggcgccaatgcgcattgccttgggccaagcttatagcacacccttcttccgggcgaccaccttaccgagacaacttggttttgcacacatttttccgagccgacttctagtcacataaacgcgcataggacccaacacccttgtgaccggcatatatagcaccaacccgttggagataccctacacccgtttgcgaacgcacaatagtacgaaatagaccgtgtgtatacgaaccaccacttgtccaaagcaatcgatggacattgtgctttggcaaacaatatcttacaacttttgtgtgaccaccgtaaaagccgacactacaaatgtttatactaccctcggtgtggctaacacgtttggtaggtgccccacag

SEQ ID NO: 672226 - DNA, 171 bp, Homo sapiens
tccgtctgagcaagctgggaatgcagtccacctttattgggcgaaactcagtgtaactgttttaaataactcgtgcctgcccacccagtgcccggggggtcagacgatcatctccagctgcctgggcatactcgatgacctgtttggccagttctgtggcgagcctggtgg

SEQ ID NO: 672227 - DNA, 251 bp, Homo sapiens
cgataaacaggcgagaaggattgtcagagaacagtgcctatcgctggagcgttgtgacatcagaggagggaaggccagctctggagccgctcccgtcagggcatccagggagtctctaatgtactctgtcccctggggatttagaggaagtagtccagatggaacctgaagatgctacagaggaaagtcagtggatttctttgagctaggagaataagagtctggagactgggagccttcacttcggcctc

SEQ ID NO: 672228 - DNA, 199 bp, Homo sapiens
  misc_feature (102)..(102): n is a, c, g, or t
ttcattaccgcaaataaagtatatggcgacagaaattgaaacctggcgcagtagatctagtaccgccagggacagatgaattaattataaccaagcattatnatagcacggactatccccgtataccttctcgcatatatgaattaactcatgaatcttactgttgcaagggagagccataagctgagtacccccgata

SEQ ID NO: 672229 - DNA, 318 bp, Homo sapiens
ttttttccgggggcctctttttttcggcttcctcctcaaaaagaagggggggggcaaaataatttttttttggggggggggggggggggggtttccccccccaaagggggtttttttcccccccggccccgggtcttttttttaacaccgggccccttgtttgttggggggcccccctttttttttttggggaagggggggaaaaccccccccccccccctttttggtttttggggtttttcggggcccccccccccccggccccccttttgggggggttttttttttttttttttaaaaccccggggggggttttta

SEQ ID NO: 672230 - DNA, 969 bp, Homo sapiens
gcttcgccgcggagctacgaggctctgctagcacccagataggacccagatcgcccaggcaccgcccgacgccccgacggccgtcatcctgcgccatcccagaggcagggagttcgagcatcccccgcgcgcggcacactcctcggcggccaggagcggggaaagcgaagtgcgagagaccccggaccaccagcgctagtctactatcccgaccgcccgaaccaccactgacccaccttcacaccacagggcccttcctaatgggctctacggccgacagtccaaccaacaaccactccgccttcccacccctaatgactcatcacccgccaccaaccaccgcatcctcccgccaacctcgccataccaaccaccctccaccccgccatgacgcccactccggacaccacaccctttcccaccgcctgcgcgccctctccccccgcgcactgcgcccatccactccccctccttgccccacacctcccactaaccccacccccaccgcctcacccagccccccaacgcgcccctacccgcccctcgaacccgcaacaccgcggttcaaactccgcaccgcctccccctccacaccctcgcccccccctcgccacccccctccccacaccctcccccccacacgccacaactccacctcctcgccccaccctccaacccccctcctaccacccctccacacaccaccccacccttacaacccttccccccccccccgccaccccccccccctcacccctcccccccccctcacactctttcccccaacacccccccccccccccccccccaccctccgccaccccccccccccccccccttcccccccccaccacaacaccccctcacccccaacccccccctccaggccacacttctcccccatactccctccccccaccggtccccccgcccaacccccccccctctacccccccccccccccccccc

SEQ ID NO: 672231 - DNA, 493 bp, Homo sapiens
atctttactcagtaagcagggtcctcattcggaagtcgtccctcctcgaaatgcccattacactggaattatgtttcacataatcagagctcaataaatatctgtggaaataagtgaagtctcctatccttatatgtaatgagtatttccttgcaaaaattaaaaaaaatgaagcagagtaatttaatcaagtgggaagtagaacatgctagacaatttaccaaatagggtggaaaagaaccttagaaatgatctacttcaatgctttataaaacatgatctagatgttcacagaagtaaagcgatttgccacattccaaataattggtagaaaaggaaggtctaaaatctgctcctccgacttttagtccagtgcttgttctatacatgctgtttccttacatttttgagaaatgacagggatgtgtactgacaagctcagtggattaataagtatagaatggatttccattaaaggagagaggagaaaatt

SEQ ID NO: 672232 - DNA, 635 bp, Homo sapiens
catggtggctcatgtctgtatccccaaccggctatttttgtatttagtagagatggggttcgcgtgtacaggatggtcaggagtcaaaacagctgagcacatggtgagaccatctctacaaaaaatacaaaaattagccaggcatggtggtacacattgtagtctagctactggaggctaggcaggaagatccttggcacaggagtgaggctgcgggactatgatgtgccatgcactccagctgggtgacaaagtgagacctgttccaaaatatactaataaagtaagtcatggtggctaaggtgcgaatgaacttggtatagaaaaacagaagagatacttaagttaatgcccagaggctacgtggaatgagtagatttcactgcagcctctgcctcccggatggcattctcctgctcggctcccgtgcggattacaggctgggtgccactgtagcagtatcgaggctgcgcgagatcataaccagagggagtgcggagcggatcggcactgatcagccggtgaacgtgaatcgctcaaatatatataaacgaccagtggagctgtttactcagttaaacaaccaattgttagtaacatgattttctaatgagatcccatcattccatttaaac

SEQ ID NO: 672233 - DNA, 902 bp, Homo sapiens
  misc_feature (52)..(52): n is a, c, g, or t
  misc_feature (91)..(91): n is a, c, g, or t
  misc_feature (110)..(111): n is a, c, g, or t
  misc_feature (113)..(113): n is a, c, g, or t
  misc_feature (116)..(116): n is a, c, g, or t
  misc_feature (119)..(119): n is a, c, g, or t
  misc_feature (131)..(131): n is a, c, g, or t
  misc_feature (136)..(136): n is a, c, g, or t
  misc_feature (184)..(185): n is a, c, g, or t
  misc_feature (198)..(198): n is a, c, g, or t
  misc_feature (216)..(216): n is a, c, g, or t
  misc_feature (234)..(234): n is a, c, g, or t
  misc_feature (242)..(242): n is a, c, g, or t
  misc_feature (246)..(246): n is a, c, g, or t
  misc_feature (250)..(250): n is a, c, g, or t
  misc_feature (253)..(253): n is a, c, g, or t
  misc_feature (274)..(274): n is a, c, g, or t
  misc_feature (282)..(282): n is a, c, g, or t
  misc_feature (289)..(289): n is a, c, g, or t
  misc_feature (293)..(294): n is a, c, g, or t
  misc_feature (298)..(298): n is a, c, g, or t
  misc_feature (320)..(321): n is a, c, g, or t
  misc_feature (329)..(329): n is a, c, g, or t
  misc_feature (337)..(337): n is a, c, g, or t
  misc_feature (344)..(344): n is a, c, g, or t
  misc_feature (349)..(349): n is a, c, g, or t
  misc_feature (352)..(353): n is a, c, g, or t
  misc_feature (360)..(361): n is a, c, g, or t
  misc_feature (364)..(364): n is a, c, g, or t
  misc_feature (366)..(366): n is a, c, g, or t
  misc_feature (370)..(370): n is a, c, g, or t
  misc_feature (377)..(377): n is a, c, g, or t
  misc_feature (380)..(380): n is a, c, g, or t
  misc_feature (384)..(384): n is a, c, g, or t
  misc_feature (386)..(386): n is a, c, g, or t
  misc_feature (391)..(391): n is a, c, g, or t
  misc_feature (399)..(399): n is a, c, g, or t
  misc_feature (418)..(419): n is a, c, g, or t
  misc_feature (425)..(425): n is a, c, g, or t
  misc_feature (430)..(430): n is a, c, g, or t
  misc_feature (432)..(433): n is a, c, g, or t
  misc_feature (436)..(436): n is a, c, g, or t
  misc_feature (438)..(438): n is a, c, g, or t
  misc_feature (442)..(442): n is a, c, g, or t
  misc_feature (445)..(445): n is a, c, g, or t
  misc_feature (447)..(448): n is a, c, g, or t
  misc_feature (452)..(452): n is a, c, g, or t
  misc_feature (462)..(462): n is a, c, g, or t
  misc_feature (474)..(474): n is a, c, g, or t
  misc_feature (478)..(478): n is a, c, g, or t
  misc_feature (486)..(487): n is a, c, g, or t
  misc_feature (490)..(490): n is a, c, g, or t
  misc_feature (495)..(496): n is a, c, g, or t
  misc_feature (505)..(505): n is a, c, g, or t
  misc_feature (508)..(508): n is a, c, g, or t
  misc_feature (514)..(514): n is a, c, g, or t
  misc_feature (523)..(523): n is a, c, g, or t
  misc_feature (534)..(535): n is a, c, g, or t
  misc_feature (548)..(549): n is a, c, g, or t
  misc_feature (557)..(557): n is a, c, g, or t
  misc_feature (559)..(560): n is a, c, g, or t
  misc_feature (562)..(562): n is a, c, g, or t
  misc_feature (564)..(564): n is a, c, g, or t
  misc_feature (573)..(573): n is a, c, g, or t
  misc_feature (627)..(627): n is a, c, g, or t
  misc_feature (629)..(629): n is a, c, g, or t
  misc_feature (631)..(631): n is a, c, g, or t
  misc_feature (693)..(694): n is a, c, g, or t
  misc_feature (707)..(707): n is a, c, g, or t
  misc_feature (759)..(759): n is a, c, g, or t
  misc_feature (813)..(813): n is a, c, g, or t
  misc_feature (868)..(868): n is a, c, g, or t
gggaaaatattacgggtacacttggaaaagacatgatcaccaagtgaaaacnatctaaccagaaagctttaccgtcggtcagtcaagccgnccccgaaatccggggggcnngncangcngcggggccaaangggangggtaattagtattcctctccttcttcctcaccctctccttcaacagnntccacaccacccnccccataatccttctcangggcagccatatcttcangggcctcngttntttngcnttcctccatcccctcacccangtaccagngaacaanggcnngctnggcatacatcaggtcaaacttnnggtccagnccggcccnggcctcngcaanggnnggggggnngcncngcangcacacngcnctcngnacctnggccaggnctccaccaggcaccacggnngggggnggggngnnggngncaanctngnngccngggggggggnaatccagaaagngggngggggggnnggntttgnngggggcaanggnggcgtngacatcttngggaaccaggnnaccagggtacaannggcagcgngnnangnatttaccanggggggggtcacatttcaccatctggttggctggctcaaagcaagcattggttntntntgctacagaaagctgttcatggtaggctttctcagcagagatgacaggggcatatgtggccnnttggaagtggatnttggggtagggcaccaggttggtctggaattctgtcaggtcaacattcaggnctccatcaaatctcagggaagcagtgatggaggacacaatctggctaataaggnggttaaggttagtgtaggttgggcgctcgatatcgaggtttctacgacagatgtnatagatggcctcattgtctaccatgaaggcacaa

SEQ ID NO: 672234 - DNA, 361 bp, Homo sapiens
cagtccaacatccggggtgacagtgagactgtatcaaaaaaaaaaaaaaaaaaaatatgggtggggcacgggggctcatacctgtaatcccagcatttgggaaggctgaggggggaaaatcagtggaggtccggagttcaagaccagccgcgtcactatgatgaacccctgtctccataagaaaatacgaaattaagcggggcgtaccgggtgtgcctgtagtcccagctactggggaggccacagcaggagaattcgtttgaacctgagatgtgggaaccacaatccgggttcagtcaaagatccgggggtagtgagtccgtgggtggaatccagaaaattactttcacctccatcatgc

SEQ ID NO: 672235 - DNA, 447 bp, Homo sapiens
  misc_feature (1)..(1): n is a, c, g, or t
  misc_feature (291)..(291): n is a, c, g, or t
  misc_feature (366)..(366): n is a, c, g, or t
ncactattttgttttatttgtcttattcatataagaaggcaggaatgtcaggcctctgagcccgaggcccaggccatcgcatcccctgtgacttgcacgtatacatccagatggcctgaagtaactgaagatccacaaaagaagtaaaaacagccttaactgatgacattccaacattgtgatttgttcctgccccaccctaactgataaatgtactttgtaatctcccccacccttaagaaggtcctttgtaattctccccacccttgagagtgtactttgtgagatccnacacctgcccaccagagaacaaaccccctttgactgtaattttccattaccttccctaatcctataaaacggccncaccccatctccctttgctgactctcttttcggactcagcccgcctgcacccaggtgaaataaacagccttgttgctcaca

SEQ ID NO: 672236 - DNA, 781 bp, Homo sapiens
  misc_feature (608)..(608): n is a, c, g, or t
tatattttttagtgggagaggtttagtctacagtttttatttttagtcaccaaactgtagccaactcttgggtcattttctctgaaaaacatttggagatcatgacagcgtttggattaaaacatttctgttactttgcatgcaaactagtttactgtgttcacagagtggccagtcatgggaccataagcaacacctgctctttgagtgtctttcataccgttaccatcagcaccagaaactccaggtgccccaagcttaaagtaaaaatcctaaagtacgttggctcctcccatgcaatgtgctgggtccaaaccatgctgttaaatatcagaagtttctatggttatgattaaaaaattaaatgacaataatagccccaaaactatatatttttgatactatttaaccaagattatcacaaagacacagtatttgacacattgttattcttctatgttttataaatattttaatgtgacaggtagaatctgtactttttctgtagaacgtaatattttgaagtatatatatagttaaattatttatttcttaggtaatttaattaatttatctcaccattggtcagacatgattggctcatgctntgtaatcccagcaattttgggaggcccgaggcagggcagatcacatgaggtccaggagttcgggaacagcctggcgacatggggaaaacctggttctcataaaaattcaataagcccgtgtggtgcccctgcctttaatccagtacctggggcaaagggaaaaggccaattgg

SEQ ID NO: 672237 - DNA, 258 bp, Homo sapiens
taataatgtttgcaaagtagtgagttttttaatgctgcaagcattgcagagtttatcagctagcatattattattaaaaactcaacaaaacacagtctttttttttgtcccatttaatatcataggggacttacctgtttctgcttaatattgaatgtgttataatccattactgtacttatatattttgatgatcaaaattgtcctagatatggctaatagaagcaccttcgagctgatttcttggtccttttgaca

SEQ ID NO: 672238 - DNA, 1622 bp, Homo sapiens
  misc_feature (309)..(309): n is a, c, g, or t
ttgtggggggtgcgtcgcccccaacagactgttgttggtgcctgcatcgccatcaccagcgcctgctccttttttttgatggttgcgcgctgctgcctctctttatctgctgaggagagtggacttgctctcgtctcgggagttcgactcagtacgccactttcgttggtgttgtcggtgtcccgatcattcttctctcctcctcgccgtttttgttttttgtgcccggctcgcgcgtggtgttttttgttgcccccccccgcccccatccgttcgtgtgtgtgggtgactttcttctgctctcttcgncctctctgtctgtgttcgatggtgtgtttgtgtcctccacgacgacattactcattggttctcgtccgctgtcttgtggtggtggtgttgtgcttcaccactcgccgactcgcgactctacccgatcattagtgagtgggtggttcttctcctctgcgttctgtgactcttcttcttgtgtgtgttttttgtcgtctccccctcttttgtttggtgtgttagtgcagacgattgcggtgttgtgttgctccgcgccgccacctactcggcgcgtgtcttgttgttttctattttagtgcggcggttcctttttctctgtgtgctgggagtgtggtctgcggcccccgcctctcctcttcttttttcttctctccagtgggctgtgcttcgtgtttgtattcttttcgtgtgcttttctctccccgctcgcgctcgcttgttctctttttccctcttctcgcgctccgcggctgctcgcgctctgtggtttgacacccctcgcctcctcttcgttttcgttgtctacgacgcaccgacgcgcctgctcggctctttcctcggcgcggcgttgcgctatctcatcatctagtagtcagcgagaagagagtagtcgtcgtctctctctcgtctctctccgcttctctggtgtgtgctgcctgctctctctctctgtggtgtgtgcgctccctctctcttgctcagcacacactctctctctctctgcgccctctcctctctgtgctgtgtgctgcgctgctctctctctctggtgtgtcgccgcgctctctctcttctctctctctgcagcacatatatatttttgtgtgtgcagcgcacccaccccgcgtcgcggtgtctcgcccgccgcgcgcgggcgcgccgcctcgcgtctgtgttgtgttcgccccccgcccgcgcgcgcggtgtgtgtgtgttgtcgctccccctacgacacacaccctcgttgttctctctccccgcgcgtgttgtttcttctccccgcctcctccctctccccacaagagtgtgtgtttatataagagagaggcgcgcgccctctctctctctctctctcagagatcccccgcgcgcgggtgtcgccccccccgccctctgctgctgctgtgtgtgtgtgtgtgtttttgatatcacacacacgtcgtctctctctctcctcgccccccgggcccgcccctctctctctctttttcttttgtggtggtggtgtgtgtgtggtgcggagagagagagacttcttttcttttgtgtgtgagagagagaacaagaatgtttctctctctcacacagagtga

SEQ ID NO: 672239 - DNA, 288 bp, Homo sapiens
ggaccggtttgacgtggctctgatcacactacagctaagaccctaactgggattagataccccactatgcttagccctatacctcaatcagttaaatcaacaaaactgctcgccaggactactacgagccacaacttcatactcaataggacctggtggagcttcatatccctctagaggagcctgttctgtaatcgataagccacggtcaacccacaagccacggtcaaccacaagccacggtcaacccacaagccacggtcaacccacaagccacggtcaacccac

SEQ ID NO: 672240 - DNA, 149 bp, Homo sapiens
ctgcccatgtttgctccttatgtattgtttattcctatgcacgattatttgtgtttcttcttacctgtcctccatagtgtgctctagggtttgtgacgttagcaatgctgctggcttgaagtttgttagtctaggaggccagtgggact

SEQ ID NO: 672241 - DNA, 394 bp, Homo sapiens
  misc_feature (1)..(1): n is a, c, g, or t
  misc_feature (387)..(387): n is a, c, g, or t
  misc_feature (393)..(393): n is a, c, g, or t
natcataatggtggaatgtcatcagttaaggcaggaactggctatttcacttcttttgtggttctttagttgtttcaggccatctggatgtatacgtgcaggtcacaggggttatgatggcttagcttgggctcagagacctgacagtcataaacccataaatgtaaatataatgtttccctgagttctgtgagctgctccagcaaattagtggaacctgaagatggagccatgggaacctcagtttatagcttaatttagagctgttcattgaaggacaggttaaagaacttggggcttccaattggctttgaaagtcggggggcagtcatggagactgatccctcaccctgcaggatctgacactcaggtggataatgtcagaantgaatng

SEQ ID NO: 672242 - DNA, 344 bp, Homo sapiens
ttttttaagacagagtttcactcttgtcacccaggctggagcgcaatggtgcagtctcggctccctgtaacctccgcctcccaggttcaagcgattctcctgcctcagactcccaggtagctgggattacaggcacatgccaccatgaccggctaatttttatatttttagtagagatggggtttcaccatgttggctaagctggtcttgaactcctgacctcaggtgatccaccctcctcagcctcccaaagtgctgggattacaggcgtgacgagccacgcctagcctatttttcatactgaaagaaagatggattagaatgttagtgggcaagctctgaat

SEQ ID NO: 672243 - DNA, 1578 bp, Homo sapiens
  misc_feature (179)..(179): n is a, c, g, or t
ggtccaaacagaatataaccggagaagacaaggaggtcaaagtgatcagcgcatactatagcgttctgctacatcttgctggatgacatttcacataatagtgcttagttcccgcttagctcacatgatgtacacgtaacgcctgtggtttacatctgttgttgatgagtaagctgagncatgaattaggataatcgatctatctctctcagagaaatgacataataacacacacaagagaactctacttgcggcgctacttgtggcctgggggagaacaaaagataatccagtatctcctgtgacttcaaccatcttccagcgtgccatcctgtctcaggccaaacaattcggtcgtacaagatttgcgtcgcgaggaacctgcgccctatacaggtggcccccaatattacacccatggctcttagatagctcgtaccagttaccatagccccccgggaatggaaccgccacttgtggcgacacaagtgggggcaaccaacaacaaccggacgctttcctctaccaagggaacatagctattgcgagcgaccagattccgttccctcaactacacccaaacagaaagaagcaacgcgggaacaacctatcatgttcggtcacattcggcccacagcgggacggttaaccccaccatcggggcaaatctaatttgaaccgcggttcggaacttcccaagcaaaaagttccccttggccaaaccagaatgatgacaaacctcacttggcccccccaacagtttatcccgtcaccttcccccccatacataggggatacgccacggcacttctctaggggagacacgggcttcagcagcttatttcccccgacgtcgggcacccaaaaacgaacatatacaccgtcccaaacgaccgaagcagggcaattacccacaacaagaggacaccttccaacccataaacgatggaacacacgcccgacgccatattaaccacacgccaagggggcacgaataccaccgccgcagataccttataactttgggcacaacgccccgtccaaaacatggacgccgcgaaggaacaattacaaggctaggttagaaagaagtcgctattcgaaacgacagcttttcgcccccaaaggttccctctggggtgatatgggaacatacctttggcttagcccccattgggctgggttacggctacatagcggatcatattggaacgccctagcgtcggtgtgagatccttcggcgcatctatcgacgacccacttggagacagaggcactatggagaggcccccctatagtacgatggcctagagattgcccaggaaaaccccctggagagaaaactagacactacgtaacacagatgtgcacatggatgagtaacctaaatgagggcacctgcacacactataaaccttaggacatgacggagagaaaacaaaacaccaaacgaagtacttcgagacggcgaacacaacacgaacggcgacaccacagacatacgtacacaacccaacccgtgtagttataacagccacacgcacaccacactcgaagaacacgaccacccacacacac

SEQ ID NO: 672244 - DNA, 220 bp, Homo sapiens
tacatgattacgactcgagtgagtacccctcgataagggccacatggctcagtaaggcataccttattttattgcacttcagtttattgtgcttcacagataactgcatttttaacaaattgaaggtttgtggcaaccttgcattgagcaagtctttcagcatcattttttccgacaggatatgctcactttgtttctgtcacattttggccttatcgag

SEQ ID NO: 672245 - DNA, 133 bp, Homo sapiens
gaatattctatcagcatcccgttctagatggagttctgagagtagtaacctgtgcaaggagagacccggcaagaatccatccctgccccccgtctcctcggattgtcatccccttcctaccccagagcttcct

SEQ ID NO: 672246 - DNA, 443 bp, Homo sapiens
ctgtgtggaagtgcaacagtgatgcacaagtggaaatggacacctgacactttggctttctgatggttcactgtacacacattggtatcatgcacaaaataaaactaatgtataaaattacttacaggttatgtgtataaggtgaatgtgaaacagaaatgaattttatgtttaaactggagccccatccccaagtttaaacaaatcttccaaaatccaaaaaaaattgaaatccaaaacacttctggtaccaagcatttaggataagggagactcagcctatatatacattactcatttacaggcagcatgtgatccatactatgttgtacagaagtaggtgctacgactcaaataaaaaagagtgtgcaatacgatgtgcaacggtggaacacggtgactttgggcctgggtgatctgggacagtttcatgaagagggagg

SEQ ID NO: 672247 - DNA, 229 bp, Homo sapiens
gatcccggaggctgtgtgggaggacaggttcatggatagaggttgcggcgtgagggaggaagggtaagagtgaaggaatggccatcctggatccccacatttcagtctcagatgaggacaaatgggactcccacagcccccagaatcatcatgaaaacagcaaggatgcaggagtgagcttgatgcatggccccgagggtagcctcaagagccaataccatgccacatg

SEQ ID NO: 672248 - DNA, 383 bp, Homo sapiens
  misc_feature (34)..(35): n is a, c, g, or t
ggtcggtacctctagacatgcagataccaataanntatgaagagaatatattggcagagacactgccagcttggactgaaaggacagagccagtgcaagaggacaagacggctttgcacacccaaacttttacaggcaggaagcaggcagatgaaactgtggagctgcaaacatctttcatggaagaggtgggacgactcagggagagccatggagaatcattcatgaacaggagtaggcatcaaagagttcctagcatttctccaactggattacagaatttccacacaccagtgacttatatgtatgacttatatgtgcctcctgtcccctgccccacttttttttttttttgagacagagcaagactccatttcaaaaaa

SEQ ID NO: 672249 - DNA, 320 bp, Homo sapiens
ctatacaccgggactgagctatcatggtcgttagtattacactgccgcatcgtgctcccatcgggacacatccttcacatagcagacgatttcaccgatcactcccttaccatcagctcacttggtctaccagtggtactgaatctacgagtacaccgactaccgcggactaatcttcaactcctacatacttcccccattattcctagagggcaggcgagctgagactccttgacgttgacaatcgagtagtactcccgattgaagcccccattcgtataataataacatcacaagacgtcttgttagcgcagtgctgt

SEQ ID NO: 672250 - DNA, 307 bp, Homo sapiens
  misc_feature (142)..(142): n is a, c, g, or t
ctctagaggatctcaatgcagcggactcggcagcaggcgctcacggggctgctggagcgcatcagacctataggatgcggagtcgaggcaggtgctggtgctggatgaaagagcggcaggagctgaggtgcatcaccaaggncctagtcactgcgcagttcggcagcatcttccgcaccttccacaaccccgagctacttctcaaggcgcctcgtgcggcttctcttgactctacatggcctccgtcagctgcctggtcaactaccgcgtggacttcaccttctacccatgccgagtccgctgcatt

SEQ ID NO: 672251 - DNA, 174 bp, Homo sapiens
  misc_feature (5)..(5): n is a, c, g, or t
gttancacagggagtgaaataataagtgttgtctaggacgtgaagaaattggaatcctggagtcattgtacacgcctattagaatgtaaaatgatgaagcagtagcgtgaattaaggagtttgttgacccttcctctttgttctgtgagtcataacaaatgaaagcaggaatgg

SEQ ID NO: 672252 - DNA, 465 bp, Homo sapiens
tctctgttttgtatgctagtgtgttcctggcatctagaatagagcttgacactattcttggcacaagaagaaaaaaggatttgctttaaagagatcactggtgatcttggagaaacaaatttcagtaaatttaggggcaaagatcagattcccaaaagttatacaataactggatagttgagaaaatggaccaaaggaatgtacctgtttaatgtagtggtagatttacttccacaagtattgttgtctttgatttactaacatttttctattacagtaaaaattaggatcaactatgatgaaatgaaatttaaaaataaggtggtgcatgcctgtggtcccagctactcgggaggctgaggcgggagagttgcttgaacccaggaggcggaggttgtggggagcggagatcatgccattgtactccagcctgggcaacaagagcgaaactctgtctccaaaaaa

SEQ ID NO: 672253 - DNA, 141 bp, Homo sapiens
actttactgtttagaataaaggacacactataaaaagtgaacattatgcacatttccaagacaatatcaattccacggaatataaaattcataaataacatgaggaaaacctgtaacaagtgtacgaatttagcaccaaat

SEQ ID NO: 672254 - DNA, 1758 bp, Homo sapiens
ccccagatgagccctgagcagccccaccgccgccgccggctctagttaccatcacacccctgggatggatgccgcagctgcctgcagcctggtccctagtcaccatcacctgcaaccatgatgcatgcgatggccgagacccatgcatgcctgacctgcatgtcgaaccatggatgctgatgaaccctacataaggacatgtcagaaacactctacgaacaggacgattcactacaacatacaagatacatcgaacaactagaatgtacaatattacaccgccacgagcagaaaactacatacccactagaacctaataactctagacaccgcgcccgcaagatacccaccacacacgcacacccccccgccaacgccaacagcaccccacgcacagacacaccaacaacatacacgtctcccaaccaccaccacagcacaaccaccccagccccacctgccacacccaacctccacccacaaaacacacgcgcccaccaccacactcaacccaccgccatcatcacaaaacaacacaaataaataccatagaaccaccaaacttcaatctacaaaaaatcatatacaacacaccaaacatccactatcactcacccctcacacacaaacacatcctcaaacaccatccctcctcacaacaccctcccaccctactctccattctacatactgaccacatcctcatacctaccaccatcttacatcgcatacaaaccacacacaaccctccacctcccctcctccacttccacttctccctctccctctacacaaattctcccctacctatcccccctccacaccaacttgacgacacactaccacaagactaccagactcaatcaacaacaaccaccaagcaccacccactaacctacaccactccccctaactcaacttctccctatcataagcaatccatctacatcaacaaccatacactaccaccaacaccaatcactcaacgcacaatcacaacactcacacttctacacctcatcatctatccactaacacaacacatctcaccactccccttcaaactcactaatcactcccccccacactccaccctccaactctcccactcaatcacaccacaacaaaccaactccactatcaaccaccccacctcaaccaccccaacacaagcaactatacgaacacaacaatacagcaacacaacaccaacttcacacaatacacctcacttcgccaaccctcaacacaccaactatatatctcaaacttaaacccacaccagacatcacggggaaagacgtacagacacaccgcctacgcgcgcctcgacaatccgagctgccatacatcatacgctccatgcctgcacgctcacacaagccgggcgcaacacatagagtaggctggagcagaatcgatatccggcacacacgcaaacaacagctccaccacctcatcaactcactactatccacaccacacatacacccctcactaatacacatccctacttatccacataacaaaactaataagatgaataatctcaactacccacatcaccactcactcataactccagaaaccagcacaaatcaatactatatcacaatcatcacatcaatatctacctcacatcactcccactccatacctacatataaatctcttaaatacactacatctcacacacaaacccatcctctcaacacacaaccaccacacacacctcagacatcacattaaaatcaacaa

SEQ ID NO: 672255 - DNA, 930 bp, Homo sapiens
gcagcagcctccacaccccttgcgcgctggagcaaacgcgcctggccctggattcgtgtctgcatcgacgactctccaggctccggacacgatgcaggccatcaagtgtgtggtggtgggagatggggccgtgggcaagagctgccttctcatcgatctatatcagcaaccgcctttcgccgggagtagatactagtcccacacacagttgttttgacgagacgtacttcaggtcgcaactgatgagtagggtggtacagcaattaggcccatgttgtaatccgtggagtgcttggtgtgtgacatcatgtcatggcgctagagagagaacctacagacgcgtcttccgtgtctcgatcctccttatttcagcatgactggcacgtgtcttccctcaatcgtgtctttcttcctcttcgttcatgactccacggcctcattagtgagtaacgatccgcgccatgatggattcccataaggtgcggtatcatgtgccccagcacatccagtcatcctgggtgggcaccaagctggtacctgtgggacgagaaggacaccattctgatgaaattgaaggagaagaatgctggctcccagtcactctacaccgctagggggtctggcgactgtgtccaatggagatcgagtcggtgaagactacctgtagtgctcagctctcacccagatgaggcctgataatccgtgttcgacgaggcatccggtgccgtgctgtgtcctcagccctcgcggagctgatagcgcgctctgagctcctctaggggtttgctcccagcgctcccactagatgggtctgatcctccggatcccacccggagctgatggaaccgcggttggtctgtggtcctcctgtggggttcttgcgtgtgcgctcgttgaggcttctgtggagccctgagcggcggcatgggt

SEQ ID NO: 672256 - DNA, 292 bp, Homo sapiens
gatccctgtactctcaccgtaaaaggggtctggtaggacgtgatggaatttgccccgtctaatggaggagctggatggtcacggccactgtgtcctggcctggcggtgtgacggggatgctgcttggggagttgcagatcacggcctcgccctccacgcgggcggggtgtggcggcgactccccaaaaaggcatagcaactcgtcctcctcgctcagggcagggagggggctgacggtcagctgcacctccccctgggcccgccggctcatgttctacggcttcgtcggtca

SEQ ID NO: 672257 - DNA, 102 bp, Homo sapiens
acacacacatatatacatatatacacacacacacacacaaacaatgcccggctcttctatatgtatctgtgtgtgtgtgtatatatatatgtacagtcgacc

SEQ ID NO: 672258 - DNA, 389 bp, Homo sapiens
tcctcccccctgggcctcctaaagggttgagattacaggtgtgagccccggcatctggcttacttattttgtttattgtctgttccccaagaaggaaaagttttagagagcaaaaatttttgtttattttttttttttcccccttcccttttttcctcttttacttggttcactacggtattccccataaaaaatatttggcaaatagtgggggttcaaaatgttgaaggaatgaaagaaatttaaagccttgggtggcaaaataaaaggtatttttttttcctgtgggttagggcaaaaaaagttttgaaacccgtttttaaaaaatgcaaaggtcagggctttgccccgggaaaaaaaactgaaatgacttagggatttcaaaggca

SEQ ID NO: 672259 - DNA, 141 bp, Homo sapiens
  misc_feature (7)..(7): n is a, c, g, or t
tcaggtncacacgccaccggagaaggcattgctgtggctgtgatttaggccagcaactacagctgtgattcgacccctagcctgggaacctccatatgcctttagtgtggcccccttctccggtggcgtgtgaccgcagca

SEQ ID NO: 672260 - DNA, 914 bp, Homo sapiens
  misc_feature (7)..(8): n is a, c, g, or t
  misc_feature (17)..(17): n is a, c, g, or t
  misc_feature (158)..(158): n is a, c, g, or t
  misc_feature (218)..(218): n is a, c, g, or t
  misc_feature (264)..(264): n is a, c, g, or t
  misc_feature (283)..(283): n is a, c, g, or t
  misc_feature (330)..(331): n is a, c, g, or t
  misc_feature (340)..(340): n is a, c, g, or t
  misc_feature (343)..(343): n is a, c, g, or t
  misc_feature (346)..(346): n is a, c, g, or t
  misc_feature (355)..(355): n is a, c, g, or t
  misc_feature (358)..(358): n is a, c, g, or t
  misc_feature (360)..(361): n is a, c, g, or t
  misc_feature (364)..(364): n is a, c, g, or t
  misc_feature (499)..(499): n is a, c, g, or t
  misc_feature (533)..(533): n is a, c, g, or t
  misc_feature (548)..(548): n is a, c, g, or t
  misc_feature (553)..(553): n is a, c, g, or t
  misc_feature (558)..(558): n is a, c, g, or t
  misc_feature (560)..(561): n is a, c, g, or t
  misc_feature (565)..(566): n is a, c, g, or t
  misc_feature (570)..(571): n is a, c, g, or t
  misc_feature (573)..(573): n is a, c, g, or t
  misc_feature (578)..(578): n is a, c, g, or t
  misc_feature (582)..(582): n is a, c, g, or t
  misc_feature (585)..(585): n is a, c, g, or t
  misc_feature (589)..(589): n is a, c, g, or t
  misc_feature (595)..(595): n is a, c, g, or t
  misc_feature (600)..(600): n is a, c, g, or t
  misc_feature (602)..(602): n is a, c, g, or t
  misc_feature (606)..(607): n is a, c, g, or t
  misc_feature (645)..(645): n is a, c, g, or t
  misc_feature (657)..(657): n is a, c, g, or t
  misc_feature (661)..(662): n is a, c, g, or t
  misc_feature (672)..(672): n is a, c, g, or t
  misc_feature (677)..(677): n is a, c, g, or t
  misc_feature (684)..(685): n is a, c, g, or t
  misc_feature (693)..(693): n is a, c, g, or t
  misc_feature (695)..(695): n is a, c, g, or t
  misc_feature (700)..(700): n is a, c, g, or t
  misc_feature (711)..(713): n is a, c, g, or t
  misc_feature (775)..(775): n is a, c, g, or t
  misc_feature (794)..(794): n is a, c, g, or t
  misc_feature (893)..(893): n is a, c, g, or t
ctaatgnnctacaattngctttttccacaacttacaaaataataatctgatatttaaaatgaattggttttcattatgtaagtcgaaatggtaaaaaatcataatgacctatccgatgcatcatatatatgctattcagagaaactcaaatccccganttctcctgtggcatgttttatatcagacatttaaaatctgtttaccaagaaagaccaggnttttaactatatgtaggtttctgcttacagttgcaaactatcagangcctgtctatatgatagancccagataaacctgagatttagaaaagcaagtcatttattctcctgnngctgttttngtngcncttttgtgncangnntgnccctcctaatgctttactacacaacttaaccagatctatcagtcatgataaattagacccagtccatctttcaatccagtctactctggttctgaacatataaacacaaaacactacagatttattaatatagcnttttcccacaccctaaccctataaagactttaanagagaaaatttcatntaaangtttngnncttnncggnngnccttnccanctntgcnacaggnttggncnatgnnatagtactttcctagatgacatatcgagtcaacatgangccttagctganatgnntgattcaggntattnatgagannttctcacnantgatntgcatttaggnnntgattttgctttccttaaatagttcgaaggcttgaaaataaacttttttttgcatttctttnagaatgtttggtcattaanaacttttaaccttatcttcctcttctccttagcccttaacagaccaagtccattctatttggaaataacaagaacttgatcagattattaaatcttggnaacctcatttttaccttataa

SEQ ID NO: 672261 - DNA, 454 bp, Homo sapiens
  misc_feature (7)..(8): n is a, c, g, or t
  misc_feature (17)..(17): n is a, c, g, or t
  misc_feature (158)..(158): n is a, c, g, or t
  misc_feature (218)..(218): n is a, c, g, or t
  misc_feature (264)..(264): n is a, c, g, or t
  misc_feature (283)..(283): n is a, c, g, or t
  misc_feature (319)..(319): n is a, c, g, or t
  misc_feature (358)..(358): n is a, c, g, or t
  misc_feature (361)..(362): n is a, c, g, or t
  misc_feature (366)..(366): n is a, c, g, or t
  misc_feature (448)..(448): n is a, c, g, or t
ctaatgnnctacaattngctttttccacaacttacaaaataataatctgatatttaaaatgaattggttttcattatgtaagtcgaaatggtaaaaaatcataatgacctatccgatgcatcatatatatgctattcagagaaactcaaatccccganttctcctgtggcatgttttatatcagacatttaaaatctgtttaccaagaaagaccaggnttttaactatatgtaggtttctgcttacagttgcaaactatcagangcctgtctatatgatagancccagataaacctgagatttagaaaagcaagtcagntaggcgccggaggctgtgggagtggggcacgggggggtncannaagnaccctccgcaaggcgggacgacacaactgaaccagagcgatcaggcaggagaaaggagacccaggccagcgtgcaagccagncgacgc

SEQ ID NO: 672262 - DNA, 93 bp, Homo sapiens
ttttgtagaatttaaaatctggtgtttttctgaaaaaatatatataaatatattgctttatttgaaacaaattaaaatatgctgcatttgaaa

SEQ ID NO: 672263 - DNA, 319 bp, Homo sapiens
atgggtccagaagtgtgagcagaccgtattagtgataactacttaaagaaggcgatcaaaatttatttttatcatgccctctcacaggtttgtgttatacattgtagcccatattacttgtgttagtagtttagtctctattggtgacataatgacagtcgtgtatagtttctgttcaagaaacatatattgtacagttactttattcaaaatacctgccaaaggaaatggtcttcactttcgaatgacttttaaagcatgtattatttcgcacagagcaggagaagactttaatcagaatttgctgtgcccatttcaa

SEQ ID NO: 672264 - DNA, 102 bp, Homo sapiens
  misc_feature (16)..(16): n is a, c, g, or t
aggctccccctgtatnatgcaaaggtcacaagacagatgtatagatagatctaacgggctcacaaactagtagagtagaccctattttaaatcaatagctag

SEQ ID NO: 672265 - DNA, 617 bp, Homo sapiens
  misc_feature (617)..(617): n is a, c, g, or t
ctcagaggatcccttcgatcggcgggcaacttagattatcaatttttttttactatcagctattcgtgtgtattactaaaacattttttagatgactttttaaagtatatggagcagtcagcttatgaaagttcaaatgggtaaatctcttgtaatttagccttcatcgaataataggtaccagtgtattaaaaatgtgtatttttggcagccccttgaaccagagtaggttcagagaaactcccaaagttggtacttgagacacatcatgctggatgggtaacttccctccttggtgggggaacatgttggtgtcctattaacttaatgggatagatttttaaatatttcttattttgggcacacggaaagggtagttcgagtacagaactttgattgtgggtgtagatgcagagggaatgatgggtaaatttcctaggtttatgtgaatggagggggtgtatgcatttggaaacaatctactaacagatggtgctgaaatctattacctacatgttttctagtactccagcattatgttcatgacgcctccatataaggagtgtctctctggcacagttggtaagttgcccgacaatcggagggtaccgagctcn

SEQ ID NO: 672266 - DNA, 354 bp, Homo sapiens
gacctaaggatccggatagcgacatttcaagggcttactgggaatcacaagaacccaagtataagaaactcaagatgcattgaagaaaagatcatcattggtgaagtcgtgaacaaaattaaccgtgctaatgggaagagtacatctcgggattttcctcttaacaaaaaataatctccttcttggtgaccaaaagtctggaccaatcaagtccgaggttccactgggtggatgtggacccaggtataccatgagctcacaaaatggatgggttcttcgccgtcccactcaaagagggctcagaagcagccagtaaagggaagactttctcttcagcagtgatcacctgaattg

SEQ ID NO: 672267 - DNA, 826 bp, Homo sapiens
gatcagagctgagacgaccgcttgctgattcagttgcggcccctctcagtgagccggccttggctacttgtggtggcacctggtgtgaccagcaggcagtgaggagtgtagtgagcatggagctcgcaaggcctgaagtgtgcagttctccaaggacgagctgtgtctcgtgtgagtagaggcctcagaccgtccatactagcgaccgggtggagtgaactctgtcagccgagtgtacagccgagggtgacattgagcccctcagtgaggcggtcacggtcaggaacacccccgagaggcttgaggccgtgatgaaacccgggccgacattgacttgcgaacttagggccactacatggcttgccggggacaagaatcacccagcctgccattctacatttgcgacgttaccgtccggaagtctccatgggacttaaagttgaccatcggcgcagcatgacccacatggtgtcgctcggcagcattgcggaggaccaaaccagctgcgatgggcactttgccagttgggtgcacaatcggaagcaaagcattgccggtaaacgcagaggcgcccacaaaaggctcaaataaaagccacccttgcgcaaggacgagccctttacgaacgcgacggcgattaacaccttccgtggggcctaaccttacttgttacttctttggggcaagcatccctttcaaggggcctttcccaagatggagacggtccccaggaatacagcccccattcagacacacttgccagaaaaaggttctgcgacagaattgccttgaaaatgtcaagaaagattacagcaagggaacacac

SEQ ID NO: 672268 - DNA, 360 bp, Homo sapiens
  misc_feature (48)..(48): n is a, c, g, or t
  misc_feature (288)..(288): n is a, c, g, or t
  misc_feature (310)..(310): n is a, c, g, or t
  misc_feature (343)..(343): n is a, c, g, or t
accacgcatccgaccctgcttggaggaggcagtactagcagaggctangcttaagtctgggccgagtcctgattgttggtggttaagccactctgtcacatgaacaggaggatctcgggcacacatgtagcacaccgtgtgcatagattggtgtggcgctcaatagatatcgactccacttgtatgtaagggtgtgtttgccccagtctgatatactcgaggctgagacggcaggaggagggcatgatgatgctagtgtctactctgtatatagagagattcggggcncactcttcacacttggcctccntctggaggcgttgctcttgtaggatgagaaggntacacagggttgagatg

SEQ ID NO: 672269 - DNA, 371 bp, Homo sapiens
  misc_feature (96)..(96): n is a, c, g, or t
  misc_feature (99)..(99): n is a, c, g, or t
ccttatgaggatgaaaatgggattttggatgtaaaaatgccttcccatcccagtaccctgcctaaacaaaatgccttacctaatggcccgggccgncgngttgtcacgccctgtaatccccagcactttgggaggctgaggcgggcggatcgcttgaggtcaggagttcgagaccagccctggccaatatggtgaaaccctgtctctactaaaagtgcaaaaattacccgggcgtggtggtgagtgcctgtaatcccagctatccagaggctgaggcacaagaattatttgaacctgggaggtggagtttgcagtgagctgagattacgccactgcactccagcctaggcaaaagagcaagagtctgtctc

SEQ ID NO: 672270 - DNA, 888 bp, Homo sapiens
caatgtaggctgtcctggtcgagaactaatgtctggttgattccatgccgactcatttccacagcatgcacgggaaacctgaagatctgcagagactttaacctcggttggcatgtaactggcatagcgtaagcccatatctctagtcatcatgagcagttgctgttttaaaggcctttaccacgtatttctttctgttgagtgaggtgaaattcacataatttcattatattttttttttgagacagagtcttaccctgtcgcccaggctggagtgcagtggcgccatctcggttcactgcaagctccgcctcctgggttcacaccattctcctgcctcagcctctcgagtagctgggactacaggcgcccaccaccacacccggctaagtttttggtatttttagtagagacggggttatcaccgtgttagccaggatggtcttgatctcctgaccttgtgatctgccacctcggctcccaaagtgctgggattacaggtgtgaaccactgcacccggcaaaattagccattttaaggctaattttaagtattacaagttaagtaggtgagcagttcagtggcattagcacatttacagtagtgcataatcaccacctctgtctagttcccaaaacatttccatcaaccccaaaagaaaaaccagagctctttaagcggttccttcccattcctgtccgctaacccttgaacaccaatttttcatttggtcctgggaattacttccggggtattaataattttgaggacagctggtcttacccaggtgaagtacagtgggatgacagtgtcatgcagctcgattctgggcccacgatttccaccctgggtccgaggacgagaatacgggctgtgccccgatttttg

SEQ ID NO: 672271 - DNA, 90 bp, Homo sapiens
tagctgacatgtcagctccctgtccaagcagtattgggaggagagaggttcagggaagaatctggatctgaaagtctgtccctgcttttc

SEQ ID NO: 672272 - DNA, 231 bp, Homo sapiens
gaggtgctcttgaaggcggtcagttctactgcctcggtctcccttttagctgggcactgtacaggtgagctccactatgcctagctagtttttgtgatttcttacttgagacatgggtttcgccatgttggccaggctgttctctaactcctgacctcaggtgatcctcctgccttggccttcccagggtgctggaattacaggcgtgagccattgcgcccagtcccagtg

SEQ ID NO: 672273 - DNA, 1498 bp, Homo sapiens
  misc_feature (362)..(362): n is a, c, g, or t
  misc_feature (467)..(467): n is a, c, g, or t
gcagccacgtgagagctttgcttctgaccccgatcctctaccggcccgtgtgctggtgggtctagacactcatagagggatctgatatccgaaatgggctcatcaggggtcagacggcatctgtctagtagagtgtgcagctgaaagacacgtggagaccgatcatgcgaaaactcgaagcgtggataaccgcctacatggtaaaagtgtgacggatgatacattcctggtggcctggtactacgaagtaacatcatggctaagggttggatggcatagtgggtccagtgaaagtagcatcacgcgtcgagatcgatgggcgtctctatcttcatccttccaaggtcgaaagcagcacatanggtcgccatgcacattccgtcgtggtgcactgcgacgcgtcgagaggacacttgggttagggtcacgttagtgcgcgggctcacaagatacgcgaggtgttaganaaccctttcgcgttggtgacgacattagccctagatgggcattgtttgtgcttacgactttcgctcgatcagtgcaggtagatggggagcgcttacggagggtgcactatttcgcacacgttggcagggcgtgatctgtagggctaggagcatttgatacgaatcatccgcgatggtaagccgcccgttggctactatggcattgcccgcttacacgtggcccaatctcttgaaaatagttccgcgctattttgcaggaagctttcatgtgcataggcagtttctcagtagcggaggaaaagggaagaaaaacgtgggaaaccaaatgtaggaggcgagtaagagggagggggaaatgggatttggccaatgccagagaaccatttcccggcaaggacaatttcgcattcgtaacggaggagaggaggttatgctgcgcatgaggttagaagtaattcgttaaggcgattacacactttggtgggaggagacactaggatcaggaatcaggcgtgaaacttccgcacctggggtcgcgggccctttgcccggatcggcgtcacgcacatctcccttcaggggcgggcccaaattcctgtcgatcggcacttctacccccgtaggacgatccacatggcaccacgggggtcttgtcccccttatggccaactcccaggggcaccaggccaactggcacgtcgccagtctgggagcaaccacgaaggtggcgcctcacacccccgggcaacgcgtcctcagggggcggaaacaggcctccatagggtatccaaattaccttgcggtttcgccatttaacactccaaaccaattggcggcattggcgtaccagaagcgggtcttcagatctcccaaaagaacaatcgcggcccggagccgcccacacttacggtgcgagccttggacagcagcggcactgttagaacttcatagggggctataactcggactcgggtctcttaggggatttggggaactaccccccgaacttggctatgccctggggcggtgtc

SEQ ID NO: 672274 - DNA, 119 bp, Homo sapiens
aggatcccttcgaggacgatagaaagaaggaaaacaagcctgtgtactttccagcaatataacaaagaagctacttagccccccatgatgtacagcctttaagaaatgtgacacctcct

SEQ ID NO: 672275 - DNA, 358 bp, Homo sapiens
acagtaggatatggactccttgctcagtcaatgatctccggggacctccggccataagcccccatcctgctgagcgtgtggacccatggctgtccctggagaaacagccgtggtttcatggccccctgaatcaggctggatgcagagagcctcctgtccctctgcaaggaaggcagctacctagtgcggctcagtgagaccagcccccaggactgctccttgtctctcaggagcagccagggcttcctgcatctgaagttcgcgcggacccgtgagaaccagtgtggtgctgggccaacacagcgggcccttccccagcgtgcccgagctcgtcctccactacagttcacgcccactg

SEQ ID NO: 672276 - DNA, 1565 bp, Homo sapiens
  misc_feature (2)..(2): n is a, c, g, or t
  misc_feature (39)..(39): n is a, c, g, or t
  misc_feature (1120)..(1120): n is a, c, g, or t
tnagcaggcaggacgcagactagctgaacctagatcacntggcgacagggctgtgtctcgtctcgattctagtttgtattgtttgctcgctgtactctacttgtgtttgtgtcaaacaatcatactgtgctcttctttgtcgttaggtaagcttagtctcgctctcattgggggcgtggaagatttggtgacgtcctgcggcggagtactgcgtcgttaatggttgctgctgctactacttagtgtatgctcttcccatgctgtcgtttaggtgtgtttactacagagacagggtgtgtcgactgggtttcgaccaacggttgttctgcgcgccctacgaaaaaattggtgggcgccaacacaaggagcgacgaccaccgcggtgggagtatctttgtggacacacccgttgtggggagagtctcccccctcccctgtaccccggcacaacaggggcggtcaaaagcccacctgtccagagcccaccaaagcctttccggagaaggtgcacaacgggggcacagcccacttgtggggcccccacaagggggtattttgcaagaagaattctacccccaagagtttatccttgtagtatttgagaggcaccccgcgtttgggggttcaagaaggttcccaatacccttgggttgaacccaaagggggtccccccgggatccccgacaaaagtgttgtgaaagagacaacagaagcctcacaataggaacccctcttttctgggcgggaacgacccccatttgggaggaatttgtatatgggaccaccacgcgagtggtaaagcacacagttggggaggtcgttgtgaagagcatgtcactatcacgggggcgcacaaacacacagagcccaacattccaattagcttggcgcgcttcttaaactggggacactttggacccagggagctctgggagaaagaccgtgtgtttgggagcccaagatactccgtgggacccccacacaaccaaatatggggcgcgcacgtggcgttttactcgatagccccccacatggccaaagttgtatagcttaaccagacgttctccagccccgtgtgcgcccccacatcgaatcttgccgcgcctattgcgtttctggnttggggcgccagaattgggttgtggaatagccttctccacatcctctccgaggagatacattttctcaaggccagccctttaaaggtaacccagaccatgggcacacccacaccactcggtcggtgtttagacttagattaagagatttaccctcggaggactgcgcagactgggagacctcggagacccaatagggcaccagattcacacacattggaccagacaccaaagaatgtgtgggagaattggcatagcccttggaacttaagagacttctcaagttcaaggaagactgggctgggccgtatcccccgccctcttagtttttccaatgggggagggatacctgggcccagccaccaaaactttaaccaaagatgatagttaaaaatgaaaagcccaattaaaattctttggaaaagagcctggaggttcaaacgagga

SEQ ID NO: 672277 - DNA, 293 bp, Homo sapiens
tgcgatcacacgaactcagctggacttgcgtgacagtgacggccctccaagtgaagactggatgcagggtgcctgatggaacgcgtcacctatacccccatgacacctggcagctacctcatctccatcaagtacggcggcccctaccacatagggggcagccccttcaaggacaaagtcacatggccccgtttcgtcaggaaccacagcctccacgagacaatcatcagtgtttgaagacctcactgacacaaggccaccatgtgccccccagcatgggaccccggggtcct

SEQ ID NO: 672278 - DNA, 490 bp, Homo sapiens
  misc_feature (483)..(484): n is a, c, g, or t
tcgatctcggtacccgtcagacgctgaactatgtgaagggtagttcaaccgctgagattgattgattgattgattgactgagatggagtcctgctctgttacctaggctggagtgcagtggcacaatctcagctcactgcaacctccgcctcccgggttcaagtgattctcccaccctggcctcctgagtagctgggattacagggctgtgacaccacgcctggccacttttgtatttttagtagagacggggttttgccatgttggccaggctgctcttgaactcctgacctcaggtgattcacccgccttggcctcccaaagtgctgggattacaggcatgagccatcatgcccggcctgggaaatggatctttattaatatctttaagttctaaatgcccttctagcagctatatccactttcctatctttgtaccaaatcttccccattttcttttgcacatagttcagcgtctgacgnngatcct

SEQ ID NO: 672279 - DNA, 574 bp, Homo sapiens
gaatcggtcttccagcaggggatgaaaacaaatcttgatatttggcctctttaagaggcagccctggctgctttcttttctactgccctggaatgggtgttgctcttaggatgtatcccctcaaacctacctggtggttttgtgccttcccccactctcttctcatctttgtatatgacgaagtcaaaaaactcatcatcaggcgaccccctggcgggtgggtggagaaggaaacctactattagccccccgtcctgcaccccgtggagcatcaggccccacactttgcatccgacaccccccccctttttgtgtacttcagtcttggagtttggaactctaccctggtaggaaagccccccagcatgtggggaaacaaaacgtcctggaattaagcatgtagctttatggggggaggggggagggctgccttaaaaccctccatctgtggaaataccagcggggaaggtttttatgtgcccttttgtttttgtaaaaaaggaacccccggaaagactgaaaaaataccttttatatttggatttttccaaataaaaatggcttttttaatgga

SEQ ID NO: 672280 - DNA, 760 bp, Homo sapiens
tgatggtggagaagttgatttagacctggaaatactgaaagattttggatattactctttataaagacaacaatatcaccacggggcagatatatcagcatgtgatcaataaagagaggcgtggtgattacctggggaaaaccagtgcgacagttgtccctctacattcactgcatgctgtcccaggcagtgggttcatgcaatcaaagcccaaggtgccggtggcatggtcacataaggcaagcagcccccaaatatgcgttcattgagctgggcaggccacccattggagcaccatcgcaaggaatgccgtatgtggcaggcgtttagacacattcccagtttcaaggcgaacaacgagagaatttcttgtaatatccacgttagcctctgtcccacagctcagatgctaccgagagaacaaaaacaacaaagccacccaaaacagcgtccagcgcactgaggggtttaggcctgtctccagatctgctttgtctgccgaagttcaaccgcccattgcgatggccgtgacaggcgacgcatttctcatgtttgtacacgtgaacccctgaaacagagtccatatgtactcccatcgactgtaaactctccaaaattaccgaggttctcgtgctataaaagaggaaaaccaaccgcattgtgaccaacataacacggcacagatagcccaggcaccatcggagatactgaacagtcattagacaaaacagaggagaaataatgagaagaggttgaacgg

SEQ ID NO: 672281 - DNA, 875 bp, Homo sapiens
cttatgccccgcaccgttgggaactcctgttttcccccaatccgtttgggaaaacactggattgggacatccacgatactccgaccaaaattggggcctaacgtgcagatccctccttggttttgccgacctctatgggtaaatgtgcccccgttgttttccgacccgaatctttctcagggcgttttaagtgcccccctgtaggggcgggccgccccccgcatttcgtttcgtgcatacgcccaccaaaataatttttgtcgccctcccctgctttaaaaccaagagtgcgccttggggttaaacaagaaaccgccacctttttgaaaaatttataatgccccccccctccccgtaaagcggttacccccttttccccgcccttaagaagaattattagtttgacccctcgtgcttgcatatacgtcccacacttttccacccccaagatgcgggtgggtccccccctttaaagcactcttccttagaaatgtgcttttctataatatctaccattctaataatactcctgcttcatattcagaaaaataactttaatatctcggggacctactctccccgtgtttgaacacccacgcccacacatgctccctcccgtttctttgacttagacattcacacatgccgctctttcctaatagcgcaccagacggggtctaactctacatatcaactgtacccccaacattctcaatctaaactgtgccctccaatccatatcccctatcgtcttattatttttacccccgctcatcatgacaaagagttttctttttaatttctattgacaaccccttttcactggcgctacggggaaaaattaaaacattactccacccccctcacataacaaa

SEQ ID NO: 672282 - DNA, 346 bp, Homo sapiens
tcatggcagaagtatgcactttttgaagcagtcactggcaaaggatgggactgtgtgggccaacaggttcagccctggagatggatcccttcttctgggacagcaagacaaaacaacattccctttctcccctggcaatacccagccaaccttccagctatgaatctcccccacaggcaccctgtttcttctcatgacaactctgcactccattatccacctcctgggagcaaaccattttgtagcctattccaaaaagctcaagccagcacagacaccacagggcagcaaacgaaatctgaatctcaaagcttgccagaccagcagcgcccactgagaaactctc

SEQ ID NO: 672283 - DNA, 144 bp, Homo sapiens
gatgctgtttcgccgatgaagatgcgttttcgccgatgaagatgccgtttcgccgatgaagatgccgtttccgcgatgaagcatcgcggtgttcggcggatgggagataccggttccggatgaagatggcggttttcgggaaag

SEQ ID NO: 672284 - DNA, 428 bp, Homo sapiens
acggtgaggtacagctcataacaggtggcgcctccgcgagttgttctgttcctcccgtctggagttgttcctccctcctggttgggttcctagtctcgctggctttaggagtgaggcttcagaccttcgtggtgattgttacagctctcaggggcggcacggacccaaagagtcaacagcagcaacatttagcaggaagaacaaaggaactaagcttccacagcatgaaaagttgctgttgctggctgaggtggcctgcttttattcctttatctggccccacccacatcctgctgattggtccattttacagagagctgattggtccaatttgagagaatgctgattgttgtgtttacaaaccttcagctagacacagagtgctgattggtgcgtttacaatcctttggctagaggaaaagtttcca

SEQ ID NO: 672285 - DNA, 237 bp, Homo sapiens
gagtatgggctggcaagtcagtgcacctcatatatggcagccggaaagccgtgagtcagaggcccaagcaggctctgcttggagaacatcgccctgtacctcacccatatgctgaagatctttggggccgtagacgaggacagctccctgggattcccggtcggagggcctggaaccaagcctcaagtctcgaggccacatgtcatgccctaccttcaggtgtcatccagacttccg

SEQ ID NO: 672286 - DNA, 157 bp, Homo sapiens
aaagctgcgggcgagtcgacggcaaaggcagcgatgcagctagcatgcccgccattttccaaccccaagccttctgtcctcggcggatgggcgccttttgccgagcattttcgacacggagtctttatgttccttcttcgcgtcgtgaccatactgg

SEQ ID NO: 672287 - DNA, 359 bp, Homo sapiens
  misc_feature (168)..(169): n is a, c, g, or t
  misc_feature (237)..(237): n is a, c, g, or t
  misc_feature (300)..(301): n is a, c, g, or t
cctccgaagtgctgcgattacaggcgtgagcacctgtgcttggccagttctaggcattaagttctaattggttcatttggggactcgaaattctccattttattttattttattttttctgcttttgtcacaaaagcacagacattgcttaacaaagaggtctgagannggatatgaatgttaagctcagggacatagggtcaacacttttgagtgcacagactgggaacctggcanagttttaacaatcccctcccctattttcaccatcccttattcctgtagaagtagagcagatgnntacggtattcactgctatatggcttattacctttgtaggaattctaactgaagggctt

SEQ ID NO: 672288 - DNA, 882 bp, Homo sapiens
  misc_feature (198)..(198): n is a, c, g, or t
gtcactgcccctcatcccagatgacgaaggtagggcacggagcgtgagattcagttgtgacacggtagggatgagaaggctctcatgaacagtaagcgtactcccttctgcctcgaggtacccactattatgacctgctatttgattgccgcttatggctgtgctcatatgtgtatcctagacgtactgcgacttccntctagatagtacgacaggtatagaccctgttcagtaacgcaacgccaccttacaattagtgttccttctgcactgtcgtaaattagtgtactgtgtgtacacagtctgagccacgtgcacagtgtacaccgtgagccacaaaacacgagaacgtactgatcttaccagtgcggctacgtctacggctcagagcttacgttcgcattcacactgaaagttggcaaccttggcattatacatgccaattgaactagtgtgtgtgtggcaggagtcatgtaccctcacatcctttgtacaaatgacaattactcttaattccttcagatttataataactctgtactttggtttcatgggtgacatttgggaaggattggtttagaattaatggagtggcacattttgcagcctttttgcttgattgcatgtactggaaatgccctatattttcctgcaaaataagtactaaattcattatcgttaagcaaatgtacaatatgctcaggcaccgcagagagctgtgcacggagcccattgtgagcatcactttggaaagtagggctcttcaacagggaccttgaactttacagaaaggaacttctttttgccttctattgatcatatagactattcttggtaagtctgcccacatgtaataccggtaattcaagcggagaaccaatg

SEQ ID NO: 672289 - DNA, 810 bp, Homo sapiens
tcctcacccaggtggggctttaatggaaaaggcgcccccctcaggccgtgtaaccggtatattccccgcagggggataccaagccgctctccttcccggggtgggtgcttctgtgggctctcaaggtccccctcggtggtgtgtgaacccgggcgggccgaatgagcaaggatgtattattaaacgccacgaatggctccaggggcgcatgaacatctttgcgccctgttaaaaaatcccaagaaggagataccataccaaagaagtctgggataataaccctgggtagaaaacacgtggcgcaaaaggagaatcccggagacaaacctcagtactataaaagagaatctctgtggggaggcccgaccaccgctccgtgtcaccatctgtgggcaaggcacccccacagatgtgggaaaaaagccccccactcttaggagggtgctcccgagtgtgattcacaagagaggctcccccccctcttttttctcccccgggaaaaaattcgcggaccctgtggttatctgggcccatgtggttgcaacaaccgccgcctttgggggaggcgttgacaccttgtgctgatcccgtgaccccaagagggctttctttctgtgcccccttaaaagagggtgttgtcgcccctttagtggtggccccacgaccccttctttggggcttgaagcttctgagaggaaaaagggctcattgttcgccgtgtaccggaaaagatcttgcccatgtgtcttgtacccctggtggtagtgcttgtgacatctttgcaaagtgtggccccagtgtcccacgtct

SEQ ID NO: 672290 - DNA, 156 bp, Homo sapiens
tcacccaggctggaatgaaggatgcaatcttggtcactgcaacccacctcctggatgcaagtggttcttgtgcctcagctccccaagtggctgggactacaggcgtgtgccatcacactcagctaatttctgtatttttagtagaaatgggctttg

SEQ ID NO: 672291 - DNA, 104 bp, Homo sapiens
  misc_feature (10)..(10): n is a, c, g, or t
  misc_feature (13)..(13): n is a, c, g, or t
  misc_feature (104)..(104): n is a, c, g, or t
cttaaatgtngantgtaagcacattcatttttttaacttttaagttcagggtacaagtacagagtagttgaacagcgtggcatgatcagaacttcaagaagttn

SEQ ID NO: 672292 - DNA, 102 bp, Homo sapiens
cagtcaactgacatctgctctctaatcacatgatgtgatcctgtcattaaaatgattcctggcctgggacaaatgatcttgatgggtgtcgagacaatggta

SEQ ID NO: 672293 - DNA, 321 bp, Homo sapiens
  misc_feature (9)..(9): n is a, c, g, or t
  misc_feature (17)..(17): n is a, c, g, or t
  misc_feature (60)..(60): n is a, c, g, or t
  misc_feature (94)..(94): n is a, c, g, or t
  misc_feature (104)..(104): n is a, c, g, or t
  misc_feature (174)..(174): n is a, c, g, or t
  misc_feature (268)..(268): n is a, c, g, or t
  misc_feature (283)..(283): n is a, c, g, or t
  misc_feature (301)..(301): n is a, c, g, or t
  misc_feature (309)..(309): n is a, c, g, or t
tccccccgnccaccggnttcctctcccaccggttgcctgtccagaggtctgaaggcaccnacgagagccacgatgaccctctccccagggactngggctgcctnctggaaattcgagcctacagagaagctctgaaagctaaaataaaaccaggacctaggcctgaaaagctcnaagattgaaaaaagtgtggctgtataggagctgaccttcccccacgtaacgtagtcagatggttttcggccgaccaaccgtcggcccaggtgtncagttcggagctcgngcacttttcaaagcgagngaggagtnaggcacagaagt

SEQ ID NO: 672294 - DNA, 204 bp, Homo sapiens
atcctgaggcgcagggtgggttgatcgatgagtttctatctagtaatcttttccagtattaacaaggcactagttacatgacccttgctacaagccaaagggagggcagtatttttactggttatcttgtacgagtcagttctgcactagcactgttaaaccagacatctcaacgtgtatttggtttggtcccattttactggg

SEQ ID NO: 672295 - DNA, 117 bp, Homo sapiens
gaacgaacagtacacttcgagagaatttcagtgagtctggaataggcctgcccatcacgcattgagatgctctcgatggatgttgtgcgccggggagacacattgctctgtttctca

SEQ ID NO: 672296 - DNA, 870 bp, Homo sapiens
cccttttttattattattattttatgtgtagtcgtgcaggtaaaggcttactaaaagtgtgaaaacgtaggcattggtatcaaggcgacacaagcgaatttctcaggcatacgctccagtcaaaattcagaattgtgcaaacatcgcatcacacgtgtacaagggacaggttcaagggttagatcattgctcaggggtggccgcttccatatataagtgtgagctatagatgtaaggtgtgaaggcctaagcaaagtaaatgatgttaaaggggatataaggctgtaacggcccaggggtctatatatgggttagatatggattaaggctgagataggttatcagataaatatacacgtacagatatatgggagtataaagaggagtagttaggagtggtgccctttggtggatcaagacaaagcgtgggcctcaggagcctattattaacactctttcagacaccagcacaagcccgtaatatatcaacgtggacgcctcagattactatataaaggggggattcgcgccccatggagtctaaaaggtttaaaatcacgcataatatacagagagtgaggtatcggtctgtcacatattacgcagaatgcagggagttcccacaatcaatgcgggcttaaggccacccactacacccattaggcatcagaaagcccgcaagcaaccagagacaaaaacgggccaagcaaatcgtaaccaaacaacgacacaaaccaccacacaaaccgtcataaagacgagaccagcgatacacataagggctatacactaaaacaccacggaacaccaaaaagactccaaagaggggcacaaagggagagcaccaacagggggcaccaaatagcgcga

SEQ ID NO: 672297 - DNA, 113 bp, Homo sapiens
cgaacagtattcccgaagttctcaggatcacgggatatggactggttcgccgagatgcagcaggtaggcggccgcgccttctcacgcggagaactctgtcacgtcgcaggtga

SEQ ID NO: 672298 - DNA, 189 bp, Homo sapiens
aaattcccttatttggccaaatccccccaaaaaccccctttttggggtaaggttccctggggaacccttttccgttttcctgggaaggggtctttcctggggtagggggggaaatgttttaaaaatttttttaaaaaaaaattttttggggcgcccccttttaataaaaaaaaaccttgtttttttgga

SEQ ID NO: 672299 - DNA, 360 bp, Homo sapiens
gacgaccgacgtacgatttctgcaccttcgaagacttcgaagtcgctgtgtggcgagcgtgaagccaaagtgatcaaccgcttggccgtcgatcaacagcatcgccacggctgggcgagtaagctatggcccaacctgttgggcgaaattggtatttaccgggtcagcagccctggcctgaccgaccacaagattgccgtctaatcattttcaagagggacgctcatgagtcgtttggctgtttttctattgactgcactgcttggcgccaacgccatggccgccgacgttatcgaccctaatcgcacgaaggaattcggcgatattacggtgcgctacaacaccttcacctccagcttc

SEQ ID NO: 672300 - DNA, 651 bp, Homo sapiens
gtctgtcttgtcttaatctctagcaaagaagagtgctgcaacagagtatgacttttttctgggtccagaagctgaaactcaaggagttaagagctaactgtgcaaatatttccattgttttcttgataaggccccagtatcatttatttagagtcaagatgtgatgacatatactcttaaaacatcagaggctaacatataaataggatatatctagtagggaagaatgtgtggccattaggaaaaattgaaatgaatgacttgcacttacacatctgttaaggacctggggtcttagtgggtctcagataaatgggaatcggctaagtactgtgactgcaaaacagacatgaatctaacaggtagaatcgggtgaccaatatgagggattctctgctcgactctctagtctcatatagttgggaccctagattgatagaaacctttttaggaggctagacatggtggttcctacctgtaatcctagcactttgggaggccgaggcaggaggatcacttgagctcaggagttcaagaccagcccgggtaacgtgagacccaaatctatcagaaaaaacactcacaaaaaaaattttttgggggccctggcccggaaaagtttttaaacccattgttttggggcgggggcct

SEQ ID NO: 672301 - DNA, 141 bp, Homo sapiens
tcaagggcagccagagcccaaccagcagcctgaggctgcgacgccatctctgaggcccaaggccacagtgaaattcacagaaagcaacacagctgggaaaaggactcgatgtgaagagctaggaatagccaatacccacca

SEQ ID NO: 672302 - DNA, 1425 bp, Homo sapiens
tgatgtgtccctctgctggtgtgtcgctggatcgcctctcgcgtggtcatcctgccgtccgcgggatttatttctcccagaggggcttcctcgcgtgtgcggccgcagtctggggatctacatcccccgccctttttgttgcgccctcggtatatctcgcggggtcgttcccgcgccactccggggggcgcctgtcccccgggggttctccccccaactgtcctggtgagattgtgggtaatgagccgcttcttcctctggtcgcagcttcctcctccctaaggccaccacgtgtggcccaccgaaaccgacacattgttgggcccactggcgccccccccctggggtgtcctgggcccccttgggcttttttacctcctgcggggtgttctcccgtggtcctggctactccggtattgtggggattggacctcagacccccccgtagtcccacggtgccttgtgtggaggccccccggccttctacagggggattgggaaccccttcccacggacatggggcccccctccttgctggggtgcccttttcttgggaggacgggtacccatggagtgatccccccatagccccctggtggccccgcacacagaggggggccatggcccccctaaagcgccccctgctagttcgcctcgggaagatttggggacccccatgtctgcccaccccagcgcccccgctagtcgcccccactttcgctgggggcactttcctttgctcgggccccttgggtctggtccctctgggagaccttgttgggttcacctcgggagacctccttgggttcgccttgcctcggtagaatttttgggaagggaaaaaaagaggctctccacaattatgaacacacacagagggggagagttatcttctccacgggctcgcaccgcctaactcccgtgggtgcacccggacgctctctctgaatggatgaaccactctggttggtcccacgcttgattttttctccctctggggggtggcttcttgtccacaggagtttttttgggctcgcctcccgcgagtcaccacgctgttcttgggcccccgcgaaaggtgggtgacacactgtggattctctgttttttttgtggctcgtggaccacttctttcacaccacctgcctcttcttggcctctgccaagccttcgcctttggcttcgcgctttaggaggggcccggagcttcctttcttcgcttgcttggcacccactgcttatgaacaagggtccacgattatagatttttgactgaagtcactttctaaagtaaagttgccagacccctgtatactagacccctataatacttcatccccccccctcctaagaaataagaacccaccttatcacccccaagaaaattaataattccaactaatatttaacaaaaaaaaaaataaa

SEQ ID NO: 672303 - DNA, 709 bp, Homo sapiens
gactgagcggttgtggccgagttgacgacctccagacagcagtcggcttctctacgcagaacccgggagtaggagcaactcagaatcgaatctcttctccctcccacttcttgtaatcggcttctgtgagaaaccttaccatccaaacacgatggccagcaacgttaccaacaagagagatcctacgctaccatgaggctcccgtgtgtacattgggaatctcaacactcttgtggtcaagaaatctgatgtggaggcgatcgattccgagagtatggcacagattgtgggctagtctgttcataagggctttgccattcgttcagtatgttaatgagagaaatgcccgggctgacctgtagcagtgagaggatggtcagaatgattgctggccgaggtttagatattaacctaggcatgctgtagccaaaagtgacccgaggccacagcacggtgtgaacacgatctgaaagtaggaagcatgtaccgaggtcagtgaacagcaacacgccttctcccggtccccctctactcaggatcctcttagacttggactactgactatgcaacgggactattatgatacggatgtacaggacccagaaagtgtaacaccatcctcctcctattgcacgggctgatgcctcgaaacgtagcgtgtatccgacccactcacaagcgaaatgcataaacaagtgacagggactca

SEQ ID NO: 672304 - DNA, 1814 bp, Homo sapiens
ggaagcatgttcgactctaagtgtcaacaaaacgcgttcaagcctcaacaccctgtacctaaaccatcccatagagcgatatgaaccgtgaactctctctagctagcacccacacttggtgaccaactctttactcagcccatactacgatacgtacacatacaatgtatactgaataacgttgaatcagtgagaagatcaatgtgcgtccctcgcgacactaaagcgctgacggtttcatgagtatgagagacagacatgaaactcgcatgagatctaagcatgcccgctaaatgaatcctgaccacagtgcgaaagctagactagaactccatttgatttgacacctgcgaactcgttctagaagccctacatcgatcacggggctagttgctcgagtccacacgtggacataggcgtgtcagagacatgagatgcttcagcacatgtgagacgtcttgcgtggaaattctatagcgccacggcacttgattggatcgcgaaatataaccaattcatcgcgtctatgcaatcatccaaggtgaatttatgcatgtgacgaacgcaggacgtggcccttgagatgaaccaccaagtgttttacaacgtgcctcggcggtttagcgcctaaagcccgcgtgtccacaaaggcgattaggctactgacgatcgtcctggtgttcaccgttctaaacagtcagggaggcacctttggttattcgcaggattgggacctcccggactggggagtgcgattcccataccccctgggtcgctcgtctaactttgtttctcagaccccagggtgaattaccatctggaacacattggagccacttgctagaaacacttgaaggtgtcctgcgtgtgcagtggaacccatccaccgttatacggagaccgggaaatcagagtgcacggcccccttagggtggggcactggccgttttgcaaacattctatgagtctaacggattcggtcgccccacccaggataaagcggcgttacaagcgaagagaatcggcgacgaagccaagagggatccgcttaagagaacgtaaaccccaaaaaaaacccttagaggcagatattggaaaacataacttttgttccccgagtctcttgggggtgggcccggaaccccctttcggcggcacttcggatgagaaaaacctcatagaatcccttacgccggtaaatgcccatgttggacccataagcttaaaaaagaaactgttgaccacccacagagggtccctaataaaaggcaaggaaacacttaaacttaatttactttccaacatttggattccccaacatgaaagcttttggaacccaataccggaaacaaacagtataacccctaaggggggaactacaaccaggctgtcccaaaatcctatatattactataaggaagagtccccagtaattccaaagagaggcgtaggccggcatatacaagaaacccattcgcaaattgttttagaacaatcccaggagacaatctcccacgaagttggttgtgataccagccatatttaaaaagagaatcgggaaaatgatcacaacgaacagttagagaagcacccacagtgcgaacagaaacaatcaacaacccacggaaggtagacacacgagacaggatacatataaatatacatcaacaaagcatccacgtcgtacgaaagacgcacaaaacataagaccaccagacatatagactgctcccacgcacagtaaaatacttcactccgtaataaatcgatccacccagacgatgatgtgttaaaaccgaaacacataatacggt

SEQ ID NO: 672305 - DNA, 143 bp, Homo sapiens
ccgcgccagcttatctctggtcgttccagagacacctgctggctgtcttgggatgcgcccagccgtttgacgtggccactaccccagtgaagttctgccattcactggacatgatgctgaggacactgggcttcaacactgag

SEQ ID NO: 672306 - DNA, 303 bp, Homo sapiens
  misc_feature (43)..(43): n is a, c, g, or t
  misc_feature (187)..(187): n is a, c, g, or t
  misc_feature (252)..(252): n is a, c, g, or t
cagaaatcccagccaccttggaagctgaggtgtgaaaaatttnttgagcccaggagttcgaggctgcagtgagctatgatggcaccactgtactccaggctgggcaacagagagaccgcgtcttaaaaataaataaaaggccaggcaaggtggctcacacctataatcccagcactttgggaggctnaggcgggtggttcatctgaggtcaggagttcaagaccagcctggccaacatggtgaaaccctgtntctactaaaatacaaaaattagccagggatgattggttgggtgcctgtaat

SEQ ID NO: 672307 - DNA, 675 bp, Homo sapiens
ggacctgagtgctccactggcgacttgttgagtgggtcagtggagtggcctggcaaggggaggcaggagggtggcctggacctccccactacctcctgcagactttgagaagcccacagtggagacatccaccaccccagccatggtgccatactgtggtgtgtcctgacctgctgcccggctggaactggtggtgtgctcgtgcagtgctgaaggagcctgggaagggatgggagtgatacatggcaagcacatgtcttgagagaggtggcttggagccccggcacagatgactgaactgctgggtgtcccttcctgtggaccaagatggagaagtgtgttcctaagtggaggagacatgaaggaggcttgccgaatggctctgtgtggtgtcatcaccactctgcatcagctgcccttccaatggagcttctgcttgcttgctccatcctcccagacccctgtgcccaattcctcccctgcagatctgagagaggcaaaggtaatgttgcactgtgggcacattgacaggacacggaggaccacctcatcacagggttccctgcatggggatctgtaaagagaaaagtttctgcacccaccagagcaagagccaactgaaagcgtagacctgaaagaggtactcagccccttcctgctcctctgcctcatcag

SEQ ID NO: 672308 - DNA, 201 bp, Homo sapiens
gccaattttttgtattttcagtggaggcggggtttcgccatgttggccggacgtggtggtgtgtgcctgcaatcccagccacttgggcggttgaggcaggagaatcgcttgaacctgggaggtggaggttgcattgagccgagatggcgccactgcactccagcctgggtgacagagggaaactccgtctaaaaaaaaaaa

SEQ ID NO: 672309 - DNA, 127 bp, Homo sapiens
  misc_feature (19)..(19): n is a, c, g, or t
acgctgcacctggtgtcanattgctttgtactccatctgcctgtcgcagactgcccaccctgctgcaagaatacgtgcgtggagctggggatttggaattgtgccgggtgcggccatctatcgcaat

SEQ ID NO: 672310 - DNA, 2682 bp, Homo sapiens
agtgggcggttcggcggctctgggcgctgttgtttggtctttaggcctgcggaggggcgttatctggagggccgcgggtgcaggccgcagtgacagggccgctcgccccgctagtcctgcctgtctcccggtgcagctgtgttcgcggcctgcaggcccaacatggcgcaggaggtgtcggagtacctgagccagaacccgcgggtggcagcctgggtggaggcgctgcgctgcgacggcgagactgacaaacactggcgccaccgccgggattttttgcttcgcaacgccggggacctggcccccgctggcggcgctgcctccgctagcacggatgaagctgccgacgccgagagcgggacccgaaaccggcagctgcagcagctcatctccttttccatggcctgggcgaaccacgtcttcctcgggtgccgataccctcaaaaagttatggataaaatacttagtatggctgaaggcatcaaagtgacagatgctccaacctatacaacaagagatgaactggttgccaaggtgaagaaaagagggatatcgagtagcaatgaaggggtagaagagccatccaaaaaacgagttatagaaggaaaaaacagttctgcagttgagcaagatcacgcaaaaacctctgccaagacagaacgtgcatcagctcagcaggaaaacagttcaacgtgtatagggtcggccatcaaatcagagagtgggaactcagctcggagctctggcatctccagtcagaatagctctacaagtgatggagatcgatctgtttccagccaaagcagcagcagcgtttcctctcaggtaacaacggcaggatctgggaaagcttctgaagcagaagctccagataaacacggttctgcatcatttgtttccttgctgaaatccagtgtgaatagtcacatgacccaatccactgattctagacaacaaagtggatcacctaaaaagagtgctttggaaggctcttcagcctcagcttctcaaagcagctcagagatcgaggtgcccttgttgggctcctcaggaagctcagaggtagaattgccactattgtcttccaaacctagttcagagacagcttcaagtgggttaacttccaaaactagttcagaggcaagtgtttcatcatcagttgctaaaaacagttcctcatcaggcacatccttactgactcccaagagcagctcttcaacaaatacatcgctgctaacttccaagagcacttcccaggtagctgcatcactactagcttccaagagcagctcccagaccagtggatctctggtttccaaaagcacttccttagcaagtgtgtcccagttggcttctaagagtagttctcagactagcacctcacagttgccttctaaaagtacttcacagtcaagtgagagttctgtcaaattctcttgcaagttaaccaatgaagatgtgaaacagaagcaaccttttttcaatagactatataaaacggtggcatggaagttggtagctgttggtggctttagtcccaatgtgaatcatggagagctcctaaatgcagctattgaggctctgaaagcaacactggatgtattttttgtcccactaaaagaattggcagatctgcctcaaaataagagctctcaagaaagtattgtttgtgaattgaggtgcaagtctgtgtatttgggcactggctgtggaaaaagcaaagaaaatgcaaaagcagttgcatcaagagaagcattgaagttatttctcaagaaaaaggtggtggtaaaaatatgtaaaaggaaatacagaggcagtgaaatagaagatctagtactccttgatgaagaatcgaggcctgtaaacttacctccagcactaaaacatcctcaagaattactataatgtgtccaaaatatcactgcatacaatatctggtatttgaagagaaaaactgacttttgtatagtataaaacacaggctttcacaaattttgtattgctttttttccagttttgcagaaaatttacattctagttctcttcacacagtagcagttgtaaataatttatgaatgacagtacacattaaaaggtatgcattagcagcatattagtatgctgttttatttgctgaagaaaatactgtcttctatttttaatgatacattaggtacgatgtgtagttcggtagagtcctaaaatttttgtactactttcaatttggtgaaaatgtattaagttgtctaccatgttttcttttctagctgaataaaccacatcaaaggaaagggaccacagtatttgaatgtttgaaagtctgtaaagcttaaggttttaaaaatgttgcccgtaatgttgaacgtgtctgttaaaaaataaaagaaaaaatagttgcttcaaactatttttatgagaagttgtaagcattttttagatataaagcagtataaagtacttgttattttactctgaagttgtttaaaattcaccatgactttgaccgctgaagattctttaagcgggttaatttatgttttgaggtggaatacaatttacacttttttcttaaaaacatgaatgtgggtttctatattaagcatattttgtgactactattaacagattgatttgtttagatattaaatgctttaagctattttaccttttcaaaaaaaaaaa

SEQ ID NO: 672311 - DNA, 2651 bp, Homo sapiens
agtgggcggttcggcggctctgggcgctgttgtttggtctttaggcctgcggaggggcgttatctggagggccgcgggtgcaggccgcagtgacagggccgctcgccccgctagtcctgcctgtctcccggtgcagctgtgttcgcggcctgcaggcccaacatggcgcaggaggtgtcggagtacctgagccagaacccgcgggtggcagcctgggtggaggcgctgcgctgcgacggcgagactgacaaacactggcgccaccgccgggattttttgcttcgcaacgccggggacctggcccccgctggcggcgctgcctccgctagcacggatgaagctgccgacgccgagagcgggacccgaaaccggcagctgcagcagctcatctccttttccatggcctgggcgaaccacgtcttcctcgggtgccgataccctcaaaaagttatggataaaatacttagtatggctgaaggcatcaaagtgacagatgctccaacctatacaacaagagatgaactggttgccaagaaggggtagaagagccatccaaaaaacgagttatagaaggaaaaaacagttctgcagttgagcaagatcacgcaaaaacctctgccaagacagaacgtgcatcagctcagcaggaaaacagttcaacgtgtatagggtcggccatcaaatcagagagtgggaactcagctcggagctctggcatctccagtcagaatagctctacaagtgatggagatcgatctgtttccagccaaagcagcagcagcgtttcctctcaggtaacaacggcaggatctgggaaagcttctgaagcagaagctccagataaacacggttctgcatcatttgtttccttgctgaaatccagtgtgaatagtcacatgacccaatccactgattctagacaacaaagtggatcacctaaaaagagtgctttggaaggctcttcagcctcagcttctcaaagcagctcagagatcgaggtgcccttgttgggctcctcaggaagctcagaggtagaattgccactattgtcttccaaacctagttcagagacagcttcaagtgggttaacttccaaaactagttcagaggcaagtgtttcatcatcagttgctaaaaacagttcctcatcaggcacatccttactgactcccaagagcagctcttcaacaaatacatcgctgctaacttccaagagcacttcccaggtagctgcatcactactagcttccaagagcagctcccagaccagtggatctctggtttccaaaagcacttccttagcaagtgtgtcccagttggcttctaagagtagttctcagactagcacctcacagttgccttctaaaagtacttcacagtcaagtgagagttctgtcaaattctcttgcaagttaaccaatgaagatgtgaaacagaagcaaccttttttcaatagactatataaaacggtggcatggaagttggtagctgttggtggctttagtcccaatgtgaatcatggagagctcctaaatgcagctattgaggctctgaaagcaacactggatgtattttttgtcccactaaaagaattggcagatctgcctcaaaataagagctctcaagaaagtattgtttgtgaattgaggtgcaagtctgtgtatttgggcactggctgtggaaaaagcaaagaaaatgcaaaagcagttgcatcaagagaagcattgaagttatttctcaagaaaaaggtggtggtaaaaatatgtaaaaggaaatacagaggcagtgaaatagaagatctagtactccttgatgaagaatcgaggcctgtaaacttacctccagcactaaaacatcctcaagaattactataatgtgtccaaaatatcactgcatacaatatctggtatttgaagagaaaaactgacttttgtatagtataaaacacaggctttcacaaattttgtattgctttttttccagttttgcagaaaatttacattctagttctcttcacacagtagcagttgtaaataatttatgaatgacagtacacattaaaaggtatgcattagcagcatattagtatgctgttttatttgctgaagaaaatactgtcttctatttttaatgatacattaggtacgatgtgtagttcggtagagtcctaaaatttttgtactactttcaatttggtgaaaatgtattaagttgtctaccatgttttcttttctagctgaataaaccacatcaaaggaaagggaccacagtatttgaatgtttgaaagtctgtaaagcttaaggttttaaaaatgttgcccgtaatgttgaacgtgtctgttaaaaaataaaagaaaaaatagttgcttcaaactatttttatgagaagttgtaagcattttttagatataaagcagtataaagtacttgttattttactctgaagttgtttaaaattcaccatgactttgaccgctgaagattctttaagcgggttaatttatgttttgaggtggaatacaatttacacttttttcttaaaaacatgaatgtgggtttctatattaagcatattttgtgactactattaacagattgatttgtttagatattaaatgctttaagctattttaccttttcaaaaaaaaaaa

SEQ ID NO: 672312 - DNA, 250 bp, Homo sapiens
  misc_feature (72)..(72): n is a, c, g, or t
catcttatgctggctctcggctctgcgcgtcgttactacagtgacacaggctcacagtaaacaccagtatgnaggtaatacaacttctgcatccagacccagttcaagcgaccttttaacacctttagtgactatggggtgtcagtcacatttatcacgggctcaactgcaacaaaacacttccttgacagctccacaaactcagtgcacagtgaggaatcaacagtatcccattatgcggcccaggtgc

SEQ ID NO: 672313 - DNA, 110 bp, Homo sapiens
aatatgacacttgtaaatagttgtttcaaaatgaacagcgaagccttaactttaaatgacattgtattctcagacactgagtagcataaaaaccacatagaaaatatctg

SEQ ID NO: 672314 - DNA, 2618 bp, Homo sapiens
agtgggcggttcggcggctctgggcgctgttgtttggtctttaggcctgcggaggggcgttatctggagggccgcgggtgcaggccgcagtgacagggccgctcgccccgctagtcctgcctgtctcccggtgcagctgtgttcgcggcctgcaggcccaacatggcgcaggaggtgtcggagtacctgagccagaacccgcgggtggcagcctgggtggaggcgctgcgctgcgacggcgagactgacaaacactggcgccaccgccgggattttttgcttcgcaacgccggggacctggcccccgctggcggcgctgcctccgctagcacggatgaagctgccgacgccgagagcgggacccgaaaccggcagctgcagcagctcatctccttttccatggcctgggcgaaccacgtcttcctcgggtgccgataccctcaaaaagttatggataaaatacttagtatggctgaaggcatcaaagtgacagatgctccaacctatacaacaagagatgaactggttgccaagaaggggtagaagagccatccaaaaaacgagttatagaaggaaaaaacagttctgcagttgagcaagatcacgcaaaaacctctgccaagacagaacgtgcatcagctcagcaggaaaacagttcaacgtgtatagggtcggccatcaaatcagagagtgggaactcagctcggagctctggcatctccagtcagaatagctctacaagtgatggagatcgatctgtttccagccaaagcagcagcagcgtttcctctcaggtaacaacggcaggatctgggaaagcttctgaagcagaagctccagataaacacggttctgcatcatttgtttccttgctgaaatccagtgtgaatagtcacatgacccaatccactgattctagacaacaaagtggatcacctaaaaagagtgctttggaaggctcttcagcctcagcttctcaaagcagctcagagatcgaggtgcccttgttgggctcctcaggaagctcagaggtagaattgccactattgtcttccaaacctagttcagagacagcttcaagtgggttaacttccaaaactagttcagaggcaagtgtttcatcatcagttgctaaaaacagttcctcatcaggcacatccttactgactcccaagagcagctcttcaacaaatacatcgctgctaacttccaagagcacttcccaggtagctgcatcactactagcttccaagagcagctcccagaccagtggatctctggtttccaaaagcacttccttagcaagtgtgtcccagttggcttctaagagtagttctcagactagcacctcacagttgccttctaaaagtacttcacagtcaagtgagagttctgtcaaattctcttgcaagttaaccaatgaagatgtgaaacagaagcaaccttttttcaatagactatataaaacggtggcatggaagttggtagctgttggtggctttagtcccaatgtgaatcatggagagctcctaaatgcagctattgaggctctgaaagcaacactggatgtattttttgtcccactaaaagaattggcagatctgcctcaaaataagagctctcaagaaagtattgtttgtgaattgaggtgcaagtctgtgtatttgggcactggctgtggaaaaagcaaagaaaatgcaaaagcagttgcatcaagagaagcattgaagttatttctcaagaaaaaggtggtggtaaaaatatgtaaaaggaaatacagaggcagtgaaatagaagatctagtactccttgatgaagaatcgaggcctgtaaacttacctccagcactaaaacatcctcaagaattactataatgtgtccaaaatatcactgcatacaatatctggtatttgaagagaaaaactgacttttgtattgctttttttccagttttgcagaaaatttacattctagttctcttcacacagtagcagttgtaaataatttatgaatgacagtacacattaaaaggtatgcattagcagcatattagtatgctgttttatttgctgaagaaaatactgtcttctatttttaatgatacattaggtacgatgtgtagttcggtagagtcctaaaatttttgtactactttcaatttggtgaaaatgtattaagttgtctaccatgttttcttttctagctgaataaaccacatcaaaggaaagggaccacagtatttgaatgtttgaaagtctgtaaagcttaaggttttaaaaatgttgcccgtaatgttgaacgtgtctgttaaaaaataaaagaaaaaatagttgcttcaaactatttttatgagaagttgtaagcattttttagatataaagcagtataaagtacttgttattttactctgaagttgtttaaaattcaccatgactttgaccgctgaagattctttaagcgggttaatttatgttttgaggtggaatacaatttacacttttttcttaaaaacatgaatgtgggtttctatattaagcatattttgtgactactattaacagattgatttgtttagatattaaatgctttaagctattttaccttttcaaaaaaaaaaa

SEQ ID NO: 672315 - DNA, 254 bp, Homo sapiens
gcggggcggcctcccagatagggacgcattcgctaagtccgaggcggctgctcacctcactgagcccggctggacgtgggaccaccggtcgccgcgcccagggaaccaccaaggattcaagcggagcttacggccagcagtttctgcccgggccaacgcccgttccgggtagccgcgcgcaggccacttccggcagcggtgcaccatgggactgcagttcctggcaaaggttgagtcccgggcgtggcggcccc

SEQ ID NO: 672316 - DNA, 2534 bp, Homo sapiens
agtgggcggttcggcggctctgggcgctgttgtttggtctttaggcctgcggaggggcgttatctggagggccgcgggtgcaggccgcagtgacagggccgctcgccccgctagtcctgcctgtctcccggtgcagctgtgttcgcggcctgcaggcccaacatggcgcaggaggtgtcggagtacctgagccagaacccgcgggtggcagcctgggtggaggcgctgcgctgcgacggcgagactgacaaacactggcgccaccgccgggattttttgcttcgcaacgccggggacctggcccccgctggcggcgctgcctccgctagcacggatgaagctgccgacgccgagagcgggacccgaaaccggcagctgcagcagctcatctccttttccatggcctgggcgaaccacgtcttcctcgggtgccgataccctcaaaaagttatggataaaatacttagtatggctgaaggcatcaaagtgacagatgctccaacctatacaacaagagatgaactggttgccaagaaggggtagaagagccatccaaaaaacgagttatagaaggaaaaaacagttctgcagttgagcaagatcacgcaaaaacctctgccaagacagaacgtgcatcagctcagcaggaaaacagttcaacgtgtatagggtcggccatcaaatcagagagtgggaactcagctcggagctctggcatctccagtcagaatagctctacaagtgatggagatcgatctgtttccagccaaagcagcagcagcgtttcctctcaggtaacaacggcaggatctgggaaagcttctgaagcagaagctccagataaacacggttctgcatcatttgtttccttgctgaaatccagtgtgaatagtcacatgacccaatccactgattctagacaacaaagtggatcacctaaaaagagtgctttggaaggctcttcagcctcagcttctcaaagcagctcagagatcgaggtgcccttgttgggctcctcaggaagctcagaggtagaattgccactattgtcttccaaacctagttcagagacagcttcaagtgggttaacttccaaaactagttcagaggcaagtgtttcatcatcagttgctaaaaacagttcctcatcaggcacatccttactgactcccaagagcagctcttcaacaaatacatcgctgctaacttccaagagcacttcccaggtagctgcatcactactagcttccaagagcagctcccagaccagtggatctctggtttccaaaagcacttccttagcaagtgtgtcccagttggcttctaagagtagttctcagactagcacctcacagttgccttctaaaagtacttcacagtcaagtgagagttctgtcaaattctcttgcaagttaaccaatgaagatgtgaaacagaagcaaccttttttcaatagactatataaaacggtggcatggaagttggtagctgttggtggctttagtcccaatgtgaatcatggagagctcctaaatgcagctattgaggctctgaaagcaacactggatgtattttttgtcccactaaaagaattggcagatctgcctcaaaataagagctctcaagaaagtattgtttgtgaattgaggtgcaagtctgtgtatttgggcactggctgtggaaaaagcaaagaaaatgcaaaagcagttgcatcaagagaagcattgaagttatttctcaagaaaaaggtggtggtaaaaatatgtaaaaggaaatacagaggcagtgaaatagaagatctagtactccttgatgaagaatcgaggcctgtaaacttacctccagcactaaaacatcctcaagaattactataatgtgtccaaaatatcactgcatacaatatctggtatttgaagagaaaaactgacttttgtatagtataaaacacaggctttcacaaattttgtattgctttttttccagttttgcagaaaatactgtcttctatttttaatgatacattaggtacgatgtgtagttcggtagagtcctaaaatttttgtactactttcaatttggtgaaaatgtattaagttgtctaccatgttttcttttctagctgaataaaccacatcaaaggaaagggaccacagtatttgaatgtttgaaagtctgtaaagcttaaggttttaaaaatgttgcccgtaatgttgaacgtgtctgttaaaaaataaaagaaaaaatagttgcttcaaactatttttatgagaagttgtaagcattttttagatataaagcagtataaagtacttgttattttactctgaagttgtttaaaattcaccatgactttgaccgctgaagattctttaagcgggttaatttatgttttgaggtggaatacaatttacacttttttcttaaaaacatgaatgtgggtttctatattaagcatattttgtgactactattaacagattgatttgtttagatattaaatgctttaagctattttaccttttcaaaaaaaaaaa

SEQ ID NO: 672317 - DNA, 209 bp, Homo sapiens
aaggtgggatccgcaagatgatgggatggagtttgaggtgaacatacatgttccaggcacctgacttgcaggctgacatcatctgcatcacggggcctagctggaaatttgggacccgggacaaggctggacttgctggagcgtgtgaaggagctacaggcccgagcaggaggaccgggctttaaaggagttttaaggctgagtggcac

SEQ ID NO: 672318 - DNA, 1211 bp, Homo sapiens
agtgggcggttcggcggctctgggcgctgttgtttggtctttaggcctgcggaggggcgttatctggagggccgcgggtgcaggccgcagtgacagggccgctcgccccgctagtcctgcctgtctcccggtgcagctgtgttcgcggcctgcaggcccaacatggcgcaggaggtgtcggagtacctgagccagaacccgcgggtggcagcctgggtggaggcgctgcgctgcgacggcgagactgacaaacactggcgccaccgccgggattttttgcttcgcaacgccggggacctggcccccgctggcggcgctgcctccgctagcacggatgaagctgccgacgccgagagcgggacccgaaaccggcagctgcagcagctcatctccttttccatggcctgggcgaaccacgtcttcctcgggtgccgataccctcaaaaagttatggataaaatacttagtatggctgaaggcatcaaagtgacagatgctccaacctatacaacaagagatgaactggttgccaagaaggggtagaagagccatccaaaaaacgagttatagaaggaaaaaacagttctgcagttgagcaagatcacgcaaaaacctctgccaagacagaacgtgcatcagctcagcaggaaaacagttcaacgtgtatagggtcggccatcaaatcagagagtgggaactcagctcggagctctggcatctccagtcagaatagctctacaagtgatggagatcgatctgtttccagccaaagcagcagcagcgtttcctctcagagctgaataaaccacatcaaaggaaagggaccacagtatttgaatgtttgaaagtctgtaaagcttaaggttttaaaaatgttgcccgtaatgttgaacgtgtctgttaaaaaataaaagaaaaaatagttgcttcaaactatttttatgagaagttgtaagcattttttagatataaagcagtataaagtacttgttattttactctgaagttgtttaaaattcaccatgactttgaccgctgaagattctttaagcgggttaatttatgttttgaggtggaatacaatttacacttttttcttaaaaacatgaatgtgggtttctatattaagcatattttgtgactactattaacagattgatttgtttagatattaaatgctttaagctattttaccttttcaaaaaaaaaaa

SEQ ID NO: 672319 - DNA, 388 bp, Homo sapiens
cccaacacttttaaatttattagcaatatatcttttctgttgtggggtttgttttagtatgttttgtttttggtagatacagggtgtccctatgttaaccaggtggtttcgaacccctgggcccgagcaatccttctgccttggccccccaaagtaacaatactatctttgaaacatacaatggccaggcatggtggctcatgcctataatcccaggacttcggggggccaaggcaggagggttgatcgagccctggagtgtaaaaccagcctaggaaggctcaacataggaagatcccatctccacaaaaatacaaaaattatgggaggtcgcccaacactttttaaattttattagcaatattatcttttctgtgttgggcgataa

SEQ ID NO: 672320 - DNA, 150 bp, Homo sapiens
gtgtgtgtgctcatgtacccgtgctcatctgtgttgtgcatgtgggtgtgtgtgtacctgcatgcacacacatgcaggtacacacacacagacccgcatgcacacacatgcagggacagacacagatgagcacgggtacacacgcacaca

SEQ ID NO: 672321 - DNA, 477 bp, Homo sapiens
agggtttgatatttttattaaaactgaaaatacccatctccaaatggggaaaaaaattatatactgttaatgttaaaaacaaagttgattccaaccttttgagacataaacacaagcatgaggattatggacagaaacaaatccgtattccaggaacatccgttgattatcgggagggccgtaacaaatgaataccttttaatgctttctccaacgtgaaggcgttctaatttcgaaagaatgagtttctttattaaacgctgcttttacctggacatgtgggctatgatttaacaggtccaggtacggagcgagtgcacaggtgtacggctctgcagaaaggcattcccgctgcctgggcctcaagtacaccggtctggtgttgactgaacaccaagcccacaccagggcacttgtaccttaagatgctgacaacagctcttcccaaacagaggctggagaaaaaaaaaaaagatc

SEQ ID NO: 672322 - DNA, 659 bp, Homo sapiens
tgaggtgatctagaggatctcatgtagtcgctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgg

SEQ ID NO: 672323 - DNA, 653 bp, Homo sapiens
gcggccgcctactactactaaattcgcggccgcgtcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgg

SEQ ID NO: 672324 - DNA, 446 bp, Homo sapiens
  misc_feature (126)..(127): n is a, c, g, or t
  misc_feature (131)..(131): n is a, c, g, or t
  misc_feature (237)..(237): n is a, c, g, or t
  misc_feature (253)..(253): n is a, c, g, or t
  misc_feature (271)..(271): n is a, c, g, or t
  misc_feature (277)..(277): n is a, c, g, or t
  misc_feature (326)..(326): n is a, c, g, or t
  misc_feature (341)..(341): n is a, c, g, or t
cgttccacccggttactacacagatcaaagacgcccgtcggcttacttcgtcgttccgttcgtcgtccttaatgacagttaacacgtagtctcaccagacgtctctaggcgacccagacaattatnncctngccaaccccttaaacacccctccccacatcaagcccgaatgatatttcctattcgcctacacaattctccgatccgtccctaacaaactaggaggcgtccttgccntattactatccatccncatcctagcaataatccncatccnccatatatccaaacaacaagcataatatttcgccactaagcaatcactntattgactctagcgnagactctcattctacctgatcggagacacagtagctacctttacatcatggacagtagcatcgtactatactcacacatctatctatacactatctcctattgaa

SEQ ID NO: 672325 - DNA, 115 bp, Homo sapiens
ccccggccgccacaggcttctccatctggtcagcattcatcacatgtgatgcgttgcgaggaggcttgtatgggcatctcaatctcagagagtgtcagatttattcacttattat

SEQ ID NO: 672326 - DNA, 162 bp, Homo sapiens
ccatgtggggcttcactgaatatatctaaccagaattacaatatcaggagatgggtgagaggaagtaaattcagggggggcaggaggaagagaggattcaaaagataagggtggccgggtgcagtggctcacacctataatcccagcaggccgaggcgggca

SEQ ID NO: 672327 - DNA, 690 bp, Homo sapiens
gtaaaaggcataggacgagccgtgtggaatcggacgaggcctctctctctctctctctctctctctctctctcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgg

SEQ ID NO: 672328 - DNA, 777 bp, Homo sapiens
tgaggtgatctagaggatctcatgtagtcgctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgaaaaaaaaaaaacacaacaagaatggctaatggcattgctaagggagataaatcaggggggtaacagcggagggaacggggacaatataggtgggaaccttgcgagggaataaggg

SEQ ID NO: 672329 - DNA, 278 bp, Homo sapiens
ggggggggttttcttttttttcccctcccgggccttttccccccggtttatattttgcctttccctttaaaaaaacccccccccctttcccttttccccgggtgggggggcccttggggaaataaaggttccccttgggggggtgggggtttacccccccccccgttccccccctttttcccccccccgggggggggcctcccccgcccccccccccccccggttttttcccttggggggggggggggggggggggcccttttaaaccccccctttta

SEQ ID NO: 672330 - DNA, 914 bp, Homo sapiens
  misc_feature (692)..(692): n is a, c, g, or t
  misc_feature (694)..(694): n is a, c, g, or t
  misc_feature (914)..(914): n is a, c, g, or t
tgaggtgatctagaggatctcatgtagtcgctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgaaaaaaaaacaaacaaaaacatcccacaaancnccccacaaccaccaaaccccgcagcaacgacccgagggcagcacagaagccgggaggggggcacaaacaaggaggaacaagacacacgacagcacggtcccagacaaagcgagagcagccacaccaagattcacgtacaacaaagagagtagaacccgagcagcaccaccaaaggagagccaagcaacacgaaagagccgagaacgcaccgggaaaaccn

SEQ ID NO: 672331 - DNA, 402 bp, Homo sapiens
tgaccctgggcggggaccgcgcacgggacggtggatggctgagtgcagcctgctgcaattcctctcttctcgggggaggaagcctaggagctggaatcagaaacacctgttagaacctgagctctgtcactctctcacttgtgcctggtgccagctccctttccctctctttgcctttgcttcctctctggaagaatgaagcatgcacgcatcaacccatctgcacggggagccgattcacagattcacatgagggaatgctttgaaaatatttccacacattgtaatgttcaaatatatgtgtgaggtaatccatcatcaattcactcaacaaacatatggttagtactattctaaggtgatgtgtgttcctaaaagtcacccttgttacacaaaatcaca

SEQ ID NO: 672332 - DNA, 843 bp, Homo sapiens
tgaggtgatctagaggatctcatgtagtcgctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggaaaaaaaaaaacaacaacacagaacaccaacacaaccgcgaggcacaacaaagggccagaaaaagaagcaacaaaagagacaaagggaaaacagaccaggagaacaatatacgcaaaaacggacaaaaaggcggacccccaaagagagcacaaaaaaacacagaacacgggaaacacggaacaa

SEQ ID NO: 672333 - DNA, 80 bp, Homo sapiens
  misc_feature (47)..(47): n is a, c, g, or t
aatctcaaaagcccgtttattgtaacaagaattgttatgtattaatnctgcagttttcaataaagattgacttgtgttgc

SEQ ID NO: 672334 - DNA, 1004 bp, Homo sapiens
  misc_feature (450)..(450): n is a, c, g, or t
  misc_feature (806)..(806): n is a, c, g, or t
gtcagtgactcggagagtcatctcccgagaagagccagctccgcgtgtcgccccagcaggccttcaggaggcagagcaaacaccctgagtcacttccccatcgaatgccaggaacctccagcaacctgcccggtgggtccccggggggtttctgcaaacgagaaactgttatgagggtatcactcagttgagcatcagagtacgcctcctatgaagcgaacatggactttgaaatccaaagcaaaccagtcttggttgattctggtgggactccttgttgaatgacccggaggcattcgctggagtgccagcatgatattcctccgcagatagctcagccccggacatgacatggcagtgccgactctctgtccaagccaagactaattgaaccgattagttcaggagcattggtgacgaagctatccgcctcgatctgactctcctttntagggaatccaatcgatttggttgaattgatcgaggcccgttatgagttcgcgcctcgacgcaggatggaagaaggaacaaggacacttcatcgtgcagctcccgagagctagtgtgaccaaaagggcgtactacttccaatcgatgatgactggcttgctttacgaactggtgaggacacgtgaacatatccacgacagctccaaggcctcttgaaattattgactttgctggagacaaatgcgcccttgaaccctcgaatgtaattgcatacgaaaattacctcccctggttcttgaaaggaaaagttacatctaacccgctggtggggcactacaggatgctttagcccactnccagcggaatgatgcaaatacatttaagctttggaacacttgcaaaacaccattgccactcgggctggtttggggcagactgtgttgcgcaccgttcagtcacccgagggtgaaatcttcggacaatttcttagcctgagccaaattccacccttaaacaccaagatcccgaggcacaacaggcacgccacaaggatg

SEQ ID NO: 672335 - DNA, 385 bp, Homo sapiens
  misc_feature (1)..(1): n is a, c, g, or t
  misc_feature (52)..(52): n is a, c, g, or t
  misc_feature (150)..(151): n is a, c, g, or t
  misc_feature (265)..(265): n is a, c, g, or t
  misc_feature (267)..(267): n is a, c, g, or t
  misc_feature (269)..(269): n is a, c, g, or t
  misc_feature (283)..(283): n is a, c, g, or t
  misc_feature (295)..(295): n is a, c, g, or t
  misc_feature (362)..(362): n is a, c, g, or t
  misc_feature (382)..(382): n is a, c, g, or t
natctgaagtgggagctgccaggctcatcggcgaggatcgcagtcagcaganagcggctgaggctgggggtaggagcagacctgcgaatctggaggcagcatgtccaagaaagggagtggaggtgcagcgaaggacccaggggcagacannctatgggaaatactacattcgcatttagaaagtctggaagctgcaggaagatgttgagaagacagtgaaaggcacgaggcacacattggcacatggtgtcacaaggctggtgtnangngaggggctgggggncctccctcctcngcactgaaggctgtgaggagggcaaatcaagtcgtctctggggagcctcgggtttccctgtccttcnaactgggtaataataaatanctg

SEQ ID NO: 672336 - DNA, 740 bp, Homo sapiens
tgaggtgatctagaggatctcatgtagtcgctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtggaccacaccacaccacacacaaaaaaaaaagccccgaaaaacccccccatggggccccaaaaaaccacttggccggaaa

SEQ ID NO: 672337 - DNA, 690 bp, Homo sapiens
tgaggtgatctagaggatctcatgtagtcgctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtggattttaaaaaaaaatacgtggagcttgt

SEQ ID NO: 672338 - DNA, 116 bp, Homo sapiens
gctgcggtgcactcacagctaccctccttggctagctgtctccacgagtggctgggggtctcctgcctctcctggtgtcgccgcatggctccacgccaattgcacatgggtccgca

SEQ ID NO: 672339 - DNA, 811 bp, Homo sapiens
tgaggtgatctagaggatctcatgtagtcgctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggaaaaaaaaaaaaaaaaaaaaaaaaaaaaaaaaaaaaaaaaaggggggtttttttgggggggggggaaaaaaggtttaaagggaggggtaatgttttggcccctttttggaagggggaaacggggcccaaagggggaaaagaagcgggtcgaa

SEQ ID NO: 672340 - DNA, 1047 bp, Homo sapiens
tgaggtgatctagaggatctcatgtagtcgctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggaaaaaaaaaaaaaaaaaaaattgggggggaaaatgggggaaattaacgatggagcgtgacacaccaaatagccacggccactttgcacgcgcagaagaggggcccgcgagggcgaaccatggcaggaaaaagctccggggaaatcaaaaaactggcgtgggataagagacacagggaggttcatggggggcccctcattgaagaagcccctacgggatagtacatcaggggacccttgagggagcgatagagtaagacatgtgtcgcgaatttgcaccgagcacggtcaacgagcaatgtactcccttagacaagaacaggaggcttataaagaacgcacagcgaaagtggtgcccattaagaaatagagcggttatttgtcgcactg

SEQ ID NO: 672341 - DNA, 204 bp, Homo sapiens
tgcgcaagcagtgggcactgatacactataagtattgttattgtctatttccctgtcagactttttcttttttggaaatggagtttggctcttgtggcccaggctggagtgcaagggcatgatctgggttcatggaacctccgcctcccaggttcaagtgattctcctgcctcaccctccctagtagctgggataacggttttt

SEQ ID NO: 672342 - DNA, 344 bp, Homo sapiens
gcagatgttgacatcaaaggacccaaaacggacatggatggcccagaggtggatgtacataggcgcagagaggcaccgaagaagcccaatatgacaaggcgcaagtacagcgatgccgggcatcaaagcagaggggcgcagaagtggatgtgaacttgtccacggctagatgttgttgtcatcaggacccaaggtggatgtggaagtcccagatgtgagccttgaaggtccagaagggaagctgaggggactccaagcttaagatgcctgagatgcacttcataggctcgccaagatctctatgcctgtagtgtggactagagtgggcggtgtatcctcttaca

SEQ ID NO: 672343 - DNA, 371 bp, Homo sapiens
actgttcttttttgtctgagagaggttgcatattgcccaggctggtctcgaactcctgtggctcaagtggatccacctacctccacctctcaaagtgctgggactacaatgcgtgagcctgagagacaatggtagagcctgagagacaaggtagagcctgagagacaaggtagagccgatgagacaaggtagagccgagcagacaatgtagacgccgacgagacaaggtacgagccgagatgacaaggtagacaccgaggcgacaaggtagacagcgagagacaaggtagatggcgagagacaaggtagaggcgagagacaaggtagaggcgagagacaaggtagaggcgagagaaaaggtagaggcgaga

SEQ ID NO: 672344 - DNA, 309 bp, Homo sapiens
cgatgcacaggtgaccaacaaacagtcaaccgtcgatgacacaatcaatggcaagaggaagaccgccaaagaacatcatgaggaaactacgcatgaaagaacgtgagcacagagacgaggagaggcaggtgtcagaggcagaggaaaatgggaaattggatatgaaagaaatacacacctacctggacatgttatcaacgtgcgcaagcgtagcggcggcggacagaggactactacagatgcaaactcaccccttctgcaagaaagcctctttgcacccgggtcagaatggcggccgtggcgcatcga

SEQ ID NO: 672345 - DNA, 346 bp, Homo sapiens
gcttttgttatgtgggttgtatctgttgatgtttaccaccattaaaagttaaaactttttggctgggcacagtggcccatgcctgtaatcctagcactttgggaggatgagacaggtggatcacttgaggtcaggagttcgagaccaacctggccaacatggtgaaaccccgtctctactaaaaatacaaaaattagccaggcatgatggtgtgcccctgtagtcccagctgcttgggaggagagggtgggaggatcacctgagcctctgcgggttgaaggtgcaatgagctgagatgatgccactgcactccagtctgggcaacagagtgagatcttgtatcacc

SEQ ID NO: 672346 - DNA, 606 bp, Homo sapiens
  misc_feature (350)..(350): n is a, c, g, or t
  misc_feature (352)..(352): n is a, c, g, or t
cacgagggggtgacacttgcagtggtgactgctagtgggtcagcatgcagctctgtcattactactgcctacacaggtgtcagctgcactacttaagctccctgacaagtccgagtatcactgtgaatgggctttctctcctgacttctaaacaccttactagagtcttttacctgtgtagatgtcatatcatggcctggagagcatccagaacggccttcccaaagaggttttcctggcacatatattttgtctctgaccttgtgcctgcttattcacagtgatttctctggctttagtaatttcctaatccttttgaaaatatatatattttaccaatcctttgtgantntcatacttccttccatacaaggtattttgtattatatccatcctccctcactcctcctggtctacttctcacccctcccaaagttttcctttacttttgctgatgttgtaacaactcaccaagcccagtgcatgctgcttatatactcaccgatgaggggttgtccacgagagcatagcggtctatctaccctaattctgcctcctaagaagtctggctcccgtcttaacaatgaaccatacaacagcccccca

SEQ ID NO: 672347 - DNA, 704 bp, Homo sapiens
ataatcgttatctgctgcctagtcctgtatgcccttttcctatcactcacaagaaaagctagttaatactagcatctcagacgctcaggaaatagaaattcgtcgtgaatctatcctgggccgtcatcatcctagtcctcatcgccctcccatcccttacgcatcctttacagtaacagacgaggtgcaacgaatccctcatccgttaccatcaaactcaattggcgcaaccaagtggtagctgaggcctacgagttacaccgactacgggcggactaatcgttcaactccgtacatacttcccccagttattcctagtaaccaggcgacctgtgacctccttgacgttgacgactcgagtagtactcccgattgaaggccccattcgtaataataattacatcacaagacgtcttgcaatgcatgagctgtccccacattaggcttaaaaagcagatgcaattcccggacgtctaaaccaaatccacttgtcaccgttagacgagcgggggtatactacggtcaatgctctgaaatctgtggagcaaaccacagtatcatgccgcatcgtcctagaattaatttcccctaaagaatcttttgaatatggggcccgtatttaccctatagcagccccgtctaccccctctagagccagtagaagaaccctccataaaacctggagtgactacatggaaagaagg

SEQ ID NO: 672348 - DNA, 503 bp, Homo sapiens
  misc_feature (22)..(22): n is a, c, g, or t
  misc_feature (155)..(155): n is a, c, g, or t
  misc_feature (275)..(275): n is a, c, g, or t
  misc_feature (352)..(352): n is a, c, g, or t
  misc_feature (424)..(424): n is a, c, g, or t
  misc_feature (436)..(436): n is a, c, g, or t
  misc_feature (455)..(455): n is a, c, g, or t
  misc_feature (486)..(486): n is a, c, g, or t
gaacatgaaatgtactttgatntctatgaacatttgctgaaattgttcacaatgctcgaaatattcttccaacttcaatatctagtaagatcctgcccataacttaaggctcagctcaaatgatctctcttctataaaacttattccaaagcctnagagacaccacacactataatgagaagactaagggctttggacttgggttaaaatcccagctgtcaatataacagctgctttctgatcttcattacttaatcttggttttctcatctatnatattaagaaacatatcggataatacttgaggaaattaagtaaagatttattcaaagcacttatgaagggtagccgncacacagaaggcattcattgaataaaggacaatgtcttcagagtgggtgtgctagtaaatggttaacaaccnggtttcaaaagngcagcttatgcatgccggncgcaattcgggctcacttggccttcgcctanaggggggcggattacca

SEQ ID NO: 672349 - DNA, 279 bp, Homo sapiens
aaactcacacatgtaaacacaaatacattcaacagaacataaactcacaagcacacacaaagcacatgcaaacaccaatatggtgtacaaagatacatgcagaaacagataaatataaacgtgcaaaacaacaaacatacacgtggataggcagagatacatggaaatacaatatatgtacagagaaaataaatgagcacaacgacaattcattcatgcacatccacacatacacaaatacaaacaggcacacaaaaacccaggcaaaaacgtcgacgc

SEQ ID NO: 672350 - DNA, 709 bp, Homo sapiens
agcgggggtgctggcagccttgccgctcgctgtgccagtgccccgcaggctctttggcagtccagcatagtggactactacgaggtgctgggagtaccccggtaggcctcgtccgagggtatcaagaaggcgtaccgcaagctggcgctcaagtggcaccccgacaaaaaccccgaggacagggaggaagcggtgagaagattcaagcaggtggctgaggcctacgaggtgttgtcggacgcgtagaaacgcgatatctatgaccgctatggcgaggcgagggcggagggcggctgcgcaggcggcaggcccttcaaggaccccttcgagtacgtcttcagcttccgtgaccccgccgaggtcttcagggagttctttggcggccgggacccattctcctttgacctcttgggaaacccgctggagaatatttcggggggtcagaggaactccctgggaagcagaagcagagggtctgaccccttttctctgccttcagtgaatttccagcttttgagggtggtttttcttctttgatacaggatttcgttcctttggctccctgggaaagtgggggcctttcttccttctgcatgtcctacggtagtgatgggacaggcagcttcaagtccatgtcgacttccactgaacatagttgatggtcacaaaaatcactaccaagagaatcatcgagaatggccaagaacgg

SEQ ID NO: 672351 - DNA, 200 bp, Homo sapiens
tgcttccggttcgattctagaggtatccccacttttctgaacggtagacttcctagagataattacttttgaactagttggtttgaagtttacagagccactcgggctcacaggtctcctcagttgattgtatccaaatttccagtacgatagtactaagtaataacaccaggaaggtgtcccttcagaaggaaaataag

SEQ ID NO: 672352 - DNA, 108 bp, Homo sapiens
ggtaccctcgcacagaccaccacgtcgtcgtgctcggcagcgtctaatcgctcgacccaatcgtcatagaaacgcgccaacaatccgttgtagtcggggctgtcgaca

SEQ ID NO: 672353 - DNA, 1210 bp, Homo sapiens
ggctggtctggactgccctctgagctcgcagcgggtctctatgcaggcagtagtcctcccagatccctctctcctcgattcttgcggcgaggggtcggctggagagaaggccacctggtgcacaatctggcctcgatctgtctactagaacgtatcgagatgaagcggatggagtagtcagcatctatgtgacgtagcactgcgaagagccttgccctccacacccttacgcatcactcgaacgaacgtcctacttgcgcgacgtcgggaagaagactattggtattgtgactgagcgaagattgcccatgtctacaatatagttattcatgagaatctccacatgctgaatgtgaggcacgactgagcgtggatggtagagaatcagaatcgctgcggatgcgcgtggacaccggatgctcaactgagtactgcgtgtgcgagtctgccaactatgagtcgttccaagatccaacggcctgaggcatgacttggtcgtaataccattgttcgggccaatgacgctctgaggctgatccggcgtgctaacttgggaatccgcaggcatctgcagcacaagcaccgctaacagtcactagatgttccagtcacccaagcatgtcgccccaagcagtcctcgtgcacatctgagacaatcgggagcaacgcagctgctacaagtttaacaggcacacccgagaaggagccccctgtgatggccagcgggatgcacgtcgggagccgaggcgacgtgaggggacagtacaggcccggggagtgggcccatcggacaggcgtgacggggaccaagcgatcatgggcccttggaactaacgtagggagcctcttcgcccggtgaaccccagggcgtgtcccgcgacaggcagggaccccgcgaacccacaggaccgacaacatcctggaccgggctagggcaaagcaggaagggagctgggacgcggggaccctggcccaagcagctccgaaggaagcgggcgcaagggtggcatggagagccaacagaacaggcaaggaccccaagaaggtgacctgcctgggcgagggggaccgagccgggggccctgggatgcgccccactgattgagggaccaaggaacaaccgggcttaagagagggagacatcgagaaagaagtgccaggaacctggcaaacgataggcccatgcgtggagaaataaggggtcgaccca

SEQ ID NO: 672354 - DNA, 136 bp, Homo sapiens
cacgctgttctcggcgtaggtgaaggagaggcgccggaagctgccggcgttgcgcgggatgtccttctccagcgcgtttttagatcgcgcccacaacccccgaggtctccgcgcccagcgaggtgttcagccgggc

SEQ ID NO: 672355 - DNA, 510 bp, Homo sapiens
  misc_feature (139)..(139): n is a, c, g, or t
agggccggtctgggaaatcgcttccaaccccccttttttttgaaagagggggtcctgcagggcaaccaggagttacaaccgccttcttggtgttaacccctcgatgtcatagcttttttcaactgcctgcgcgcccccnacaatcaaccctgtgcgcgcggaaaaaggtgccccgtgggctcaaaagcctaaatgggtggttttcaagaataaaggaccctatccctcatgcccgttttgggggtcctccccaacaaggctggtcgggggcccctggtttgtccctaaacctttttcccagggcaaaaacagttttttttgtttttggtttggtttgttttgtttttaaaacaatcatgttcccctaaaaaaaacttggccctcctgtgccctttgcctgggcaagcacaaaacaaatttaactttcctaaggcaggggggagcccggaacaatggggccttcaactggaactgtggacttttgtacaaaccctaaaattttgaagttta

SEQ ID NO: 672356 - DNA, 1122 bp, Homo sapiens
tcaacactttgcctatttactatatgaagaatatggaagtcgaaaagtgatcaagatactacggtgctggctagtacgttgaaaacttattgccgtcattatttacactacttaagacatattagcaagcttgactccaacaactggcgaggccttactagactgtgcttgggcggaaaatgacacggggagaaagtagccaatacaggagttcaaagaaattccatgccctgtcagcacttagcccaagttaccagaaacatcatgaaagatagtacttaaaaactaagttatttactacagctgtactttcaccttgctctcgatgtgtctgaacaccacagaagctaacttagcaacgttattgaacgaacgtattctaaacaactcttactacggattgaccactttactctctgaacttctgtataaaataggcttactaggtgcagaagctacgtgttgctcacaattgtaaccattctgttaccattgggcaaaattctgtacatattcactcaacgcatttaagctctaccaacagaaccacacgtgcatgtacacacgactgtcttacacactctccaacagccccagtacacacagcaaatctctgcttccactgtgcacctgctacaacgtaacgagtttaggctgctggtagacaccattctgactctgatgtctataagatacctaccaatcaacgacgccaccatgctaaaggtccccgggtcaccaacaggaagcatacaggcgccccctggagaccacgcacgtacacagaacactgaccaactggcaacaccaaacagaaagacaacacacacacaaacggagaggcaccaaagcagaacatgccacccagagagagcacacaactaaacgaggacgcagaagctaggaaaaaacagagcacaccacaggaaaccccaaataagaaacagaccagggaaggaagactaacgagacgcggacggaaaacaggcaaccgagaaaaaagagcgcaccagaccacagcagcacaaatggaaaacccgacaaagaccagccagccccacaaacaaacactccgcaccaaccaaacccacgaaaaaaaacaccgaaacgaatcacaacgca

SEQ ID NO: 672357 - DNA, 165 bp, Homo sapiens
  misc_feature (159)..(159): n is a, c, g, or t
acatatcacagaataaacatcctcttctgtcctgctgctagacctccattccaagagaacaggatcagtatcttgtgctctatttgtttaatcaatatcaatcgccagtctattgtgcccaccagagtacacgccctaataggagtgtcatgtgcccangtgcag

SEQ ID NO: 672358 - DNA, 324 bp, Homo sapiens
  misc_feature (9)..(9): n is a, c, g, or t
ttttttttncccctcccacctgcccctccctccagcccagctccattttttggcataacaggcaactttaacctagcccagaagaggatggctcatcctggttgggacgatggctcctgccttgagagacaaaaatccccccttgggcagagctgagtgtgaaaaaatggaaaaccagtatttgccaggtgctcagtgactggccatcccattaatgaatgatgagattggagtaccctgtccccaagggcaggcccaaatggcttttggggttgtttggttcccagtgaaaggctcctgaaaaaaataaagctggttcccaga

SEQ ID NO: 672359 - DNA, 407 bp, Homo sapiens
actctcatcaacctgtagccaattagctggagtagagattcctcagcattcaagggtcttctcgatcaggcgcgcgatcttcatgtcctgctgtaaccatgtcaactcccgtatattccattcattcagccacacaggtctgctctacataccgtgaaaacgcttcatggatgtgaagtctctacaatgcctgaagccactctttctgcctaggtcaggttctctgacgaaaatcctacttatgccttaaagtagagctcaagtgccaattagtgttctgggttagagtttggctctctgacatatgagtcttgtgcgactgagctctataagtctcagtttccctatctctaagaatgaatatgatcacagtatcaaaagcagggttgtggtgaacattatatgcg

SEQ ID NO: 672360 - DNA, 160 bp, Homo sapiens
gggggggaagggggggggggttttaaaaatttttttttgaaactttttttttaaaagttttgccctcccattttttaagtttcccggggaagggttttgggggcccccccctttttttgtttttttttgggttttgggggggtgggttttttttttccca

SEQ ID NO: 672361 - DNA, 406 bp, Homo sapiens
aaaatcgtgatgaaaatacgccagatgaactgtggattttgcagcaccacgacgttttaacccaaggacaagctggtaaacctgaacatattctacaagcaactcagctcccgattgtacaaagcgaccgtggcgggcaagtgacttggcatggtccagggcaattggtggcttattttatgtttgatttaaatcgtttaggctggaacgtgcgaacattagtgacgtatgcagaaaatttaatgattcatctgcttaaaaaatacaaaatcgaagcttatgctaaagcggatgcaccaggggtttatgttgcagagcgtaaaattggatctttgggttttaaaattcgtaaaggacgtagctatcatggtttggctttaaatattgattgtgatcttttgggttt

SEQ ID NO: 672362 - DNA, 758 bp, Homo sapiens
agcgggttcacctgcgtcgctccgggagctgccgacggacggagcgccgcgggcgaagccgggcggacgaactgcgagcgtcggtggactttggccaggatgcgataagcgtcagatagtaagtcgtgactgctactcacggacacggaggtagcggagttgccccgagccgtgaggcgcccacatataagccacatggcgcgaggtcgctgtaccccgtgagactgtcacgcggaagctgcgccgccaagagcacgccgatgcggcgttcacgcatggacagacgtcgatccgagacacggcgtggacaaacacacgggcacacaccagtacatcaatgaccagtgggcttgcgttggcggagcgaccgagagagatccttacacgaaactgttcaaggcctctccttacgaacccacatcatcgaggaccggcaacggcggaatacaagacaccagcgatgagcacaaagaccgacctcacaacccgacaaaactgagaggggaggagaacgaactggaaccaaaacatacgatgcctgagcatcgggggtgcagcaagggccgacagaatccgtgagcttcatgcactccccccccggcacctgcaacccaggagggaaacggcccgagaccatccgagaaagctcagaggaggaaagacccatagtcaaccttggagcggagaaactggcaggagcgatactacgcgctcaagagcatgacggagggaggagcagcagcagtccatgagacaat

SEQ ID NO: 672363 - DNA, 180 bp, Homo sapiens
gaccggtaggagagagaacgcacactgatagcactgggccttgttctatcctggcaacactcgctgcagctctgggcaggggacacactcaccagcacgccacagtcctcaccacttcccatgtgcctctccaacagctgacgacagcgctgcctgccacgagcccactgcccatcccca

SEQ ID NO: 672364 - DNA, 1091 bp, Homo sapiens
cttcagaggggccctcagcgctctcctgaagccctcttgtgtcaagaattgtggaccatgcgagtgccgtctggtttccatcgcagcagtccaaggactgatactgatctcctctggtgacagctggtctagaggcctgatattctcctacagaggttctcgtctcgaatgccccacaagatagcgtccaggcgcccctcgagactgcaccagtcgagtggattcattgcttgttgcaagcaagagcacatcatcggagtaagattgcatgggctctgattgtatggtggtaaggttcacagatgaccgagctggttactcctcctgacagactatatcagctcatgagtactagttgaggagccgtcgccgtgacaagcatacgaatctcgcctggagactttaccagtggactagggtgagctcgatctcgcattccctagccttggttgagatccgtgtgacacgagcttcgcattcgccgcgacgatctagcgggtatcgatatcttgcatcgttccaatgaatgggagatggatcgcttcctgttttatcggctatccacactctcttttttggtcgtgttcttgaggtaatttcatataaacgaaaagctacaattgttatccaatttggttgaggagggaaagttatgtgaccaacctggttagggaaatgaggaagttcataggtacagcaaaaaacgattaagtacaactcaatgcgttggtctgttcaaatccacggcttaagcatagcaaccagggaagtgactgtgaataaccaagactcgacggaggggcttatacagacaacggccgagaattttatacccttcgtttccccttaaggccctttcaacccacattcgttggcattttgtacgccatcgttggtttaccatggctgcatctcgtctcacacggcaacagagcaacaaaacgttggcagttaaggtttgtacacgacacttgtctagccttggcagtgatgcgtaggaacactcatctggttcaggggagacccgtgtggggaacccttgttacagttgacagggaggcacgctcccgtatcattagcgtgaatgtcga

SEQ ID NO: 672365 - DNA, 177 bp, Homo sapiens
tatcagccggttacccataatgcagaaaacaggagaatttatttattatcagtgattgaaggaaggacggactccaagctcatatcaatacatgtagtagtaagccaccgaagagtttgtaagatacagctcgaaacgcctacgtgcaatagtgaatgcacactcaagaaagtcagt

SEQ ID NO: 672366 - DNA, 1471 bp, Homo sapiens
  misc_feature (261)..(261): n is a, c, g, or t
ggaggggacttgagattccacaattgggaagaagaacagggagaggtatacaaaggtgaagtatgggagtaagaggcagtaggcttgtttggtcaatgcatctgcttgggttgtgcttctagtatcatcctagactgatgatgaactagtggtctccggtcatacgtggctcggcaggcatgatggactgctctggtggtaggcacaccccaacggtcccgtatcacctggcctgggactcgcacatgacaacctggcatngcgagaagtggtttcttccctgaggatcagaacaggagtcttgtggcaaggacgagatgtatagacatccttgtatcacggataccagggtatgggatatggcttggagggagagcgtgacggacgtaggatgcttggttgtcggaagaaatggacgtgctctaggggcatacacagaacatctcagcggcttgagaggtcgtgtggaccgtacatgtcctgggtaaaatcctcagggcaactatatgtggaatgcgccgtgacgggaccagcgacgggagtacatcatacatgcggtctagggatggttatcaggaggaaccatgggcgcgtggtgcacataacgaatgggtgtgcagcagcgcccacggtacgtacctaacataaaggaaagtaaccaaaaggatagtaagggtctccaatgggatggatggcgctagggggttgggtgaattaggcacattggttaaaaattacaccactaaagacgttaacactttttgggcggaacggtgggcttcggtatggagccgtattggaggaacgccacaaattacaggaggtgttttggaacaacccgcagggggggaaagggaggctttagaaagaggggcataaggtcggaagggataaagaaaaggactcccctggacacgaaatttaatgtgtcggccgccattttctagtggggggggcccttttaaggggggcccgcgcaaatcaagcgcgcaccgcattcgaacatggaatccgttcccttaggggtgaccagtttcggaacaattaggagcacacatatacacaggagattaacacatatagggacattttatacacataacagcagagagtgacgcggaagggggggggtgtcacgagcaccgtaacctcttcaatcgtagcaacaacattatggtgtgttcaaccacctgtagcatcttcagcaatgagggagggcggagccagcacaaacagccggaaaaacgaggaacgttggtgatcacaacgcgcgcacaccagggatttcaaaacgcgccgcacagaggccagaaatattacaaaggcagtcgtgtgcacaacctaaaccaccacaagagcgagacggaggaggcgtttaccccgaccgcgtataacaatatagcgaggatcggggagacagacactcaccgagttcataattatccacagacggacaaaaaagcgagacacc

SEQ ID NO: 672367 - DNA, 1036 bp, Homo sapiens
ctcacaggccttataacttgcggcaccaggaggggcatcggggtgataaaggggttttgagcacccgaatggggattttcgttggtggtgtggtaaatagttgcgtcgttgttgtgcgaaccgggagttcccggcattgtttcccccacgcgtgggggatcacaagggccgcaatatatgcggcgtctcaacaccacaaacatcccgtgccccccttgggggtctcaagagttatatttccgccgctgctcctccaaggaggtcccgccgcccccttgcggtgtgttgataacacccgagtaacaacggtggttttaaggctaatattctgcccgcggctttgctcagccccctgagaatgtgtgggcgctccaacgctgagttgttttgtgttggtagtaaggtttactccggccccggcacgccacatgggccttcaacaccgccgtgatctcccaccaactcttgggaagcgcccgcaggagcggctagattcaccctcgcaggtcccacggcagtttttgcagaacccacccttggggcccacccacagggcgtgggaagcccccctttcttcgatgacattgatgttataccaaacatgttagcgtgggtgtgggtggtgcacaaccccggggtatccacgcacgtgcgttggggagcgcttgagggccaggagaatccgctttggatcccggaaggcacgaggtttccagtgggcgccgagatccacaacccattgcccacatcccaccctctgggccgaataaggagggaaacatcttgtctgtccacaaaattagtggaggaataacatagaataaattttattcccaccctgggccaccaatagcgagaccccgtcccacaccaaaaattagaccccccctggtggtggtgtgcttgtacatccccagactacttgggaggctgaggcaggaggatctccttgagtccccgaaattgaggttctcgttcccccatagtcaagcccactgccacatcccctttgggagacaagccagacccttttcca

SEQ ID NO: 672368 - DNA, 450 bp, Homo sapiens
ctaacaacacaacaaattgaccaactctagaaatggaagtaaccaaggtttaggtgcagttaaggttggcaccagttagaaagaaggaaacaacgcctctaggtatagagtgcaagcttccaaagagtgggccacacactgtagtctagagcaggaagacaaaggtagaaagtcattcaatggcccgcaatatttgcgacacatgactgagtatagttccacaattgtacttactcatatgcattccagtattaaaactataccgaaagcttaccacagttctctggaatgtgtgtgtgcattacagcaagtacccaggctctactaattagggggactggatattcaccagtttgatcatattctgcagccactgggatgatattcctctctggcaaatttacgagcagtcgcttgcaatacttactgctgttcggagacctcctgaaa

SEQ ID NO: 672369 - DNA, 1017 bp, Homo sapiens
  misc_feature (666)..(666): n is a, c, g, or t
tgaggtgatctagaggatctcatgtagtcgctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtggaaanaacaacacgacacgacaaaacaaaagcaaaaacagacaaagaaaaaagcggacacaaatcacggaggcaaaaacacacaacaaactacacagacacaacagaaccacacacacaaatggacaacggagaaaaggggcaccaagaggagacaatcaaggaaaacgcgtaagctaaaggagaacacgaaccggacgacagaacacacacacacacgaacacacgcaaccacaccacgcaaaaacaccaaaccaagacccacacacacaaaaaacaaaacaaacgagcacccgagagaacacaccaccacacacaccaccccaacccaaacccccacaagacacggagaaaagc

SEQ ID NO: 672370 - DNA, 1156 bp, Homo sapiens
tgaggtgatctagaggatctcatgtagtcgctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggaaaaaaaaaacaaaaaaacaaaaaaaaaaaaaaaaaaaaaacaaaaaaaaaaaaaaaaaaaaaacccgggggggcctttttgcggggggggggagacacagggggtaaaagggccctcgggccaatggggcaccgccaccccacttcgtgaacaagggggggaaagcgcgcgggggcccccaaaaaggaggagcgtttaatgagcaaagaggcgggcgacaccgcgataaaaaaaaagagggaggaaggagcgcgaaataaaaccgccataagagcggggcactggggagcaccagagtctcgcggagaaccctcttgaaggaacaaaactgggctgtggaacaaaacaaccgccctcaagcggggtgtggttggcgacagacgaagaccccaacctatacgaggaagcgctagcagagagcaaaccacaagccgatcgtggaagacgacggccctctgcagtctggtaccgcctgtctccgcgcgaatgtaacggg

SEQ ID NO: 672371 - DNA, 1623 bp, Homo sapiens
tgaggtgatctagaggatctcatgtagtcgctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggaaaaaaaaaaaaaaaaacaaaaaacaataaaaaacaaagaaataaaatcagaaaaaaagaaaacaaaaaacacccaccgacgaaagcatgttcttctcacccccgggcagaagggtgagggaggcacacacacgacaggcatatcccacacccccggaagaacacaataggcggcgggcgaggaagaccacatccgaagcacgcacagacgcgaggaggagaggagccaaagcagacgcagaaccgacacaaacaagggagacaaaaaacaaaccgacaacgaaccagagagaacaaacaaaacggaaggaaagcacgttgtcaagcagaccaaacacgaggaggagacccacgagagcacaacaggagagaaaagcgtggatgattcaatcggagccagcgagaaggaaaaccaataacaacacgctccaagaagcagccagaccgaatagcgctggcgcgacccgaaccccgagagaaagcatgaaacacacacagcacaaaaacgcactcactcacagacaccaaaagaggagacaacaccaccagcacaaaggaaaaaataaaggcggagtgagtgaacgcaaccaacctctcggggccaaaccaacccacgcagacgagcgcggacaacaaaccaaggcggggagagaccaacaagagacaagaagagacagcgccctcaactcatacagagagccacacagagagagggacagtagcacggcgacgcaggggaagcggagccgaaactaaatgcgagtgacagaacagagccaccagacacgcaaagacgatggagagcgcgagcaaaacaacaccaacaacgagggccgacgacaacacgacccacacaggaaaaaagacgccgagcggaaaaatacgagagcagagcgcgtcctacgccagaggagtgcgagagaaaccaccattggggcaacctacaagaagaacaacggaccgc

SEQ ID NO: 672372 - DNA, 160 bp, Homo sapiens
  misc_feature (13)..(13): n is a, c, g, or t
  misc_feature (25)..(25): n is a, c, g, or t
  misc_feature (75)..(75): n is a, c, g, or t
  misc_feature (121)..(121): n is a, c, g, or t
taatagagacgangttccccatgtngaccgggcactccgggcctcaagtgatccacccccgtgggcttcccaaangctaggattacaagggtaagccacagcaccgggcctcatgcgtgtnctttttctttgggagagagtctcacttggtcaccagtct

SEQ ID NO: 672373 - DNA, 1210 bp, Homo sapiens
tgaggtgatctagaggatctcatgtagtcgctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtggaaaaaaaaaaaaaaggccctcctcgcaagagccgtccgggagccagccaaggaggggaaaagggcagcacaattttcggctccatgatggcgttcatctggggtctgggaaaccccaaaccctccagggatgggcctgcgcgcttgggggaaccaagccttgttggggggcagggggctcacccaggggctccctatccgtggggcctacccggggcaggccccccgggggcttatcctggacaggcccctccgaggcgccctcaccgtgagcacctggaagctcatccggagacttggccttgggagttttccccggcgccacccacgcgcccttggggccttaccattttttgtggacagccatgtgcccgggggctatactggcatggccctattgcgccctggtggccagtgtggggcttatactgcttcctgggagtggcctcgctcgtgtactttggcggtgagcatgaacggatgcgttattcagaggtgttgtgctccattccccgtctgaccgcagcttgtggacagcggttacgggcg

SEQ ID NO: 672374 - DNA, 98 bp, Homo sapiens
agggaggctaagaggcgggagggattagcttggatgtcccaggagtgtcgagagccagcgctgggcagatatgagcgagacgctaccgttgcgtccaa

SEQ ID NO: 672375 - DNA, 854 bp, Homo sapiens
gatccatctggagagacagtcaccgtgttatgggatctctacaatgatctttccctctaaggtcccagatcttgatgctggggccggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggaaaaaaaaaaaaaaaaaaaaaaaaaaaaaaaaaaaaaaaaaggggggtttttttgggggggggggaaaaaaggtttaaagggaggggtaatgttttggcccctttttggaagggggaaacggggcccaaagggggaaaagaagcgggtcgaa

SEQ ID NO: 672376 - DNA, 330 bp, Homo sapiens
gtatatgctgtctcatcttactgttataaacattcctcaggtacttgaaaggagtgtgtgttctaggcttgttgagtacagataacctatattgagcaaagggtcactatcttccctgctgcctgtctatcacctctattagaagtatttaaaatctcaattttccttttaattttcatgcggttttctgggttgttcatgattgctatgtttgtggtggattgttctttaaaaaaaaaatcttgatcctattaacactttttggctcaaattctatttggtctgctattgatattactacccaaaatccccgtaccccgcccttttttt

SEQ ID NO: 672377 - DNA, 379 bp, Homo sapiens
  misc_feature (144)..(144): n is a, c, g, or t
  misc_feature (357)..(358): n is a, c, g, or t
ccaggtagaaactgatcctgactgccaagaaggactcctgattccttccccaagtctccttagaactgtggcccctcatcagcgaacagtgaggaactacccagtgtgatcatttcaaaactggaataaggtcgggcgcgggtncacgcctgtaatcccagcactttgggaggccgaggtgggcggatcacgaggtcaggaaatcgagaccatcctggctaacacagtgaaaccctgtctctactaaaaatacaaaaaattagccgggcgaggtgcaggcgcctgtagtcccagctactcgggaagctgaggcagaatggcgtgaaccccggagcggagcctgcagtgaactgaganntccactgcactccaccctggg

SEQ ID NO: 672378 - DNA, 617 bp, Homo sapiens
  misc_feature (70)..(71): n is a, c, g, or t
  misc_feature (132)..(132): n is a, c, g, or t
  misc_feature (511)..(511): n is a, c, g, or t
  misc_feature (533)..(533): n is a, c, g, or t
  misc_feature (575)..(576): n is a, c, g, or t
  misc_feature (589)..(589): n is a, c, g, or t
  misc_feature (594)..(594): n is a, c, g, or t
ataaaaaaaaaaaaaaacacacccttttctaaaaaaaaaaaaaaaaagggggggggggggtgtgtgtttnntctctccgccccccccccccttgaggtaataaaaaaaaacacacccccggctttttttttnttttttttaaaaaaaaaaaaccccccccgggggtggggtgtggagaaggaaaaaaaaaaacaacccccccccccccccccccaaagtgggtggggggggggcgcccctttgggggggagaaaaaaatatttttctcccccacaaaaagggggggcaccacccccccgtggggggcgcccccctcataaaaaaaaaaaaaatttccccccccgcgggcgcccccgggggggggacaaaatttttctccccccttaaaaaaaaaaaaacacacacccccccccccgggcaagaaaaaaaaccaaaaaaaaggggcccccaaaccccccgggaatagcaaggggcccaatagagaaaatttcccaggaccccccccccgagncaccaattggaaatgaagtctnggcccaggtggggacacctttggatttcttccccaacatgannccatgaccctcgntggtncccatcactgaaaatacgtactc

SEQ ID NO: 672379 - DNA, 981 bp, Homo sapiens
cttcactatttctggtggccgtgttccacctccctgctcgctgttattactcctttcgccgacgatatctgcctctagcacatgtgtgccgccctttggtgcagaaagtcccgtaagattttcgcacaatgcggttttctataaacaccgcccaccacatttgtgttccccccccgtgcgaataaccagttgccgcctgcctttttcgtgactctcccttttgtgcgcgaaggtatatataaccaggccatttgcgtcttacccaactccgacgtgctttaactcgggctgcctctggaaatctgtttcaatcatagcccgcaatagcccgctctgtttggtacaagcccaaattgcgttgatcgccatacacccctccgttattgtttcacccgcgcccaaattatatttcttataataatttgctctccccgcggcctttaactctcctccctagtatggttctgcgccctatgttgaacccctctaagtttctggagacatcttcaaaacactctgtccccgatttatacccgtcttctctctctgaacgacttctcaagagacttgttagctgctcccccgcgaaagataaggctgctttggcgagaaccatttctacacacaaccctttgttttacacgcttgcgcgctggctccccccccccccctctttcggcctccccctgggggacccgtcctcgggtaagaaaccagcgtgtgtcccgggggtcaaaagacatcgtgtccgcgcatacgggaggccgaccaaaaatggggcccgccctaaaatccgcggggcaaaaaaatgtccgccgaccacccgattcggggcaccacccccgcccggccgacggcgccacacaatgacccccgccttctcgacacggggaaaccaaccctgaagggggaaacaaccctgacgcccctttttcccgttcccccaaccccaaatattccgggttttccccccaacaaaac

SEQ ID NO: 672380 - DNA, 605 bp, Homo sapiens
agaggctggacgaggctagtcaatccttgtcgtcccgaatcggtcatcgacaccagccgctcaccatgccgcggaagtcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgg

SEQ ID NO: 672381 - DNA, 545 bp, Homo sapiens
gcgaccttctgctctgcgtcgaccttctgctctgcgtcgaccttctgctctgcgtcgaccttctgctctgcgtcgaccttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgg

SEQ ID NO: 672382 - DNA, 121 bp, Homo sapiens
tcgagctcggtaccgattacgctcctaacggtggtgtaggggttgcttgccgacagttgatgtggttgctctcagcgatcctctgggcctccttgtggatggacaggatgtgctcgcgcgt

SEQ ID NO: 672383 - DNA, 423 bp, Homo sapiens
acctcctaccccacgatcatgtctggctaatttttttatttttattggagacagggtttcaccatgttgggcaggctggtcttgaactcctgacctcaggtgatccacccgccttggcctcccaaagtgctgggattacaggcgtgagccaccacatccagcaaaagaacagttttgacctgggccctgggctggagcaatagtgtaccaagagacaggcccccatgactaaaaatacaatttaaggaaaaatgcagctccagggcaagtgccctgtgcctccttccaacaaccattccccaggcctcccctagcaatatgctgtttatcaagtgctcaccctgtgctggccctctgcgtggcatttgtggacagtagctcattcaacctggggttagagtgtgggaccccggggtaccgagc

SEQ ID NO: 672384 - DNA, 741 bp, Homo sapiens
tgaggtgatctagaggatctcatgtagtcgctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtggacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgaaaaaaaaaaaacacaacaagaatggctaatggcattgctaagggagataaatcaggggggtaacagcggagggaacggggacaatataggtgggaaccttgcgagggaataaggg

SEQ ID NO: 672385 - DNA, 753 bp, Homo sapiens
  misc_feature (2)..(2): n is a, c, g, or t
  misc_feature (8)..(9): n is a, c, g, or t
  misc_feature (18)..(18): n is a, c, g, or t
  misc_feature (30)..(30): n is a, c, g, or t
  misc_feature (34)..(34): n is a, c, g, or t
  misc_feature (52)..(53): n is a, c, g, or t
tncgcggnnggctggcgnaaaagaactagnggancccccgggcggtttgaanncggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtggacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgaaaaaaaaaaaacacaacaagaatggctaatggcattgctaagggagataaatcaggggggtaacagcggagggaacggggacaatataggtgggaaccttgcgagggaataaggg

SEQ ID NO: 672386 - DNA, 596 bp, Homo sapiens
tgaggtgatctagaggatctcatgtagtcgctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgg

SEQ ID NO: 672387 - DNA, 151 bp, Homo sapiens
  misc_feature (18)..(18): n is a, c, g, or t
agccaccttttcagtcgngttttcataatttagcttcgtttttctatatccacaaacaatatattatattgggtggcatttacttatacttttaaaaaatgatctcatgcgaggatgtcctattgtatcatattttttcacgaaacattat

SEQ ID NO: 672388 - DNA, 502 bp, Homo sapiens
  misc_feature (423)..(423): n is a, c, g, or t
  misc_feature (487)..(487): n is a, c, g, or t
  misc_feature (499)..(499): n is a, c, g, or t
ctttctgcacccagacagacgctgataattcttgctctgcacactgaccaccttattgctgagtattgtcaaggacaagactttttttttttaattcaaaacatttgactttttaaaggaaaggatgtcacagtgtctttataaccgagataatgaaatcttagcttaattttgtgcaagaattaaggtacttgaattgattaaggcacagatgtgtttggtctaaaaggctgtattttgtctgctttttcacaaatctatggaaattgatttccccatcttgcagtgtgcttagcgcccacgatccccaagttctagaattctggaaagagccttcatgtatggaatgtcttctgtgcagaggaggtgctcagcataggcggctcagacacggggtgcttctctaaccacgctctgtgttancctggggacccctcttcctaatccacgtttgagtaaaggatgtttggattccctggaatgactngagttttttganaca

SEQ ID NO: 672389 - DNA, 133 bp, Homo sapiens
gtgggtacggcgacggttcgctgacggcttgctacgacacgtcactcaacacacacgctacttacgtgggacgtacgacgtttgacacgtccttgacgacgacggacttactgacttgcgaccttgtgacgtt

SEQ ID NO: 672390 - DNA, 683 bp, Homo sapiens
aatttttccactgcatgggtggagggtagttccctgattctgacttgagtttgtagccaatctaaggccagggtcaaaagcttccagcaagaggccggacgcttggaaaaggctttcagaagtttccatcggagagtcattaaaaactctgccaaaagccccctagcagcaaagagccccccatttttgcccttggtgggagccttcaaaaacattacttccagttccccggaaagacatatttttggagaggacagagttgtttttgagcaccctcaagtgggccccctttaaaaaaggaatgacgtcgtggaagccctgacaggcagtgcagcctcgaggctccgcgggggcccttcctccagacgccttttttcccccccccttccaaaagcaaaaaaaagccccgaaagtgaaatggatttggaaggtttgggcagatcccccattgcttccccccgtccttgttctggcagaatggccccaccatccccccctgggtttagggccagcctctccctccctcctgtttcccgccccccggggcagaaagtgggtttttatcgaagaccaactgaacttcaagaccaaagtgaattttccgatgggggccagctagcttttaaggataatggggggtttgaatccttttttgaatgggtaggtccgaaaccaattgaaga

SEQ ID NO: 672391 - DNA, 305 bp, Homo sapiens
gcgagaaagagaacaagccagaaatttagacagtgctctcgaacctgtgaaatataggggtcagagcatgaaggatggttgtgaacaaggaagatggattagtcatgaaatagcatgaaactggcattgacatgagtgtagaacatccctgattaacctgactctttatgcttaggtgcccacttatcacagcccttccttggcagttaataatgtctgaggcattgccaattgtacaactacatgagccagtcatagcatctcctctaatagtaggcatgtatcaggaaagagctgaccggcat

SEQ ID NO: 672392 - DNA, 421 bp, Homo sapiens
ttcgctgtcgagttcgagaaatccgtcttgactgggaaacaccttgggcgccaagataataaatagattcaaagccatccccatccagctaccatctgactttcttcacagtacatttggataaacactactttaaatgctacatgatgcgaaccataatgatagagcctgcagttgccaagttcaatccttaatcccaaaataaacaatccctgaaagggtcactcgacactcacctgtacttgcaaactagtactacacacggtgacaggtaaccagagaacagaatggtactgagtaccaaaacagtaggatataggaccaatggaacagaacagagccctcagaaataatgccacgtatctacaactatctgatcttagatcaacctgagaaaaacaagcaatggggaaaggattcc

SEQ ID NO: 672393 - DNA, 198 bp, Homo sapiens
atttccaggctcgtccagtcgccattcgcacattgtgcaagcatgcatccagtgtcgcagggccaggttccatggttgcatcattgctcagggtggcgcttcccacattcaggtgcctgcagtaggtggcctgccagtcacatgttcagcggttcaggcgtccgtgcccagggctcattgtgttgcacacatggtcgc

SEQ ID NO: 672394 - DNA, 268 bp, Homo sapiens
gaaacctgcggcgagttcgatgagcgacaacaccgccttgagaacgacataaagacgctgatcatcgaggccctgggcctgggagacatcagccccgacgatatggcagcgaccagaccctgtttggcgaaggcctgggcctggattcggtcgatgcgctggaattgggcctggcgatccagaaaaaatacggcatcaaaatcgatgccgacgccaaggacacccgcaatcacttcaccaacgtggccagccttgcggcgttcgtcac

SEQ ID NO: 672395 - DNA, 188 bp, Homo sapiens
tgtggtacattggaaatttagatattgaaatctgttaataaccagccaatatgatgtgcaaaaacgtcctagttggattggttgtttactgaatagtttgatcagtttgtagtttgaactagttgcttgaggctgggtcattgatttgaggtagttagaattacatgaaaagagtataacgcacaaaa

SEQ ID NO: 672396 - DNA, 735 bp, Homo sapiens
  misc_feature (1)..(1): n is a, c, g, or t
  misc_feature (5)..(5): n is a, c, g, or t
ntggnacaccggaattcggccattatggccggggaagaaatatgcttgtatataggaccacgcttttctaaagtgcatattagaatttttgtttttgtaaatggttaaatacatttcctgggtaacttaggaaattaagtttttcataaggcaacagatggttaaactgattgccatgaatacccaaagatcatgtatataatctgttttgttttagcaccatcccaaggtgtttttctcatttaacatattcgcttcataattcagcacgtacagatgcaagcgcattgcacactttttcctttctaaacttaaagacaggtcaaaaagccattcttagaactagaggatttaagagggtaggacttagggtttgtttatatgtatatatgggacattttaccttgtggcccaaagtcagatctttataaaaatcttgagtctgttcactaatgcgaaataagctttgagtccagcgtattgctcccctgattgaatatgagtgctgagctacattgcagaaatgtgatgagttattcactggcacaactttttttatagcatatcaattattttaaagtcggaaagcagtttggacctaatttggaggtgggtgtctattcaaggttggttggaaatctgggtgtgacacttctcgcacataaggttaaattagcacgccttacacatatcattttgcgccgctttgtataacacccttgtttataagaatta

SEQ ID NO: 672397 - DNA, 1146 bp, Homo sapiens
  misc_feature (331)..(331): n is a, c, g, or t
gcgctctgatgaactaggacccgttgccatgggccgtgtgatccgtggacagacggatgggcgccggagatcgtgatgttcgccgcgcagcacagtgaagcaccgtaaaggcgctgctgggcgccgttgcggcggccggtcggcatttcagcctgacgctcggcactggcctacgattctaagcggcttcggctcacagcgtcgatcgatctcattgcacccaggcgtcggctgttgccctcccttctgcctagaggtggatcttcctggagatccagtgactcgggttgtagaagaacaggtcaggacgcgaggactaggtatcagttancaccgatcggcacgcgagccaatttcgacaccggggcactagttctgggttggtaatttgtggtggccaaacgcaaagggctccgagcatccaacaacaagttgtgggcacgacttggttgaccttgcgccctgcttgcggacaagccccgagtgacccctttggaggggggttaaccagagtcctggtggtgccttgaccttggttgcagcggacgcaacaggcccttgggcaaggatggccggtcgtgccgacacgcccttggtgctctcggggcgtccaattctaagggggaaacacctttcattgtggcgcctaccccctgggatgtactttcgattcccgccaagcaatatccctccgtgtagggcaccctagagggcaacaattgcaagccccccggatatggcttggcacgaacgtccttcggtcgccccacttcctcaggggacgtactctcggttagcgaaaacgggggtccacatttccattcccccttttcttgggacgccccttccccggcaaaggccctttggtcgcccgccacggggggctggcctcgcgggccccgctctgccattggggcacaacgggcgctttggggcccccctggaaatacctccttgccaccccacgaggagccaacccccaccatcaccgtgctgacaaccccgtcggtaaccctcggaggccccaggagtgatcccacgatttaccccccacccgaaacaaatcttccctccaacacgcgcgcaccacgacctctagggagacaacaacggtgcacctctgcaccccgccacaaggacaccgcc

SEQ ID NO: 672398 - DNA, 1273 bp, Homo sapiens
  misc_feature (571)..(571): n is a, c, g, or t
ggagaggcttctggagtcaaagcgaccagatctgtggacggatcctgtgtcttggaaacgaggaggctccgacacgggcgttgcccctaccgaagccatgatcatggcgtgaatccaaagacacgggcacatagtacctcgcatccaaagagctcatgcatgtggtggtggctgctggattgcaaggaagcccaatggacagatgaacgaatggatgtactgtgcagcgctggacactgatgagaggcgccatcaagccatggtgcgcgatggaagatcttctacaagaggccagcttgggtgcacatgctggtgctgacaaactgtgttgcggaccttgaacgtgattgccaggtcgatcggtcattgtgcagggatcgcctggaggtcgtctacgatggaaacagccatccccatggccatcctgggccagacgtcgtgtcttctcagagagccacatgaatcaagggccctatgtcagtgtcttagtgggcagaagtgtgcaccagatggctaacgagtggaaaacctggaagtggcaccttcgacctagtgtcacgagatagccaanagattcgcacgtgtgggggctcgggacttgagagtacgttccaagattgcacgagtctatcgttaaggaggacgtaactgcgtggcgtttgttggggatccattggaattgcagagtgaaaaaacgccaagggatggcaagcgctcgaacagccccttgtgaacccttcgttcctaaggtgaaggcttccttcgggaagggccctttgggggccaacggagttctttttgaacaaggcccatgcggggtggcttgcggaacccttgttctcaattcagaccgttgaaattgtttgcaggtggccgatgggacggccccttgtgggctttccttgtgggcccacaaccgggtccaatctcttgaacgtagcgcaaagccttgggaagggcccccaggcgcccttgttgggcaaaagagaagcccgtgggccaagcaaactttgtccacccattgcatgttgttgggattggcttgaagtgtgtgtgcccccagtggggtcccgggacacccctttctccacagggtcaacttttctagcttcccccggaaagggctttgggcccattcacccctgggtcggtcaggtccaaagttggtttcccagaaaagctggggcctcctggcctattgggggccaggggccacgctgtcacggggctacttgccgccacgacctcttttggcaatccttcctttccccta

SEQ ID NO: 672399 - DNA, 848 bp, Homo sapiens
ggctggtaccgcgcctgggcgttatgggatgcggcgacgtatacatgctgagctgacccagtgccactggaagacggtcagcttctccactcaggctcctccagtcccgagccagaagatcccactccccccgaattctgggggccgatggaagggagccgagtcagatcgcgaggtacccagagccgacagaccggagcgacagggaggtagccagaagccaccgcccccatagggagtgatcggaaaagcctcagccataccgggtgagagaaccacggagggacccgcctccgggcggagcccgacgaaccatggactacgccaacgatggtggcgggatccccgcaagacaacaaaacgctctacgaccagacacgaaggccaaagacgtgcgcaagagacaagatgccagccaggacacgacatgcgggcctggcaaacacatatcaacgccggcaaagataaccaagggacgataacctaggccgacacatcgtggacagacagccatgagacgccccacatgagcagcaagagacacgggaataaccagagaaaacacaactgaaacggggccgatacaggaaaataggcgcccttccaaaagcgccacgagagggagaggataggaaaggcatgacgagaaatacccgtggcaagagggaaccagaagaacacaagaggaaacaccgaaggatacagaagacagagaccccgaggaaaaagtcaaacacaacagatagacaccaggcaaagtacctggagaaacgcccaaataagaggacagggcgaaaacacagaaaagagagaaaagacaacacggaagcgggacatccatgaggcga

SEQ ID NO: 672400 - DNA, 795 bp, Homo sapiens
gcagcccttgccatctctgcgctcttcccccgttgactggggtatcagtttatggtgccctgcagtgaagacctcttgttcctgtgggtgggaaggttctggaatctcagttgccctctctggagttgggagagacataggcttcggatcgacaagctttgcagagtggttcatggagtgaggtggtgggacgatttctgaggtgcgcgtgcggtgccatggctgcaaatcagaaccaccccttggacgttgatctcaaagcttggttcccagaactggcattttgaagcctctgcatagatctgggcagcttggtcaggatggccattcgggcgctcagcacagcaacgcatgccatactcagactggggaagcaaccacggggctggacaggccacgagagcctgtcggcacatgtgactcctgagatgtggcgagtcgctgcagagcggcataacggacgacgctacatgtccgtggacgtcccagctctactgcgccctccatagaacctccctgcgcgagcgcacctgctctcggcaggcctgtggcgtcccgtactgtccaccagcgtcctctgcaggtgtcatccttgggcttgagtgatccctcatgcggggcacctccgccggtggccggcgtcgccttgaccgagcgcgctgctgcgtctcccggggggccgtgtgctcccccttatgggcgcgtgtggtacgatgccgatggttgcctactcctgtccccggcacacgtccgtgttcccgctgcaattgctgtccccagcactgtgcccgttgt

SEQ ID NO: 672401 - DNA, 191 bp, Homo sapiens
tgcagttgggcagaggaggcatctgctgaacccaattaacgccaatgcaaaaagtataatggctttgggtgaccaatgcaacaaggaatcctatcactacatttataaaatctaaacgctggagattagaggtgtgacagcgtgacactccctcacccacagcgctactgtgtctgctggcccctacgcaa

SEQ ID NO: 672402 - DNA, 144 bp, Homo sapiens
cgaattatgcgtcgccctcgcggcagcagggatgcagcgtgctggatcgccgcctgcgaccctgcaatcggcagacacgccgcgcgcatctgatcacgccgtaggtgcgcggaggctgcgcttcgaggccatcgtcttcgggca

SEQ ID NO: 672403 - DNA, 579 bp, Homo sapiens
gcgacctgggaggcacggagactgctcacctgcccgtgcctggccgcggagtgcccggcgccaaggtgcctcgcgctcgtgcctcccgccccctgcgcgcgcttcccgtgtgctggctgccgtgcctcctgcctccctgcagatgtggatgttcctgatgcatgacctgggctcctgctgctgctccatgctgttggatgtgtgtgacgctgtgtgatgtgacttaagcaggtgctgtgcctcgtgtgcaggtgctgtggtccacccaatgtgagcactgacgacagcggactggttcccatgcccaaatggatgctctgacgccaccgccagacacacctgcagctttaccctgcagcttgaggcactcgtgacaatgacaacactggactgccatgactgcccgtatgtgacatgtgaagtgatggccctccatgacgtcttgatgcacgcgactgagagcccatatgggacagcattgcacccttgaaacttgggcacattgggaagggggggttgaccgtcggggagtcgaaaggtgacgaagacgcagtgggggcgacatggagaggagtagca

SEQ ID NO: 672404 - DNA, 231 bp, Homo sapiens
ccctgccagtacaacactgcatgggctgttatattcaacaacaagaccacatcatagtgactctatggcgagaaacaaacccatagtttagtctgaaaaaggagaaactcatatcctgattggctaaacactatacaattgaactgctatcagaaggcacagatagatagctcccagttgatccattgtcaggagctagtggaaaataacctaactactctgcagtcttcc

SEQ ID NO: 672405 - DNA, 298 bp, Homo sapiens
  misc_feature (31)..(31): n is a, c, g, or t
  misc_feature (33)..(33): n is a, c, g, or t
  misc_feature (40)..(41): n is a, c, g, or t
  misc_feature (57)..(57): n is a, c, g, or t
  misc_feature (270)..(270): n is a, c, g, or t
ccccaaatttccttccactcgcctgctgccntntgaagtnncactgaccagccaggnctcgtcatcaagggtatgggccttgcgaatacgctaaccggcgtggccattccgggccgtcgtcggtgccatcaacgttctgctcatggcgaccgctgtcagagccgtccctccatcggttttagatgcggcaaccgttgacggcgccgaacacgtggtcgaagattcgccacatcgtatggccaacatcaagggcatggctccgtggtcgcngtgttctcgttcatcggggcctgggacg

SEQ ID NO: 672406 - DNA, 1138 bp, Homo sapiens
agcttgcaggtgttggctcgtctgtggcttctccgatgctatcctggagccataggcaagagtgtggaagacggatcgtgacactactgctcatctggggctgaactggtggtggaggtcctcaactggctgcgacgcattaatcattctagtcgcattcccgtgcgagcagacgggttcttcctgcgtcagtggggactgagatgttgcctccctgtggccgtctctgtctaggatggtgatggaatgacctgctggttaccttgtgtcgttagcatgtctggacgactgtcttccacgtgggcggcgtcgcttgtgagtgacatacagacgtccacgacccggggatgtggacattgatgtcctgggcgcggagattgcggcagtcggcccgagcgcaggggcgttgaggtgggtgcgtctggggggagacgcggagtcgaaggcggatacccgggtcagcgccccggttccgggaattactacttgtgtcgaggtttggcatgaatcatcagtccagtgaggaattgattcagtgacgcagtgtagcatcgatggtcgatgtctagtgctagtggttgtaaatacgtaagggaacatgggattcaaatagaaaagtattgtaggttaaattacgtggtatggtacggattgtactgaggtggacaaaatagattgcatccatctgagagcggtcagtgagtgttagcgggttgaaatacatgtcatcagatgcattgagtgtgagggcaacgtcgtaatagcagatcggagcatagaagtggtattggcgagtaatggttcttgaagcggcaatgtctattaagtaaagggcccctggggaataagatgtcgcggagcgggaaactaagtcattgaatcgcgtgttggacagatattggacgtacgtgagcgaattttgaggaagttgtggcgtttcgtgggaccggaacagggtagctaagaacgagggggttaactcgtaagagtagtaaacgaaaagttagtagaaattttttgtgctatggatcatatgacaaaaatttaacaagtttattagagaaacaaaataaaaatgatacagatggtaatcacatagacaattagtgagacattaagaatttaataatatagttag

SEQ ID NO: 672407 - DNA, 302 bp, Homo sapiens
tatggcggatgccagatggtgtcggacagatggacttagagcctgaggtggaggaagcagctactccatatggcacgtggtcttggcgttggaggtggctacagtcccagcagtggcagagccattgggggtggcctcagctctgtaggaggcggcagttccaccatcaagtacaccaccacctcctcctccagcaggaagagctatcagcactaaagtgcgtctgatagctctcggtcccacagtcctcaggcccctctctggctgcagagccctctcctcatgttgcctttcggagaaga

SEQ ID NO: 672408 - DNA, 385 bp, Homo sapiens
cgcgactcttatccaattacaatacacaccctcatccccatttccagtctgattatacacattgctaagtggcagaaaggtctggaataaatacatcacataggagaggcaaagcagtgaacatgagttgcatgccatgggttctatgaggttgggggaagtgtctgagaagtcaaggagattaagacaatgtaactggaatattttagctaaaggttctttcagtcatcttggacttgggttccatgtagcaggatgcgtgtgaactcgatgtaatggaaatgcccctttcggtcaattaggtgcgactctgtaacagttcatccaattcctcatctgaaaagcgatcccgctaacaaatagtcggaagcagggtaccgagccc

SEQ ID NO: 672409 - DNA, 357 bp, Homo sapiens
ctcattggtacaccgctgtccggccattccttaacatgtcctacgaatgatctggattggaccctaccattgaggtctgatttcgtgcaactctaacatgtctcatagcaggtgtatctaaaatcagacttggtctacctttcatctgtttatggtcctgggtatatttaaccagagctaatattttcttgattcttcttcactctttccattacaggaagtaacacttaaagtggtagctcttcccagctgacctctgtaataaacacattgctgatgtatatctggtttacttttgccctcttcagctctggtggatcagaaattgcagttccccgttgaagttctcccttatat

SEQ ID NO: 672410 - DNA, 295 bp, Homo sapiens
acgttctgtcagctataagtcacaaactatctatctcaaatatgagcttttatcctagcgggaggctcaatgtcctcataatctttcgtgctatagatgtcgcattagcctccaaactgtcccccggggccactcttacccttagtaccatcttccttccacacaatgggccagggtgggtattttgtcagttgtagttagttagtaagtttttgtgagaccagggtctaagtctattgcccaggctgcagagcagtggtgtgatcatcagctcagtgtagactctaacatcctg

SEQ ID NO: 672411 - DNA, 384 bp, Homo sapiens
ggagcacggcaaaagcatacagacataggcgtcaaagtcgctatcgatcacattgcaaggcagccctaaagaacctgtgaagcagtgttttgttcgggaaaacctcaagtggctatcctgttcaccttctcaataaaacaaataagacccctttgggccaacagaaaaaagagacaggcttggggaaggaactcatatacctcagataatgaatcacaaatgaaacttcccatggtctgaacccaacaaaataaaaaatctaaaataatcagagatcactcacatttggactaactgtaagataaatgagatggaggacccgtgggcttagcagtccatttcattttgggtggatcgtaaggttaatatgagccacctggaatc

SEQ ID NO: 672412 - DNA, 376 bp, Homo sapiens
gtatgtacaacatgtaaagaagtgtcagcagaggagatgactatcaaaccttagtccaaagccacctcaacacctttattttctgagcttgttggaaaacctgataccagaattaatttgccacatgtgtactgtaataacagtggacccatgtcatacttacatccatgtttacaccacgaaggaattaggacaaaggcaaaccgtctactgtaattaaccaacgtttaagctttccggacttttaaatgctaactgtatttccccttcctgactaggaaaatgctataaagctcacattagttaggaatgacttatacgtatagttttgaatacctaagagatacttttcggcatatttactatcgccatattc

SEQ ID NO: 672413 - DNA, 387 bp, Homo sapiens
ggtcaagacgcgtcgagtctctcttatctcagtcttgtagtaagtcaactcagcttggtccgctccttcagcaggaattcacacacctcacagtcacacatcagacttagctgggacctcgtgcttcttaatgggctccgccagtatcccgggcagggatgacattcttggaggacacatttggcggggaccacgacgtctgcaatgggcactctctttcacctcatcacagaacccaaccagcgcaccgatctccttgggttgcttgtgcatcatcatctggatcgcaattcagaatactggctgatatcgttctcgcatatgtcggccatgccagggcccaggcggtcacactcctccttgacatgtaccaccaaggcctggaca

SEQ ID NO: 672414 - DNA, 1163 bp, Homo sapiens
ggaccaggagcgagtgtgtgtgagcggtgtagtgatagaggtgaggcgtagtgatgtagatggtgagtgcttgaaatgtaggcggtagctcgtggcttgctgggtcataatctccataggcacccaacctatacgccatgtggtcatgtgttgccattcgtccctggtagactagggggatacgtactagatcgcggacacaacagacatctatgcaacggagcaaatgtgtgctatgatgtttcgctcttgacatacaaacagaagaaccagagtctgctccagagtcctagaaactagtgcacgctgggaggggatccctatcttctagtcctactcagtcttactgtctcgcacaagacaaggaggggacccctagctgggcagcactaaacggagaagcactacggacgctagggacccagcccggtaccaccgagacaggacgagtcaccggagccattagatctgagacaagaagggcgagagtcagtgacgtggcacgaggaaccatgatcctagcgtgtggagacgccagtgtgtgggacgcgcgcacaataccagctgcatctagaacagagtcagatgcggacccattttcctgtgttgggtagggtcgctgactactggtgtgtgcaacctttacgctagcggtgatcctgggaactgctaggcagaatgccgttgcgacaggcccagatctagtcacattgaagcgccgttgctgcctgcccaaggaaatttaaacccccggttttccccccggcccaaggataacttcttcccaccaagaaaccattctaccgaacaatctaccaaaggccactctcggccgctggtgccgcaggggcggcggcccgtgctcctgcagcggacgaacatgggaggacgtgctccgcactccagaggccacccttccaaggaagccgggaaaaaccatggggaagcgatccaccgacccttcgcaagaatatatccccagcgagctcaggccagcacaatggacacacagggaaacccgcacgaaggcacacaaccgttaagataaccaacagaacagaatccaacaaacaacacacagacaacacgtaaggcgacacgcaaaccagcaatgagacctcacactcgcccaaaacaatcagtccaacagaaagaaaacacaa

SEQ ID NO: 672415 - DNA, 1436 bp, Homo sapiens
ggtcgaaccagcgtccggagacgcgtgggttgaaatggagtccttctatgacaggagaagactttatctgcagcaccctgactcgggccacatttagaagagctcaacatggatctgttccggtctactatgaagcccgtccagcacaagtgttggaagattctgattagacagcaagtctgcatattgcatgcaaattgttcttagttggtaggcatcagactcgcaattccaaaagcattcagcccacactagcgttcacaagcagatacatatccacaatggacaaggcaaccaatacccagtggacataaacccaagcatgcacagacatagatagaagtcatggttgctagcatgtcccaggcatggatgtgcatcattcatgggtgcatcaaaagcatcaccaggtgcacactggataatagcgttggatagtatggtaccctccaccacctagggatactcgacacactggtgcgagaagagcagctcacctgaccccaacaccagcagtccacaacgggacaccccaagctggaagcacatacaacaaagaaaacgacatccaggactccaccacacctacacggactctcccggactcccatccacgcgccaaactggataaacccaactagcacacggcgacccatccgaccacagctagaccacgcacaccccccagcacgcacaaccccacccacaccacacaccacccctgtgcgctaccaactcgcgccctccccggacaccgccgcaccaccccccacgccactggacatcccacaacaaccacgccgggcacacacaaacgacaacaactccgccacacgactacacaccactacagcccgccactaaccgcaacgcccccaccccaggcacacactacgccaacccgccaccacggcaaccacgcgcgatgccacacaaacacaaccgggcgaccaccccgctcccacacacccacaaccaacacgcaaacacctccccaccaccacccacaacaacaacgaactcccaggcccagggatagacactagcacacccacacgtgaaccgcacacacacaccaccacccaaaacggcgcactggcgcacataacccggcacgcgccgacgcagcacgacgcaacccgcacgccgagatcagcaaaccacacaacaggacccacgcggtcagcagccgtcgccggcacctccacgacaacaccacagccagcgaccagaccaccagcccatacacgcccctacacagccaaccgccccctgcaccgcacacgcaagcaacaacaagcgacaggctgaaacagcccgccaacgcaccagcccccctgcagcgaccacggaccaacacaggggcatgcaccagtagcaccgagacaactggacagcgccacgcaccacggcagtacacgatccaccgacgcacc

SEQ ID NO: 672416 - DNA, 281 bp, Homo sapiens
agaccttgtgtcccacgctggtggttcatggggtcactccattcacctgcactgatctgtgatgcccctgcctccagggctaggtagagagggcccatgcaggcggcctatcctgatccttggaggaggaggaagaggaggccactgaggcccgtggccttgctctcgggacgtggactcccctggaggttataaagggatcctgtgcttgggcatttcgcccacctcttttggcttagggaccccagcacactaacatatgggaggagggccccaccgag

SEQ ID NO: 672417 - DNA, 237 bp, Homo sapiens
ccggaccggctctttgtgtggctcttacgggtgggctcagttgcgtggctcttcgggtggctcctggggtggctcatcgtgtggcgcttggggtggctcatggtgtggcgcttcgggtggctctttgtggggcgcctcgggtggctcttcgcgacggctcagctccaagcccagtgccaggtcatctgggacaccattgattgtgactgacttcagctgcccatcctcctccacgag

SEQ ID NO: 672418 - DNA, 330 bp, Homo sapiens
tcagctcggcccaagttttacatgagcagatctctcctatgtgctgttgcgcaactatggctttgttggcggaacgcttgatgctaattaatgtgcgaaaaggcaatcgaatttgttttatcctgtatgaactattgacggtggatgtgcttgcagaccatgttctgaatcccatgctggtcagatctattgttgcacaggatttctgggctattacacgtcagttgcgtcatgctacattctgatttacttggctgttggctttgtgaacgacaattaccctcagagcgggctcaatggaaggccggagaagttaccagatgtatgcta

SEQ ID NO: 672419 - DNA, 916 bp, Homo sapiens
  misc_feature (805)..(805): n is a, c, g, or t
ctgaacccaaaacatcaaatctgtgtgggaatcgagcatatggaaaatctctgataccggcagtgccccggatctcagtgaaaacttcagcctctgcctcattggaggcgacagccatgggcacagagaagggagctgttctgatgagaggatccagacatctcaagaagatgactgaagagtatccagcccttccccaaggagcagaagcctctctaccactgacaggcagtgcttcctgcggcgtccccggcatcctccggaaaatgtggacaaggcacaagaagaagtctgaatatgtgggagccaccaacagcgcctttgaggccgactaaaggtgaccctcttcaagtgccctgtgttggccaaggttccccggacaagaggaaaaaccttcaggattgaaactgagccacacgcacctctgctagtagctggtccaaacccattatcctccctcactcattgattaccctgggatagggcacaggaaagaaatgtccctcgaaggcaatataaaactgccccttcttagaattgctaaagccattggtctgaaagtgactttgggaggtcataaagtttgtatctctatctttaagcaaaaaattaaactttcccagctcattttaaagacctccaaggaaggaaaaaagcaattcctctgtcttccttgtgagttgctctaaagtgtgtgattttctagtgtaaatggactttgaggcacttgtaaacacaatggttcttactgtttccattactgcatttacttcaccttgacaaggtacaattttcaaggacaaancactatatataaagttagtagttctaatatccacttgagagtatactcaagattgattttcatggccatttggcatgattgcatgaatctctatcctttatctgcagtttt

SEQ ID NO: 672420 - DNA, 389 bp, Homo sapiens
  misc_feature (10)..(10): n is a, c, g, or t
  misc_feature (385)..(385): n is a, c, g, or t
tgtgatcagncatctctgatgctactattgtaattgatttgtaatggcctctaagtgttcaagtgaaaggaagagtcaaatgtctctcactttaaattgaaagatggagataattaagcttattgaggaaagcatgtcaaaagccaaaacaggccaaaagttaggcctcttgtgtcaagcattagccagttgtgaatggaaaggaaaagttcttaaagaaaatacaaagtgctactttgatgaacacaggaatgatttaaaaaaaaaaaaaagcaacacacccttattgctgatagggatttagtggtctggatagacagtcagaccagctacaacactcccttaagccaaagcctaatccagcataaggccgtaactctctgcnatcc

SEQ ID NO: 672421 - DNA, 213 bp, Homo sapiens
tgagagtttttagagaggggctgcaaagaagaggtcgtccacatattgaagatgactgggagacaggtttaaggaagtgaggtttcgggctagagcttgtccaaagaaatgagggctatccctgaagccctgagggaggacagtccatgtgagttgttgtgactggagggtgtcagggctcagtccaggtgaaagcaaataggttttgggaat

SEQ ID NO: 672422 - DNA, 363 bp, Homo sapiens
atctcgaactctcttggtcttcaaagaaggagtgtcattcgtatcgggttctaatgattcgtcaggattaacagagagtcgattggctttcatcaccttttagacttcgaatgttctgtacacacctggatgtaagatgtcttccaaagccgtgtagacccttgtcacctagggtttatataagaacacagataatctccaatgccccaggtagttgcacaatagccaccgtatctttcttctaagacaccctagttgtctctgaacgcaacatatgtaacacatgttacagatataaataacagagcatagatgtagagttttatttcccgggtgcgcaaggcccctctcaagatgtgtgag

SEQ ID NO: 672423 - DNA, 362 bp, Homo sapiens
tactggctcgatggctaaaggaagagacataagtgttgttccctctgtgttcaaataagcaggctatcataggtatagaattaaagcccataggtttaggcgggcagcagtggctcatgcctgtaatcccagcactttgggaggccgaggcgggcggttcacgaggtcaggagttcgagaccagcctggcgcatatggtgaaaccctgtctccactaaaaatacaaaacaattagctgggcatggtggtgccacacctgtaatcccagctgcttgagaggctgagacaggagaatcacttgaaccctgggcagtggagggtgcagtgagctgagatcataccactgcactccagcctgagcg

SEQ ID NO: 672424 - DNA, 140 bp, Homo sapiens
aatcaaatcaaggggcttggttttaaagtaaatgtttttttaaaaaaaactgtgcttttttgttgacccaaacgaaaagggcccagccctgtaactgcacggcccttttgtcattgggaataaaataaatttttccgaga

SEQ ID NO: 672425 - DNA, 152 bp, Homo sapiens
  misc_feature (57)..(57): n is a, c, g, or t
tgagctgactcttgagtagtcctggtaaacgacgacactacttctgtgccgtcgtgngatgacggggtgaggaccgtggtatacgtgacacttcggactctaccctgggaggggggacgtggaaccttgcccgccccggaagacgcggtgag

SEQ ID NO: 672426 - DNA, 449 bp, Homo sapiens
  misc_feature (124)..(124): n is a, c, g, or t
  misc_feature (292)..(292): n is a, c, g, or t
accagaaagtacttaacccgtttatgccagaggttgcaattttttgaatttttgcatgagtgaaaaatcagaccttggcgatgaccttgagcagtaggctataaataattcccacatgctttangttccaataatggaacgctaggcatacgtgggttaaggggcatggtggctaatacctgtggtcccctatttgggaggctacggtgggaggatctcttgaagccaggagtttgaggccagcctgggcaacactgcaagaccccatctctaaaaaaatttttttttaatntactgcgcatggtggcacacacctgttatcccagcaactcaggaggctgaggcaggagggttgtctaagcccaggagtttgaggctgccgtgagctgtggtcatgccactgcactccagcctgggtgatagagtgggaccctatctctaacgaaaag

SEQ ID NO: 672427 - DNA, 869 bp, Homo sapiens
  misc_feature (202)..(202): n is a, c, g, or t
ggccagagaagacaagggcatgacaagcagcatgaagtgggggcccaatgggaggaaggcccgggggccgaggagcaccagtcggttcatgcagaacgatatccctcgcaacctcgctccaggatcaacgagaaccaagctgacgtcatttgagatgcgttggacagaaaatgcgtatgagggctgggcgcacgttgcgagnttgttcacgtcctgctacacgtgagcggcatgctcccacgtgggagactgatgcacgtggacctaaggaagacacttgtgcgtgtgcataggtggtagcattcggttcgcatacgagattatacgctcctcgaggaagaagatccgttagcgtttgcaacttctcagtctcgttttcaccagtgctcgttaccatgggtctttgagtcggggcttgggcttcatggggaatacaagggaggacatggtatctcaacggaggccatatgcgtcctatcttcccgagcacgctcacaaactcgctcacgttgtcttttctctaacaacacagttgtcagcttgtgaaggccatggaaccctgccccgaaaagaccgggggggtccctgcacactatattgagcccagaaagccgaaagcgggcaccgtaagggacaccccacggagacaccgttatcccagtggtcccctttcggatatgacgatggggatgcacatggattatccacatatacacaggggcataagtctagaaagaggcaatacaagttcggggcaggaaccaatgaacctgtctcaaaggacttaatccacgctctaacactaacccgagagcaatcccaagtccccaaactttgtacaggaacgaaagaaacaggaagggaaagag

SEQ ID NO: 672428 - DNA, 670 bp, Homo sapiens
gcatggcggctgagaccctgtacacgtatcctgaaaactggagggccttcaagctctcatcgctgctcagtacagcggggctcaggtccgcgtgctctccgaaccacccactatccattttggcaaaccaagccgcaccctgaatctctccgcaaattgcctgccggaaggtcccagcattagagggtgatgatggattctgtgtgtttgacgagcaacgccattgcctactatgtgagcaatgcagtgagctgcggggaagtactccagaggcagcagacccacggtggtgcagtgcggtgagctttgctgattccgatatagtgcccccagctcagtaactggtggttgttccccacacttgggcatcatgcaaccaaacaaacaggccactgagaatgcaaaggacggaagtgagcgcggaatcctgcggtgctgctggcaatgcattaccttgaaagaacaaagggaccttgacctaggtgggccgacaccgagatgacatttgcggatggaccactccgcaagcctgctttgacacccccatgttaggtgaacctcgtattaaagcaagggttacgtacgaacggcaccttctaacacaggagctaggcagtaccccaataccaacgccgctggtatcactccaccatgacatacaaccgagccc

SEQ ID NO: 672429 - DNA, 539 bp, Homo sapiens
tcacaggggtatgtggctatccagttgccaaatgacatatgaagagactgtctttccacatgtgtagtcctggcaccttgtcaagaagtcgattgattatagatatatgcatttattctgggctatccatcctattccatgggtggacatgtctgtgtttatgtcagtgccgtgctgttttaattactataggttggtaatatattttcaaacatggtagtgtgatgcctccagctttgttctctttggacctaaagtctattttgtctgaaataaatatagctatctctgttctctttttgtttgcatttgtatggaatatctttgtcagtcccttcatttacagtctatgagtgtcctttatggtgaagtgagtctctttataggcagcgcagagttggatcttgttttttatccatttagccactctatgcctgtggttgggagaatttaatctgtttacattggaagtaattattgataggtaaggacttagtagtgccattttgtgtatagttttctagtgtttctgtagaagc

SEQ ID NO: 672430 - DNA, 1881 bp, Homo sapiens
  misc_feature (294)..(294): n is a, c, g, or t
  misc_feature (300)..(300): n is a, c, g, or t
  misc_feature (303)..(303): n is a, c, g, or t
  misc_feature (477)..(477): n is a, c, g, or t
  misc_feature (503)..(503): n is a, c, g, or t
  misc_feature (562)..(562): n is a, c, g, or t
  misc_feature (569)..(569): n is a, c, g, or t
  misc_feature (593)..(593): n is a, c, g, or t
  misc_feature (604)..(604): n is a, c, g, or t
  misc_feature (653)..(653): n is a, c, g, or t
  misc_feature (663)..(663): n is a, c, g, or t
  misc_feature (673)..(673): n is a, c, g, or t
  misc_feature (679)..(679): n is a, c, g, or t
  misc_feature (684)..(684): n is a, c, g, or t
  misc_feature (723)..(723): n is a, c, g, or t
  misc_feature (768)..(768): n is a, c, g, or t
  misc_feature (770)..(770): n is a, c, g, or t
  misc_feature (807)..(807): n is a, c, g, or t
  misc_feature (842)..(842): n is a, c, g, or t
  misc_feature (998)..(998): n is a, c, g, or t
  misc_feature (1672)..(1672): n is a, c, g, or t
agtggttgtggttgttgtttgttttttgtagtgttgtttgtttgtttgctggctgcgtgtgtctgttgtagttcagttcgtctatagtcgtattgcactgttgtatgtggtcgttgttttgtggttgttgtgttgttgtggtttttggtggtggttggttgcgttgttgtgtatgttgtgtgtgatttttaaggagaagaatgtataggtcggattgaatagagacggaggacatgcgaaggatacgtagaattaggtagcgcaggtcgacgctgtcagtacggagacacgaanaaaaanagnggacccgtaatcaaagagaagtagcttgtgttcgttgagctagtccgttggtctcgccttaaggtcagttccggaacatgtgttgtgtttgtgttgtaggcgctgatgcgcctgctgggttagataggatcgatttattgtgttggttgctggctccctcctctcttgtggttnttgggtctaggcgacacgcctctccnctctcctgctctggtggttgggttcgttggcggactggacaacactcgcactctttggngtctgtngtttcgacactcacaccgctagcncgctgcggtgncgtgggtctttcttcctacttgatatagtgttgggtggcttcctcttcntatttgatgnatcaacgacnacgacnaagcntcattcgtgttcgtttgttgtggtgaaagacgacaccgnacccgaggtgttgctgctctgctctgctctaaggctgacttatgngnagcgagcacgtctcttgtgtgggggttgtgtcggcgncccacgccacatctcctctggctctgggctgtagntagtatcgcctgccgccgcacactgaaagttattgtcgccgtgtgctgctaggtagtatctgtgtctcctagcgatagttaggttgttgccgcggcgtctcctcccgcgcagctgtgtccgcttggtgttggtggtcgagagcagcacaggagagnaagaggcgctctctgtgtcgtttgttgtctgtccgtgctctcacacagcacgcacacccatcgctgccgtcctccttcctttggtttagtgttttttatgtgtgttgtccatgcggttctaccgcccctcctcctgctgtgagttgtaatacgtgcttttggcccgcgttgacacacacactcacgtcttggggtgggccaccgcctgcccgtattgtgcgcgagtgctatattacactctcccgtgggtctatgtgtgcgccagaaacatagtcacccccccgctcctgtctgtccctcgcctctttgcgcagtgtcgagactctctggtcgtctctggccgcgcgttgtctgtttagtttgctgtggtcattacttgtggtctccctcgcccactggccagttttgtgtgtccgagttgtctccgccccctctctggtgtgtcatcacaactcgaacggccgatatatcaacctctacgcctcctacacctgatatagacccgcttctggcacaatcccttgtgtctctcacatatctggcgagatcatctatgaacgccatgtctctctctctctagactatctcaaccgtgtggttcaacacctcagacggagctcactttctttatagatataatcactctgtctgtctgactcgttctctgtgtcctntactcgcgacacttataggcgcacacactctctcgttgtgtctgtagactgcgcgggagagatacatacatattcttgtctgcaccgcgctatcaacaaaactgctgtgtaatacaatgtgttctcccactcacacatcgcagcggcttctttgcatggcattacaaagagacgtgtctttgctgtcacaatcaatagtcagagaaata

SEQ ID NO: 672431 - DNA, 186 bp, Homo sapiens
gagagctggacgatggagcagataacagaaaaaaatgcaaatgtgaaaactcagtgttccagaaaaagagacagagagaagagagaaggaaaaagaagaagagaagaaagggaagaaaggaaaggaagaaagaaaagaaaaaaggaggagaagggggagaaaggcagtcaagggcagaagggttaa

SEQ ID NO: 672432 - DNA, 579 bp, Homo sapiens
caacttctggaattcggaaaagaattctaaattcacgtcttctgacgatcacagcactttccctgttcatggaggcccgttcactccttgtacagtcagttttctaagggcagggcgtggaggtggacttcctcccaggagtgggagctggatgaacagtgaagagtaaagccacgggaagccccagtcacgacactcacagtgtaacacagtgaacagagacaagcaccggaggaaatggagatcaaaatgtcactgccgctgtgtgaatctgtagctcaagccccattcaaggggagcctcatttttgacacaggcttgctggtttaaccaaatccctgttgactcttaagctgcctaagcggtttacaaggatgagcctccattcacaacaatttctatttcaggaaaaaccatggggatgggcgcggtggctcatgcctgtaattgcagcaccctggaagggtgagagtggcagactgtctgagcccagcagttcaagaccagcctgggaacatagtgaaacctcccgttctaaaaagtacaaatggcagggtgtggtcagctgtatccctgatt

SEQ ID NO: 672433 - DNA, 447 bp, Homo sapiens
  misc_feature (32)..(32): n is a, c, g, or t
  misc_feature (300)..(300): n is a, c, g, or t
  misc_feature (366)..(366): n is a, c, g, or t
  misc_feature (409)..(409): n is a, c, g, or t
  misc_feature (429)..(429): n is a, c, g, or t
aggactgattcacgcaaacccgctcaggagantccgttccgtcttcaaaaaacccaaaaagaagaacatggcggcactcccacccgatgagctgaaagagctcatggtggcaatcgcaattgccagcataaaaaggactacccgctgcctaattgaatggcagctccacaccatgacccgacccgcagaggctgctaccacccgctgggctgacatcgacatagaaaagaaggtctggacgattccagctgagcgcatgaagaaacgccgtatccacatcgtgccgctaacagaccaggncctagccctgctttgcagcaattcaagccctacagcgggacaccggggagttacgtgtttcccttncagaccgttaatccttggaacccacttgcaacagccaaaccgncaacatgggaattgaaacgnattgggatttggaaggac

SEQ ID NO: 672434 - DNA, 185 bp, Homo sapiens
gactctacaggatccttacacggtctgttaccacgttgcttcatccaggcatgtatcggttcagaaacgaattcttgccgtgcgctgcgcttgatggaaactaccgtgcgccggtagaggtggcccatgctaccgacgttacctggcatcagtatgacatgatttcatggcataaacaaattttt

SEQ ID NO: 672435 - DNA, 409 bp, Homo sapiens
ggatcccataccataacctccatctaaagtcaagacaaagaaagaatcttaagaactatgagacaaaagtgtcaggtaacccatatgttaatctaacttattagactaaaggacatttttcagcagaaatctcacagatcagaagggattagggtcctatctttagctgccttaaacaaaataattgtcaggcaagagatttgaatccagcaatcctaaggttcataaatgaaggagagataaattattttacagacaaatgctgacagaatttaccaattccaagccagcactaccagaaatgctataggagttctaaactcttgaaacaaaaactcgaagtacacccaaaaaaaaccttcttaaagcctaaatctcacagggaaagcaataactgacaatggcggga

SEQ ID NO: 672436 - DNA, 253 bp, Homo sapiens
aagaagacaggccccaaacaaaaccacccaccaaagccacaaacaagacttggcaagagaaaggagctgaaaaggctttcctaaatctccagtctgcatccacctcttttctttttctttctttttctttttttcctagagacagagtctcacttcgttgcccaggctggactgcagtggtgcaatcacagcccactgcctcgaactctcaggctcaagcaattctctctcctcagcctcctgagtagctggg

SEQ ID NO: 672437 - DNA, 199 bp, Homo sapiens
ctgctcctaggtgatgttaacacagagatgtggccaggcgcgtggctcacgcctgcaatcccaacaccttggaaggcaaggtgggcggatcacccgaggtcgggagttcgagaccagcctggccaacatggtgaaaccccgtctccactaaaaaatacaaaaattagccgggcatggtggcaggtgccccaatcccagc

SEQ ID NO: 672438 - DNA, 157 bp, Homo sapiens
catgtcgggcatctgtgaaagcaatgcacacgacttgtgacatatatgcaggcaactatgattctggatttaggtcctagcttgactttcctttagtacaactgttgtgtgattacgcaagcgacaaaactaacgcaatcctggctagacgggatac

SEQ ID NO: 672439 - DNA, 132 bp, Homo sapiens
tggagagcacgactaggcacggaggtcagacaggcagccgggcaggatgttagtggcccagggagagccgcaaacctggggacgcaaggggctggtcggcaagtgccccgggaacacccaccccgtacgagg

SEQ ID NO: 672440 - DNA, 109 bp, Homo sapiens
ctgagatcaagtgggcgacagagcaagactctgttctcaaaagaaaaaaaaaaagggcccttactataggcggggggagattgttaaagtgggttatggccatttgggg

SEQ ID NO: 672441 - DNA, 170 bp, Homo sapiens
gcacgaggctcttggtacctcagcgcgagcgccaggcgtgcggccgccgaggctatgttcgagtccgatttccgcactgagttctacgaggtggtccagagccagagggttcttctcttcgtggcctctgacgaggatgctctgagagcgtgcaagatccttcaggcctt

SEQ ID NO: 672442 - DNA, 197 bp, Homo sapiens
aaaatctcgcgcggccgagtaccctatattcttggaagaactttattgaaatgtcgttgacatactgtgcaatatcacccatttcacatgtacacgttaagtgatttatgtatatattcagagttgtacaaccgtcactacagtcagtttctgttatacgtattagtttatttgagatagagtttcgggtaccgagc

SEQ ID NO: 672443 - DNA, 1072 bp, Homo sapiens
gccacaaatagtggaagacggacgcagaaaggtggaggaaccacccccagcaaaagacgagtgtaggggacgacacgacggagtggtgagaggacgacccgcgcgtgggtcgggggggggcaccacgagacgaggagcgaggcaagaagagcaccggcagagtgacgcactaacgacgcgcaccacaggaggacagagggatgactaactctcggggggggggcacacaaagaaagagagtgggggcccgcgccttctcacggggagagagagcatgatcggtgtcgagagagggggaggccacacccctgctggtgggcgagaagaaacagatatctagtcgcagggcggggggattgagtataaaccaaaccgcatgggcgggagtatctatataaagaagagaggcacgcacagatcggacaaaatcttgcctccgagaaaaaagaaaaaatgtgtgcgcccacaagagggggcgcgcacacagagagaacacagaggagcgcacaacacaccgcgtgggcgcccacacacaacacacgggagggagctctccgaaccgtcgcacacacccaggggggcgcacgtccccactcactcttttgagggtggggccaccagaaagaatttttcatcacttatctcaaccacggaggattctatgtgagacgaagttgcgtctccccatgagacacacatgtgggtgtcgcaccctgtctctccccaacaccagggagcatgttctgtggggcttggggggcgacacaccatgcgtgccgcagagcactccgcgcaggcgagtacgcctgagcggtgtacgaacagatctccccccgacagcggagaaacctcccctgcgtctgtgttccaccacggctgttggagaggtcccagcgacggcggtgggaacattcttcctcgcggagacacacgggcaacttgggcacgaagaccccctcgggagaagaagggggggggggggacccccgaggccccgcggggggaaagaacccccccccccccggaaaggggtttttttcgggaaaaaaaaaacacccttttggggcccgga

SEQ ID NO: 672444 - DNA, 763 bp, Homo sapiens
actgttataacagcaacttcccaaaaggcatgtaactgcgctatgtaggggcacttctatgacttgagtaatcgaagaagaagcttcttgggttgcggaagaagatataatccaagagtaccgggtaaaaggcaaggctttgtccaggtgaatcagtggctatcctggttagaaaactgctgcagagaagacagaatcagaggaacgaagctgactaaagaccccagccagagccttaaatggtgcagagacatactgtggctatgatgtaactgcatttgagctaaccactgcgaaaatgcatcccgctgtaatgtttccacacctatttcaaagcagaagcgccgtcagatcaggatgccttccgtgcataaggttttgcgtagtcgtaaggtcttaatcatagtctaccatcgaatataaaggagtatctctaatgtcagatagtatattagcagcatgcaataagttactcagtaagttctcaagcagaaggcagtctattgcaaggaccttctatgctgccagttatcactaggctgtctgaagctacgacccactgaatagcaacactgaatagctgtagaaatgcacttgtgctccgtactacttgcacgttggtgcaataatttgattatccatggggttgtcaccgcaaaaattcttacctgacactgatgggctgtggcgacatagtatttaggctgaattctagctccactaaggggctcagttccgaagtctcatccctgactggcagtca

SEQ ID NO: 672445 - DNA, 368 bp, Homo sapiens
ggtcgactctagaaggactccccacatctcgactacgtaaagctggaggaggaaggggagtttgactaatagttctatatgtttgtgtcaaatttttcattaactgtgtatagtgctcaataccatattcatgaggggaatgtggaggactgaaagctgacagtttggacttttctttttgtacttgtgtcatgtctctcgctaactgatccattgctgtttcccaggatgtatgggatttagagtacttttgccatgctatagaatattcactttgtcatctgttataataatgcccttcagttctgtgtccagtctgaccaggttctatggtggtggtggtctagtgtcgtcttggagactgacgt

SEQ ID NO: 672446 - DNA, 192 bp, Homo sapiens
catcagtactatgagagcagcaaatatagagggaggagcaatgagacgtggcagctctcgtctaggttcggacagtacaggtagaatacctttaatccgaaaatccgaaaccctccaaaatccaaaactttttgacgcacgcaaccatgaccactcaaacggaaactgctcatggacgttttccaaatttct

SEQ ID NO: 672447 - DNA, 234 bp, Homo sapiens
tccagtacccgagcatgcatgcctgcctgccggtcgacgtgtatacaccactgccgtgcgtgcctccctggaacaagttccggcgagacatgagcagccgtcgcagagctccaggtttcgttcagctggagcctggtcgacgtgtattcaccactgcggtgcatgcctccctgtacaagttccgtcgacacgtgagcaccgtgctgacctccaaatatcgttgagctggagcct

SEQ ID NO: 672448 - DNA, 558 bp, Homo sapiens
  misc_feature (124)..(124): n is a, c, g, or t
  misc_feature (142)..(142): n is a, c, g, or t
gggtgggcaaatgctggctcactgccagctacaaatggttttacatttgtaaatggttggaaacaaatcaaaagaaaaacaatcttttgtcattcatgaaaatacgaaattcaaatttcagtgntcgtaaagaacacgttantggaacacagccatgcctattgacttctggattgtctgtagctgctttcagactacgatggcagagctgaagcattgtgacagttgtgtggcccaaagagcctagaatattcaccatctggccttctatggaaaacgcttgttaacccctgctctaggtgattctgacacatgcaggtgagaacctgctctgtccaatacaggcacaggccacatgtgactatcaaacacctgaaatgtggctggtacaaaatgagacaggttgtgagtgtaaaatacacattggaattgtggccttggtaagaaacacagactgtaaaatatctaataaccttttacattaaatatctattgaaataattgtattttggatgtatgaaattcaataaaatctattattgaaattaaaaaaaaaaa

SEQ ID NO: 672449 - DNA, 253 bp, Homo sapiens
cactgagcttgatcctctctaagcactaccccattatggcctaaacctcctcagtggaccacgggaaatcatgtaggcacaagggtttccactgatacaaacagacaacaaggccctccccataggttgagatatttttgatacagaaggcccaggccccccagatatggcttgctgccagcaagcagcaaggattctctcgtgggtaacgctgtagccaggcaggaccagcctcttctgggagacccctctc

SEQ ID NO: 672450 - DNA, 393 bp, Homo sapiens
tcacccagtctcatctctccgcagacttcagagtatcgacagagccgaaacagacacagcacttctcttcaactctatgcagcttctctccacttgggcaaccaatcttctatgcaatgcaggtcgagtggaactatgtacacaactcatacaactgaatcgaatattagaggtcactcaggaactagaagaacaccatggtgtggatgagcccagcagttcccttccccacaacgtctgcctccaggtgacccttcaacagcacacaggcagcacgaacttcacactcagcactctgctctacctatatccccctttcaaacaggcgacttatttttctctgtactcaagcaagtagtatcacaggcgatctggcagagggaggctcaggac

SEQ ID NO: 672451 - DNA, 296 bp, Homo sapiens
gacgaaccacgcagcagaaggtgagctgcatgctcgaagcttcatctgtatttacagctgctcccccaccccccgaccattgctccaattaccgcctgaactcacctcctgtcagatcggcagcagcattagactctcacagaagcacgaaccctattgtgaactgtgcaagaaaggtatgtaggctgcccgctccttatgagaatctaacgcctgatgatctgtcactgtctcccatcaaccccagatgggaccatctagttgcaagaaaacaagctcagggctcccactggtcg

SEQ ID NO: 672452 - DNA, 1036 bp, Homo sapiens
gggggagggccaggaggtcggtctggtggtggtcccccaggtccagctccaggtctgactcctggtccccctcctcgtggatcgctcacaagggtagcgcccgcctgcacactccagggattgcctccacctcgtcctggcatgactgcgacccaacggttgggtgacatcccactatggacctgccacgccacctggggcgtgtgaccacgcacatgacgtcccattgacccaaaacacctggaggctaagaacgtgcacccgaaacacaagcgttgacttccagagatgccgaaggacggattgattaccaagttgaagaatagctagttgagtaagaagggcgagaagaaagccatacaggtgacccaaggcgacgaggagttcactaaatcctcaagggaggagatggacatcggatttgtggccctacttggcacctggagaagtaacgtcgggagagacagtagagaccgcggggcattcacccttggagtgcgatccctcgccgaacaggcacaccgctccacgcagaggaagtgcaattaccctgcagtggtgggccattccttgtgcccaaagaaggacaaggcaagcacccaaaaacatacgtgcggcacgcggtcacagggataccccatggatgcgtcagaggataaacaaaaacttacacgcggatggaactagggtcccatacactagaacgacgccgttcgcaccacctcggcccagccggcacgcaacttgcggacaccgacggaactgaccgctggcattgccaccgcacggcaactagcaccggacgtccagccaagccaaacacaaacagagggccctaacccatggagtcccacagccaacaacaggcgatgaggcccccccagatagggcacagcaacacaacgaaagcgggccatcacatgagcttcacaaccacgcggataccgcacgttgacacagaagacacaggcacacgggcgcacatacccccaaccacgggtccacacagacgagtgacttatacgacccatacaaa

SEQ ID NO: 672453 - DNA, 107 bp, Homo sapiens
cgcgtcaaagcagctcaggagggagaagctgctgtgctttcctgaagcagcaatgtgttttcttgctgagcaaccaaaaccaagatcctgatggacagccccgaaga

SEQ ID NO: 672454 - DNA, 925 bp, Homo sapiens
  misc_feature (299)..(299): n is a, c, g, or t
aatgacgaaccgctaaacctcgccttgtcttaatctcatgatctagcgtagaggtgaatgtggaatgtatttaggcgaggttgctaacacccaagaaacacttagtcagttgaaatcatctgtttacagtacctatgatgggccactctggatatttgcatcaccactgactgaagagacgccaagatacttgtggcatgctaaactcgtgctggcatggtacctcccatgttatcgatgacctgttggaaaaggacttgtagtagaggactcgtaagtaacaattcataatcctagtntgtctaagctacatataaatcgcctaggtctcgtcggacataacctcgacatattataagggaaattgggtcatgcgtggccctaataggtcgtgtgtaacgattgcacgccagaggaagcaatactgggcgcaacgcgaactggacaggccgtacataatcttgggggaatcatggctggacatgcactaccggcagacgttgaggctgagaatcggatttggtgcctataggatacttctctgtgccttataggcctaattctctcggatgagataccgctgaatgaatggggattctgggggctgtggttcagagttgtattgagcctaagaggtgcttgggaatatggatctggagttctgaattgtgaagactggagcaagcgggggtagcccatataaggagtcgttctagccacggctggggtgcgatgttccccctgtgagtaatgtttgagtcctgcgtgcccaactctccagtgttgttatgaaaaaacgggtacggcacttaagataggttggtgttccagaagaaacctctggatactcttgggaactcgttaacccgctttttgggagcgtagaccgggccttccaacgaaggacgctttttgaaaccctctg

SEQ ID NO: 672455 - DNA, 259 bp, Homo sapiens
  misc_feature (107)..(107): n is a, c, g, or t
  misc_feature (109)..(109): n is a, c, g, or t
  misc_feature (161)..(161): n is a, c, g, or t
  misc_feature (176)..(176): n is a, c, g, or t
agggggttaaagggaagttcctggggtagaggagggcatgaatccctggctagggctcccatcaggggcctgtgtccacggacctaggtagatagccatttttgtcntnccgcccaaatgttggatttcccaagaccaccctggtctgccacagcccctcnacctgtgctatcccnactccccagaccctagcaggcagacacacaagcggctggacttctagaggaacacattggcagaagcagacacaacgcctgga

SEQ ID NO: 672456 - DNA, 533 bp, Homo sapiens
  misc_feature (12)..(12): n is a, c, g, or t
  misc_feature (45)..(45): n is a, c, g, or t
  misc_feature (53)..(53): n is a, c, g, or t
  misc_feature (192)..(192): n is a, c, g, or t
  misc_feature (206)..(206): n is a, c, g, or t
  misc_feature (496)..(496): n is a, c, g, or t
agtggtaagaanaggaacaaataaagccccaaaaatcccacctantttaaaanaaacaggccagccaggaaatccagggagtttaaaccctcgaaaacaacagtattaccccaaccgtacagaccccctattccctgttccaggcaagttgtcccccagtaaccgtcccttaccagcattgtttttttaaantccaggattccagncccaagatcatgcattccttttccacctgagttgtccgtgtctctttagtcatctttaatctggaacgattcctctgtttttgtctttcatgacattgacattttttatgagaacagggccagttagttaagctgcataaactctcttattttgagtttgtctgatgcttcttcctgatgatattcaggttatgcatttttagtaggaagactatataagtgatactgtgtcctccaggaggcatgtgatgttcctttgtcccattattggtgatgttaattttgatcantttggtgaatgcaagtgtaaaacatttgcaaggtaaa

SEQ ID NO: 672457 - DNA, 337 bp, Homo sapiens
agactgacaacagaggttaagacacgtgaacttcgaactatgtgtctgcaagtagcactgtgcagctttgtattataatccacacctactactcaataccttagaaaatcttcgcttccctactaatgtcgaaccagttacaaatcatataattacacagatggcttaactgatgtcgactgtttcttgagggcttcatgacagaaagatgagtgttctcggactctgtgctcttattgatatggaacagataccccaagttataaatcaggtaactggacagatatcgccggcttatatccttttatataacggattgaaaagagcatatgcctgc

SEQ ID NO: 672458 - DNA, 267 bp, Homo sapiens
tctagcaggacctggcagctatccggtcaattgtttaaattccttacagattctggatattcgaccttgattggatgcatcatttgtgaatattttgtaggttgtctgtttactctgttgatggtttcttttgctgtccagaagctctttaattaggtcccacttgtcaatttttgtttttgttgcaattgcttttgaagacttagtcataatttttttcccaagaccaatgtctagaatggtgtttcctaggttttcttctaggat

SEQ ID NO: 672459 - DNA, 732 bp, Homo sapiens
gatcgaaccactgctttccagcttgggtgacagaggtgagatcctgtctcacaacttctacaaacccgacacaggaagaaaggagaccccattctatcccaacaacatattctgataacacggtcagccggaaggtggactattcttatcctaccaggcttgtcggaataagtctcccatatgagataaaccgtggactactccggaaggaggagaaccacttccggatacaataggtctgggctgagctatgatctcaaggagagcttcctagggtggatcgtgtgagcacaaccagatatttacaagaggaaatagacgtgagacacacgagcatatttcacctccgcgtaggcataatcatcgctatccccacggagtcaaagtatttagctgactcgccaactccacggaagcaatatgaaatgatctgctgcagtgctctgagacctaggattcatctgttcttttcaccgtaggtggcctgaatggcatgtattagcaaactcatcactagacatcgtactacaacgaccacgtactacagttgtagactcactttacactatgtcctatcaataggagctgtatttgccatcataggaggcttcattcaactgatttcccctatctcaggctacacctagaaccaacctacgccaaatcattcactatcatatacatcgggttaatctacttattccacaaaacttctcggctaaccggaatccc

SEQ ID NO: 672460 - DNA, 461 bp, Homo sapiens
cggccaggcttggcagggccctggtcgaccaccccaccactgccctggccggactttcccagggcgttggtctcctggtccctattaagtcggggctgtcctgggcttggagcccaggttcagggctgtcagccccttgccagctgtctgagctctctgcctttctagtttattttcccccagctcttgccctgggttagctctctcccagccctccactctgtctctgtctccgactccatctctggcagggctgccactgtctctctgtctctctgtctctccctgtctctctgtctctgtctctcttgtttgtttcaaggcgcggacactgattgtgccttatgaagttctaactggttttgtgtcaggaagatctttctcgccgctacccagcctggcgtgacggattaaacatcaactagttaaataaaaattaatatcaactgcaaaaaaaaaaa

SEQ ID NO: 672461 - DNA, 269 bp, Homo sapiens
  misc_feature (94)..(94): n is a, c, g, or t
  misc_feature (246)..(246): n is a, c, g, or t
tgaccttgtatgtgacatggcttctgaacccttaggagagatatgatttaaagctaccaagatgctgtatatgcaaggcgtgcgaccatcatgnaacctacccgggcatcccactcgttgtgatttaagagcaagccgtggaaaggctgaacatctaagctgaagataacagttagtttgctctacgttcactcctgcaggaggcaggacagtgaaagtcagaataaaggcaaaacagtggtaacnttggtggtgtcttgaggtcacgt

SEQ ID NO: 672462 - DNA, 484 bp, Homo sapiens
gttttttttgcgttaaattttgaatatttcattttttcctttgacccaagtcatacagggagggggccatggaggaagttgcggcttttgcaaaataaatgcccacttgttatccgcccatcatacgttcccaataacattttttacttatttacactggccatacatttcccaaatcgtttttttcaaaaagtgaacattatcgcctgaatctttagcccatccttaaaagggaagcctacctgaccagttactttttttctatgttatacaaaaaggctcatattgggtttcattttctcacataagcaattacattccggtggaatgaaaaaagtctgccacaccattcctaaatttttaaaaaactcaaattgctctagcatttataagtttgactgccccctactggcgacgtataaaacgtatactggtcaagcaaatttagagactttggcaggtgtgtccaaaaaaacctagtagg

SEQ ID NO: 672463 - DNA, 962 bp, Homo sapiens
  misc_feature (43)..(43): n is a, c, g, or t
  misc_feature (62)..(62): n is a, c, g, or t
  misc_feature (73)..(73): n is a, c, g, or t
  misc_feature (78)..(78): n is a, c, g, or t
  misc_feature (139)..(139): n is a, c, g, or t
  misc_feature (147)..(147): n is a, c, g, or t
  misc_feature (220)..(220): n is a, c, g, or t
  misc_feature (244)..(244): n is a, c, g, or t
  misc_feature (324)..(324): n is a, c, g, or t
  misc_feature (329)..(329): n is a, c, g, or t
  misc_feature (346)..(346): n is a, c, g, or t
  misc_feature (382)..(382): n is a, c, g, or t
  misc_feature (385)..(385): n is a, c, g, or t
  misc_feature (389)..(389): n is a, c, g, or t
  misc_feature (394)..(394): n is a, c, g, or t
  misc_feature (396)..(396): n is a, c, g, or t
  misc_feature (398)..(398): n is a, c, g, or t
  misc_feature (402)..(402): n is a, c, g, or t
  misc_feature (412)..(413): n is a, c, g, or t
  misc_feature (420)..(420): n is a, c, g, or t
  misc_feature (430)..(430): n is a, c, g, or t
  misc_feature (434)..(434): n is a, c, g, or t
  misc_feature (440)..(440): n is a, c, g, or t
  misc_feature (458)..(458): n is a, c, g, or t
gcggggtgggggggggcggtgggagagcggggggctcaggcgngtgtgcgagcgggtgggtncgcggggggcnaggcncagtgctgcccctcctgggcaataatttagcgataaatactgcgcagggcaggggtagggnaccagggncactgccctgcaaggggtcaggcccctgcccgccctacacggagtggagcgctcgggcctcaccccgcatccnagccccagcccctcctcacttagntctttaataacctccatcccaccccagcgggtcccggggtcttctcccacgcacgcaacctcccctggctagacctgggnggggngggcgggggctggtcanctctgcttgggcccacctctcagcgccaggggggcnacngggntgggngngngggnggcccttgtnntgttgcnaggggggggntttntgtgcncactcccgtatggttganggcttcgggggctagcaggttgggggggtgggagggggggcagggctggggcacaaggttgctgggggggccagggcccggctggggtcaccaggggcaggggggtctcacggtttatcgggggcacactctggctcgggctcgggggacgcccatggtatcggggctgctgctccgggggcggggtgggggtgtgtggggctggcccggcgggtgtggtgcacgccgcggggcgcgggccgggggcggggcaggcattagtctctcagacacgccctgcctctgtgtggcactgattatgtactctactctcccgacctgctccaaggccagacagccaacaggaaggcaaaaatacaccaaaaagaattattcagtggcttctgggggaaaaatcgttaatgtgttggttcctttcaccaaaccacagcctaaaaaagtaactcacaagatcccagagcggaaacggtgcagcaggctgcggctccgactttccagatgtgg

SEQ ID NO: 672464 - DNA, 300 bp, Homo sapiens
tttttaaaataaaaagggaagggaataaataaagcgggttttttttttgccttttttacaaatctatcgccgggcgggaaacccggtttgggatatattgcccctggccctctccctttggatatgccccagggggctttatatttccaaaaacgggaaaaaatcccttttgggaaagggtcctcctatccagatggtacccaaagggtggtaaaaaaaacccgcctttttttgggatttttttttttagattttttttggggagattagccggccataaaggttcttttttgcctttta

SEQ ID NO: 672465 - DNA, 856 bp, Homo sapiens
  misc_feature (291)..(291): n is a, c, g, or t
  misc_feature (298)..(298): n is a, c, g, or t
  misc_feature (315)..(315): n is a, c, g, or t
  misc_feature (338)..(338): n is a, c, g, or t
  misc_feature (401)..(401): n is a, c, g, or t
gcacaggtgtcgtgaaacagctacccctaaatgcctcaatgggactaggagaagactcatatcaacattgtcgtactacttggagcacgttagatacgcggtcacacgttccagcactgcatacctgggcccatctgagtctattcatactgcggtgtgcactcgacataacagaagcctagttgatagaacattttgatgcaaggagggcatgctcgagcatggcgcagagaggagtgcctccgtttcaaagctattgaccgtgagggtcgttggcgatagacatgctgnaacagantctgaggcgatgaacancgctggctcatgcgacgcattgnagtgatctccgttgggggcaaacttgtgagaaccagctccagatgactcatcgcgtgactatncattgaatgtcccctaggagcacagaagtactattgatcgagaaatagcaatgagttacatgggcacattctcagtggctgactatgatgtctgatccatgaatgtgtctgcttgcctgaggtgatctgggtgagaatttgagacgctgagttaatctctcgagacgaaagtgggcgcagatgcgcgagaaggcattgccgcttgctgggcttgacacatctggagctgtggaaaatccaagctaaatttgttgcgggtagtttacacaagaataatcgggattgccatctgtacggccacccctacaggaccgaggacacagaccgattattgagaggaaatacctatgggttgacggcaaatgttcacagcatggtgtagcactttaaagaaaaaaggtatgggcgtagcaaaggccgccggaacaggcaggtaaggcaattatagttgccca

SEQ ID NO: 672466 - DNA, 317 bp, Homo sapiens
gctgagtaccgacgcagggaccgcgtctcgtgcgcctggtgctagtgtgactgagaggcattagtcatatcccacagtatgtagcatcgccccattggctcctcagccaagcacatacaccagatgtctgaacctgcggttcctctcgtactgagcaggattaccatggcaacaacacatcatcagtagggtaaaactaacctgtctcacgacggtctaaacccagctcacgttccctattagtgagtgaacaatccaacgcttggtgaattctgcttcacattgatagggagagccgacttctaaggatccaaaag

SEQ ID NO: 672467 - DNA, 585 bp, Homo sapiens
ccttcgtgctaccaagcctcgcccaatgtaagagggcccctgcctttgagatcgccacccccagggagcgggtggagggggaggggagcgggattttctcgcctcttccaaacttttcctccctgaccctgagggaaaattattgggattcccccccttgggttgataccccctcaaaaaggccccttttgattaagccggttgaaactagagagggccgggttatccacgaaacttttcagcctcccgatgcccttgaataaaaatggcccccccccggggccccaatattttccccgcaagaataaaaaagaaacccattttttaaagaaccggctttcaaggccctttttgcggtttttcgggggccccaaaaagatttggaataggaataagctttggtttttaccccccgccccccccccaagatttagaaaaaggtttcccccatattttggtttccagaaaatttttggggtagaaacctttttaaaggggtttttgaaaccccttaaaacggcttttttttttcccgcagggacccccccccctgggtttggctccaataaatttttggaaaaccca

SEQ ID NO: 672468 - DNA, 176 bp, Homo sapiens
agaggatccgaaactgacatgaggcaggtctcactatgttgctcaggttggtttcaaactcctgggctcaaaccatcctcccacctctgcctcccaaagtgctgcgattacaggtgtgagccactgcgtctggccttctaacaatgctccgtcacctgtcatctgtctatcatttc

SEQ ID NO: 672469 - DNA, 534 bp, Homo sapiens
  misc_feature (141)..(141): n is a, c, g, or t
gggggggtgggttgcgttgtttggccgtgtgggagggtctcactgcggtggggggtggtgttgctgtttttatgtgtgagttcgcccgttggtggtatgcattggctagcttgtcgcagtcgcggagcccccggcttcccnagctccgcaatgcggggatttctgccgccgcgcccccgcgctccgcacgcacgcagctccgcccccacgcaggggaggccccgccactccaaccgcgccgcgggggcctccaggctcccggcgcagacccagcccggctgcgccctgcgtcacgcacggagactcctccgctaccgcccccagccgggggtctctcgggccggaaggatgtcacgcgcctcccacaccggggcaagaggccccgtaccccccaacgcgatggaggaagcaatattgagcgcgcccctagcccccacccagcacgatcccgctcttgatccctcgctcagccctccccagggtagcgcgtgggctctgctccccacgagagcagacccagggcgcgcggccgct

SEQ ID NO: 672470 - DNA, 383 bp, Homo sapiens
tggcctcgaccttcaacgcgccgtcagaggcgggcagaaaatacccgtccgcccatatccggccaatgcgcgcgatcggtttgctcgacacggtgaccgcaagattggcagaataactatacgtcgttgtcgcgggccgggttttgccacccccgttgacagtccgcctttcgatcaaatcgctcgcccatataaccgtgccagcaaccctcatcgtaccaaatatcgctggaattgcagtgccatacctcgacgttagcagttccagtatctgcaggcgcgggccgtcgcgcaggggcccatttccaactatagcgcgatcgagctgctggccaagcattgccccaacagcaccgccgacgtgcccgccaatcgccgtgccc

SEQ ID NO: 672471 - DNA, 332 bp, Homo sapiens
actgtacatggcttgctaataactgtttggctaacccaaagcaagacaagaggcctgttctctacctggagaatgaaaacaaagctttgatggcttcttgggaagaagatggtgaaggggaatgggatggggggagtagcagagacttacccagacagcacacccagcacgaggttcagcataaaaaaggagccaatgatgatgagggggatgaagtacaaccagttccaagtgttccctgaggcatcgttgctctatgggggtgaggaaggaaagcaggtgagcactgagtggtactcaggtatgatctgacaggttgggggagaaggaac

SEQ ID NO: 672472 - DNA, 855 bp, Homo sapiens
  misc_feature (2)..(2): n is a, c, g, or t
anaagaaagacaagcaacagcacgtccgatagagaattccaccgaagaatgggattctcccatgagagccgggggaatagggaaccctgcggggagccccagcaataatgggggctggcagcacctatctctggtccgggcttcccgattgccgggcgttcagcgaattaccggaaatttggtgaccccccccgagaacgttacaatgggtaaaaaccgggggaatatagccaagtcagggtcatgcgccttacaccaacaaggggtgggccccgaccccgcagcgggtgcccatgcccccgctgtacctcggggcaaaaaatttgcccccaacaaaagggctacacccctgagggttgagaaaccctcgctcaagctcggggggtcaaaaaaaggccaccacaccctgggagcaagcatcatttgggaaacaaccatggctcccgccccttccaggaaagaataaatgccgcgcggattgcaccccccggagaagaaactctgggtcagccggccctgtcctatgtgtagtactcgcccgataatattctgtcgacctcagtgtgcccacaccctcgagagcggtcacttattgggggctcccacctagacccccgagtgtttggcaccccctcggtgttcacaatctttcagagccccgcctctggtctcagctacaaataacgccaagattttgccgggccgctattcggggcacccagtcgggtggcacgccactacatttgctaggaggtagtaggaggggggagaatcacctattgggggggagaaggcccacggcgtggtcacaacccacctatcccccccggggcaaaggaacctcttccacaaaac

SEQ ID NO: 672473 - DNA, 861 bp, Homo sapiens
agcggctgatgttggccaggtgtggatctcagacttctggcatcaaagtgatctttccatgcctgagtgtctcatagaatgctgggattacgggtatgagccactgcagccgtggtccctttccctaactttttccttatgataattgacaatccttgtgcattggatgcctttctccgagatcagtgatcagacgttgcatgtgacatttctgcctaaggtgcttctgtgccatcatgggagaatgatggccttgcaatactagactagttttaacttcacgaggaaaacaatgtttggtactccgtgaatagtcaagggactcctgtatggctcaacagtgtgtgtatatatgacgctggttcttcgttgcatccttgcgatagctttttacatgactcgttgttccagcactacagttctctatataggatatccgttggtatatgggatgtgctagtgatagtcaggctgtccagtgttagttcgaatcgaccagtggcaactgggacagcaaagcgtatcgtgcaggtcatgttccatagtgggagcgaagaggatacgggaacggggcctaaggagtagccaatcgtagtgcattcagcgaaacgtacagaggggactcatcatgtcattatagagtggcgtgacatgtcaagtggaacaaggagactgggatttcccgtggcgattagtaaagggtccaaggaacatgggagagtcgaaatggcatattggcggaaaaggcaccacttaccctccgttggggccgtcttatttaaacgcaaatgttacggccaaaattttggggcatggtcagagacgcctatggtaagtaggagcggttcctacgacattcca

SEQ ID NO: 672474 - DNA, 105 bp, Homo sapiens
tgctgcttcctgctgctctgttatgtgttcgcctatcctggaccgcatcaacatcggtcttcgcccagctgcagatgcagcacgacatcggacatctcgcgatga

SEQ ID NO: 672475 - DNA, 159 bp, Homo sapiens
  misc_feature (4)..(4): n is a, c, g, or t
  misc_feature (39)..(39): n is a, c, g, or t
tccntaaaatcactgtacatctggattctagtttgatcnttctttactatctacatgaatcattgtttttgggtctctgtacacttaatcaatttctaacaaactgtccttttctaaattctggttattaaaagtcttggaattatttcattcctttca

SEQ ID NO: 672476 - DNA, 888 bp, Homo sapiens
  misc_feature (90)..(90): n is a, c, g, or t
  misc_feature (92)..(92): n is a, c, g, or t
  misc_feature (114)..(114): n is a, c, g, or t
  misc_feature (729)..(729): n is a, c, g, or t
aacgggtgatgcgggcgcacgacagatggatcctgccatgtttcccgggcagatggctggtggtgagggcctggcgggcactcccatggngnatggagtttggtggaggcgggncctcctgaccctcccatggggcagtctgggctgagggaggtggacccacccatggggccaggcaacctcagacatgaacatgaatgtcaacatgaacatgaacatgaacctgaacgtgcagatgaccccgcagcagcagatgctgatgtcgcagaagatgcggggccctggggacttgatggggccccagggcctcagtcctgaggagatggcccgggttcgggcccagaacagcagtggcgtgatgggcggcccgcagaagatgctgatgccttcacagtttcccaaccagggccagcagggattctctggaggccagggaccctaccaagccatgtcccaggacatgggcaatacccaagacatgttcagccctgatcagagctcaatgcccatgagcaacgtgggcaccacccggctcagccacatgcctctgccccctgcgtccaatcctcctgggaccgtgcattcagccccaaaccgggggctaggcaggcggccttcggacctcaccatcagtattaatcagatgggctcaccgggcatggggcacttgaagtcgcccacccttagccaggtgcactcacccctggtcacctcgccctctgccaaccncaagtcaccccagactccctcacagatggtgcccttgccttctgccaacccgccaggacctctcaagtcgcccctaggtcctcggctcctccctcagtgtccgttcactcactggctcgcccagcaggctcaagtctccttccatggcggtgcacttct

SEQ ID NO: 672477 - DNA, 407 bp, Homo sapiens
ataagccatgatttctgcacgatggaattagtctatcaccttattcagtcacttgagcatgaggcttcgaccacgggtctccagatgctgacagtgtattcacacagtgtatcgatcccgtttagcgtcttgagtctcaaatcctcaatccagcgtgactggcaccatagagtttcagcacgtgctcttaacgctcagtgatgtataatccctgcccaccgagctgtcggattagcccttctcatataccgcggtgcgcagcttcataccagattctgtgttgatcgtccctaatgaaagcatagacctttttatatacttttctaacaatctcatagtgttgtgagcaaaggaagatgcacatgttgtgtgtcagttggtagctcactaatggtactccattacac

SEQ ID NO: 672478 - DNA, 165 bp, Homo sapiens
gggggcaggatggacaggattggagcccagagcgaactgggctgtaacagcttacggtaccgaagataacagccagggaggacaagcagggctgggctagggacagactgcaagaggcagtgtccactgggtctatgctgcattgtgtctcttgttgccatgagt

SEQ ID NO: 672479 - DNA, 155 bp, Homo sapiens
actaacaccagcgaaagctaagccatcgggctaatatccccatagccagtgaggtgacttccctggtcaccaaggcagtgcatgcatgttaggggtttcctttaccctttctataagttgtaccaaaacatcccatctcgtctcttctcttgtaa

SEQ ID NO: 672480 - DNA, 1117 bp, Homo sapiens
  misc_feature (234)..(234): n is a, c, g, or t
agcgggacctgtggggggacgccggtgctggcggcagacgacggactgcgctgggcaccgggccgccggcgccaccatggtggtgactacaggcgctgggaccgcggcttgcaagctgggtcgtagcggctgttgctggcgattttcgacaggggcgaaggcccggccgggtcctgatcggctgtgggtggcgggccgaggtgccggtgggcggggctggtgtgccggcggggnatccgtgcccaggtctggggccgacagggacccaggggtcagctgagacgcccatcgcgagcggctcgcgcggctcgagagtcttccctcataagagccgttctttcctgcggtcttcctttatttccccggggctcccaatttatttcccggggggtttggggccccccggaggggcgcttaggggaccggggtaggccctgggtcttgcccatgccgggccagtatgccgctgagttgacgagagaccctggcgaggcctgccgtcgcgggccctttgtcggaacgagggacagaactgaccttggacgctgtcggcgcttacggaggccttgtggggcatcaattcgttagggatacaatacctagggtcagagccaagcgaagccccggggactgggcgccgggatcatcggagctcgttgatcgacgagaagaagttcctatcgccacaagtttttgatcacacctaaggacaacaaggccaataaggcgccgggggagacccctagtaatccccaggtgtgtggcagggaccgtacataacaggacgttagttcctgaggggggacgtttacccagtggacccttggagaccagcgccaaggctaattcacctggaatctgacgcgagcggacacacgtggtgccctagacttgtggtgcgtcacaaccagggggagccgttgtgtcaacgtggtgtgcctttggctcctggattgctttctgttagacattgttccaaccccccacgttggccaccttaacctatatttttgtcctccacccaagggaaaaccccgttggtgaaaggggtggacacgccaaaaagcggaaggcccaacccgccgcggtgttataggccgtttcccctagggggcaa

SEQ ID NO: 672481 - DNA, 172 bp, Homo sapiens
tataaacattacacaattttttattattaaatgagaaaatctcatttgttacatcgtcacttgctagtcagaggaaatgttgcagtgttgtaagaaggtcatttttggcccaacccaggtcctcgttcctacaacttttttttacaaggaagtagtctttcaacacaggccc

SEQ ID NO: 672482 - DNA, 211 bp, Homo sapiens
accagctgctcttttaatcattaatgaagctagcctgtagtctgggaggcatgtcaaaaattctgtttcgggtttggtttaaaattgagtgtaatggagagagactgattctttcatctcagagaattgggctgtctttgagagctggggacaagaactgggtcctgtaataggacactgtggagttttttttgctgctcctcaaaggaga

SEQ ID NO: 672483 - DNA, 150 bp, Homo sapiens
caaatgtaagaaaagggcaagaggaaaacaacctaaaaagcagcctaagaaggatgaagagggccagatggaagaagataagccaagaaagagccgtataaaaagaggggagagagagttgatcaaaaggaaaattagctaaacagagtt

SEQ ID NO: 672484 - DNA, 356 bp, Homo sapiens
cacagtggctcacacctataatcccagcattttgagaggcaaagacaggagaatcatttgaggccaggagtttgagaccagcctgggcaacatagaccctgtctctacaaatttttttatattagctggatgtggttgcacatgcctgcagtcccagctacccgggaggccgacgtgggaggatctcctgatgcaggagtttgagggtgcaatgggccctaattgtgccactgcactccaggttgggtaacagacagagctgggtaaccctgtctctaaaggaatggtatcttcacattctttctctttcttccttacttggagtcttagatatcttgtttttggttacagttctt

SEQ ID NO: 672485 - DNA, 110 bp, Homo sapiens
tatcaggtgccgtgagcagggggagctgcagaccagtcttcgggtggcaggctgagcgctcaagtcttcagtagggaatggctgaataggcacagagggcaccttgtaca

SEQ ID NO: 672486 - DNA, 176 bp, Homo sapiens
ctgcacagtgtccccatcgctgacaaagggatggttatacaccagcgatcttcccaaatggcttcctactgccttgttcttcagactcctcaagatagactccaccaccatgcaccgtctgcttcaatgccatgaaccgatgaggagacctgaaagccacagtaatacagtgacat

SEQ ID NO: 672487 - DNA, 318 bp, Homo sapiens
acttgtccctgtgaggacttcattccggtgatcaaccttacgacagtgctatgtatgtggacaagccttctctcagagctcatctctcactgtgcatgtgagcagccatacaggggagaagccctatggttgtaatgactgtgggcaagctttctctcagttctcaacccattgactctgcattaagagaatacacacaggtaagacagccttatcagtgcagtgaatgtgggaaagctatcagccagaagtcacaccacattagacaccaagaaaaattcaatactccaactaaaaaaaccccatgaaaggccttga

SEQ ID NO: 672488 - DNA, 327 bp, Homo sapiens
caggtatttggggggactgagacaggagaatcccttcaacccgggaggtggaggttgcagtaagtcaagatggcaccactgtgctccagcctgggggacagagcgagactccatctcaaaaaaaaaagggaatcggacgaaaaaccacaggatgttgaagacaactgtctgaagtatttggtgagggacagcgatgtgggccctctgtgttaagaataacgtgtccggcttgggcagagagaagaaaatagccacggcccgctttcagggcaagatcgaccttttctggtttggtttggtttttctttctttttccgggccatgagg

SEQ ID NO: 672489 - DNA, 945 bp, Homo sapiens
tcatgtggccaggttggtctctaactcttgacctcaagtgatccacctgccttggcctctcaagagtgctaggattacagacacgagccacggcctgacctgaactgtggggaaaagaaagagagatcagtttgttactgtgtctgtgtaggaagaagtagacataagagactccatttgttctgtactaagaaaaattcttttgccttgagacgctgttaatctgtaaccctacccccaaccctgtgctccctaagacatgggctgtgtcaacgtcagggttaagatggattaagggctgttcagggtgtgctttgttaaacaaatgcttgaaggcagcatgctgtgttaagagtctatcaccactccctaatctcaagtacccagaggcacactacactgcggaagactgcagggtcctctgcctaggaaagccaggtattgtccaaggtgttctccccatgtgatagtctagaaatacagcctcgtgggaagggaaagacctgactgtgcccccagccagacacccgtaaagggtctgtgctgaggaggattagtaaaagaggaaggaaggcctctttgcagttgagataagaggaaggcatctgtctcctcctcgtcctgggcaatggaatgtctcggtgtaaagcccgatgtatatgccatttactggagatagggggaaaacaacctttaagactgggagggtgggaaacttgctgggagcaatactggttcttaagggtgggaagtctctgttattggcattaaaggccagcttttcttacgtggtgttaaggcgagaacttggtgagggtcccgcgagattttcactggtctcttggtggcaagcccttgaaaggcgaataaaaattggagcaagggggagtgtgtgaggagcggggattttaaaaagggggataaggaaactaagatagataagga

SEQ ID NO: 672490 - DNA, 618 bp, Homo sapiens
  misc_feature (448)..(448): n is a, c, g, or t
  misc_feature (485)..(487): n is a, c, g, or t
  misc_feature (572)..(572): n is a, c, g, or t
cggtacggatcggcggaaatggcagaggtggaggagacactgaagcgacgcagagccagaagggagtgcagggaatcatcgtcgtgaacacagaaggcattcccatcaagagcaccatggacaaccccaccaccacccagtatgccagcctcatgcacagacttcatcctgaaggcacggagcaccgtgcgtgacatcgacccccagaacgatctcaccttccttcgaattcgctccaagaaaaatgaaattatggttgcacctagatataagactatttcctgattgtgattcagaatccaaccgaataagccactctcttggctccctgtgtcatccttaatttaatgccccccaagaatgttaatgtcaatcatgtcagtgggactagcacatgggcagtcgcttggaacccactcacaccaatccagtgacgtgtgtggggggnggctcttctccccaccaaggaacccctgtgtgcaccnnnttccccagagctcggagcgcctctctcattccagtttggagcagagctgcaggagccgcaccagttcttctgaccttcagttcanttgtcgccttggagaagtgttttcttaataaaataacaaatgtcaa

SEQ ID NO: 672491 - DNA, 198 bp, Homo sapiens
agcttgtactactgtcttaccatcttctttttgttttttagggtttattttttttctttttttgagatgaagtctcgctctggtcccccaggctgcggtacaatggtgcaatctcgagtcattgcaacctctgcctctcgttgttcaagagattctccgggcctcaaaaaaaaacacacgaacacacaaaacaaaaaa

SEQ ID NO: 672492 - DNA, 207 bp, Homo sapiens
  misc_feature (2)..(2): n is a, c, g, or t
gncacatgtgagagtactgcgaggatacgaaatacaagtgtaacgtacagagctcctcccgtagtaagcaatgttctgaattggaaaactctcaggggggttctgtggctaagaacttcaggaatagaggggaatcacaaaacatagtacgaattgattcaggaatgggaaggatagctgtctttataataccaggtttttccattg

SEQ ID NO: 672493 - DNA, 283 bp, Homo sapiens
gaaaaaaagctttgagggattggggatggggaagttctccaaagggttgtatgaattttcatggaacaccaagtccaatagtttatttacccttttgaggccagtgttttggcctgcagtcccaggctcctcaaaccccatgggttgaaccaagttaaacttttggccccctgtagtgaaaaaaatatttagaaattgacttagcatttaaacccctttaaaccaatttgccagagtaattttatgtctattggatgtaataaaaatttggctttgggcttta

SEQ ID NO: 672494 - DNA, 521 bp, Homo sapiens
tagtactagagtgatgcagtctgtacctgccacagtacttatttgctcgagtgaaagctgggagagggaaaagatccttaagttcggtcacatagcttttgacaagtaaagtaacgtgtatagataccaaggatgaggatgtggataccatttcggagctattatttagtctcgccgacgagctctcccgtaaacctgtgcgctatattcttgtataagatgagaactaaaggactcatttgccttcctcgcaggaaagctaggacacgaagacaaagagaacaaaatccttacattgaacttgcttcttcccatcagcgctggcatggaggagccctcttgcaccaggtagaagttggcagcctgagctctggagccagacttctggggctaaatcctggctctgcccttcctggtagaggaacataggcaggctcccccactcctgccagcttcctcatctggaatgtgggaatggcagtggtgcctagcgttgtggttgttctgaggatgaaaggaat

SEQ ID NO: 672495 - DNA, 1153 bp, Homo sapiens
  misc_feature (141)..(141): n is a, c, g, or t
gccctcggcctccttatttgcgagacgttatagggaaggggagggcgggtggtgattagcaagcccgcgttgggtgcaacttgtgggtgtccactccgggtcccgccgccgtgttcgacgtggatagagtgtgcacggtgngtgtctttccccttgtatgatgtgtcgtggtgtgttcgctagtagagttcgtccttgggtgatgtgggccccgcccgctgtggtgcggccgtggaagccacgcgatggtcgttccgcgcgcgtgtcaaaccttgtactccgtcaaaatattctgtcttacacaacgttcttcgcaacagacacggcgcttccaacagggggaatatttatgtataatcacccgctgttctgtaaacacctaattttcgcttgggccccgcccacactgtcactgtcctctagaggttcctctccactgtcgcccccgcgttccccaacttcccctctaattcgcccactttcccctgtttaatacacatttgactcaccggcattcggcatggggtttccacacgcggaggtggccccccttggcccccgttgttgcccacttccgcaaagtgtccgcacgtgtgtggcccccccccccacgtgggtgatccttgagagcccctgctctcggcagcggtatgccactcccgaggctctttcccgcgccgcggagcctatatgtgtcgttcacacactctcgctcacacacaaaacttttcccccacactctatattttccctatgaatcccacgcgcgaaacactcgcgagactccctctgaacgcttgaccacacttcgaggtaagtatactctcccgcaattgtaaagccccccacatctttcgtataaataaattacactcacccaagacgcttcttgcacacttcactgaggactgtccccaccacattaagggctttaaaaccacagaatgccacatttcccggagacgtttataaccccaaccacactttcaccccctacaccaccccggggtatactaacggtccaatgctctgaaaatctgtggacccaaccccaagtttcaatgcccctcgtcctagaattaattccccttaaaatctttgaaatagggcccgtatttaccctatagccccccctttaccccctttagagcca

SEQ ID NO: 672496 - DNA, 762 bp, Homo sapiens
taaccagcacatcaggtccgcgcgcgcagtatgacaaggagcctttggcaagattatgacctaacaagagagtactggcgtgatcctcgaacctcatagttttctcccactggccagtcctcttgtgacatttattcatcagtacagggcgtacgattgctcctagtacattccaaaggctgcttgtcatagaagccagtgcatctataaagcaacggctcctgttaaaccggaatctcctgttctagaggctcctacaaacagtcatttgggtaccataaacagtatgtgcattaacaggcaatgcgtctcagaccacaaagtagaaagaagaagtaaagctcgctgacgtaaatcaagggctgggcttagacagagctgatctgtagaatatctttaaaggagagatgatcaacttatctgcactattctccagcctctgactcctccctgtctaccctctcccctccctctctccctccacttcaccccactatcttgatcaacttcctttctcttctgtgaacatcattggccagatccattttcagtggtatggatttcatagtctatattctattcaacttgaaagaaactggacattaggccactatgtgttgttactgccactagtgttcaagtgcctcgtgttttcccagagatttcctgggtctgccagaggcccagacaggctcactcaagctctttaactaaaaagcaaggaagccactccaggaccacgttcatcctgtgacacaccct

SEQ ID NO: 672497 - DNA, 592 bp, Homo sapiens
ggcaattaaaggctgcagtgggccatgattataccactgcactacagcctgggcaacagagcaatgacctccagctaaaaaaaaaaaaaaaaaaaaaaaaatgtcaccactcccatcttaagcaagtaaaaagcggagtaaacggaaaaataaacagttcttcttagatccataaaagatgggaggtcaaagagtaacccccaaattgggaaccacaggtcaatgcaaataatcacaacttatttattgggagcacaattcttcatggcaatcagtgctgaattgggaaaacctaaagctgtaattcacaacttggctggaggcttggtggagcacaatgtctgtgagataaaaactttatttggggaggctccccacaagtatgtgtagattaacctccgggggctcatactaggtttctcacagtgaattttggcaagcaatcctctcatgctctccaccaaggggagagaaaaaggacccatttttgaaatgccctaaaggcattctgttctaaaaacacaaggtcgtcccctccaggaagaaaattactataagtggaagcctaaccatgctgggggtttataaccag

SEQ ID NO: 672498 - DNA, 949 bp, Homo sapiens
  misc_feature (2)..(2): n is a, c, g, or t
  misc_feature (250)..(251): n is a, c, g, or t
  misc_feature (391)..(391): n is a, c, g, or t
  misc_feature (468)..(473): n is a, c, g, or t
  misc_feature (504)..(504): n is a, c, g, or t
  misc_feature (510)..(510): n is a, c, g, or t
  misc_feature (539)..(539): n is a, c, g, or t
  misc_feature (580)..(580): n is a, c, g, or t
  misc_feature (663)..(663): n is a, c, g, or t
  misc_feature (665)..(665): n is a, c, g, or t
  misc_feature (673)..(674): n is a, c, g, or t
  misc_feature (683)..(683): n is a, c, g, or t
  misc_feature (689)..(689): n is a, c, g, or t
  misc_feature (695)..(695): n is a, c, g, or t
  misc_feature (705)..(705): n is a, c, g, or t
  misc_feature (798)..(798): n is a, c, g, or t
  misc_feature (805)..(805): n is a, c, g, or t
  misc_feature (843)..(843): n is a, c, g, or t
  misc_feature (876)..(876): n is a, c, g, or t
  misc_feature (932)..(932): n is a, c, g, or t
angctcttctacacattttacaaatgattcttaatcctcacaacagatctttgattaggtttttaaggcaaaactagttctttccaaaataacctaatgatcacaaaacatatagaacatacaactctgcatcttgactatggtgcgtaggtctacatgtgataaaatgacattgaactatacacacatcatacaactatcaaatccctccttttgagattgtactagaattatgtaatatgcaaccatnnggggaaactgggtaaagagtaaattggatctctctgtactatctttgagtagtgtttaggtattttataaaaataatgtcctacagtttgggtttgtcaaatggttttctcatagttagataggggttatggcttttggngagaaagaccacagaggtctgtagtatattttcaactgtaatctatttcaaaataaaaagttttaaaaaaattcccnnnnnngggctgcttagtaaattgcttcgtcctttcncccccncccccccccccccccccacactccccccnccccaccctcctattaattccggtaactcgggttgtttggngtgtggttagtgaaactaagcttaactatgcgcttccagcacctcgtatctggtacttctgttcaacagaaagccttgggggngngggggggnnggcgtggtnaaaggnacaggnttgggaaggncgctcggttccttccaatccaaacgagaggcttctgattgtttattctcacaccagagccgtgaccgagacccagaggtccgcttccggccanggccgancagctgcaccgtgcgtaccgggaacggtcaaggcgcantgggaaccgctgcaaaaggcctccgggcgtacnggacaggtcgcaaggtcgggggtcccacctagcggaaattcacggaggccaacccnccccctgccccgcgagg

SEQ ID NO: 672499 - DNA, 790 bp, Homo sapiens
  misc_feature (745)..(745): n is a, c, g, or t
cctacaacgcgccgcgggcccccccccgggtgtcccctctttgtgtgcgcgcgagggacactcgcgcccccgctcataatctctctctgctgtgtgtgagcgcgcacacacccccttgtatcacgccgcgatgtttgtcaccctgtgttgcgcgcgcgggttgtcccccccgcgggcagcatcattattattgtccgcccccctccgccggggaggaattatttattcttcgccgcccgctcctccttgttgccgccgcggcgcccccggccgaggatgtttgtctccttcgccgaccaaaaaaacttccacactggtgccgccacgctggtcaatttgtggtcttcgccccggcacagcggggtccggcatggtaaacattgtgcgggtgcctttcacaccccccacgttgggggcacccacccagccacttccgtgttggcaggcagccacgcggtttggcgtctctctgcgagtctctctctattggcccgcccaccgcgcggtttagttaggcccccccccacaccacgcctcgcattgggtccgcccccccctcacgtgcgcttgtgttgtgtccaataaaccatgtgaggccgccccacgcagtatgttgtgtgcgaagacgccaccaacggtggtgttggcaaaagttgcgttacacccccaccggtggtaccgcacgggggccaccaccctcactctgggtgtccgccgcccccagccaggcagtgtgataaaaaantgtggtggggcacgcactgtttccgccacccatccatggtacgag

SEQ ID NO: 672500 - DNA, 210 bp, Homo sapiens
tgtatgtgatctactcgctacagactatctcaaggaactgtccttcagatgacacacaagtcaatatttctgtaccattctgcagcagactcctgaaaagctgtcgtctaccaatgtagtactggaatatacatcaaaagggatgcaaatcaagaagaaaaaagggatgttctagttttatttctagagatagcagcaactattttagaa

SEQ ID NO: 672501 - DNA, 121 bp, Homo sapiens
ccatcaggacaccatggcagctttgcatgaccctgcctcccagtgtcttcctgcgtttttccttaagttgccttcttctttggttgtttccctacttgttttgttagactgcgggaggcag

SEQ ID NO: 672502 - DNA, 708 bp, Homo sapiens
attccaacactcaaaattcaggggtcaagtccaacaaaatgaggtatgtatgtcacatgtacatagtactaatgatggcattccgtatctcaaagaggccaaagtgaatcacaccagttatctgaagggtcctaaaaatagctcagtatgtcctaatgcccatgcacctactttgacataggagtgcaataaatcctgtggtcgatgctttggttttccagagcacgctagatattacgatgtttgaaatggatcatttctacttgctgtgctttttaaccaataatctgatgactatagaacaaatgatccaaaatatggatatgattggatgtatgtaacacatacatggagtatggcggaaattttctgaaaaatacatttagattagttagtttgaaggagaggtgggctgatggctgagttgtatgtcactaacttggccctgactggttgtgcaaccattgcttcatttctttgcaaaatgtagttaacgatatactttattctaatgacaggcctttctaaaatttgtgtccactgcattctgtgggtattcactacttcaagtcccgtcagaacttcgtagaccgacctgaagtttcttttgaatacttgttcctttagcactttgagatgaaaaaccacttttaaggtactaagtcatcattgcccttggaagttcctctgatggggttggaagacgtc

SEQ ID NO: 672503 - DNA, 333 bp, Homo sapiens
  misc_feature (197)..(197): n is a, c, g, or t
cagcaacttttgcatttttgtaggggcggcaggcccggttttttttttgggaattcggcagcccctttgtttgcaagggtttaatcccggggattgcttcctttgtccggggagggtgcgcctcagggctttaccccaatgcttttgccccggtggcccagtttgtaaattggtttgatttttttttccaacgttcngaggacaacccctgtccccccccccgggacccggacccggccagcaggacccctttagaagggttgcccgggtcccctcagttgccccccccccccttttccagcttttggcccaataaacatttttttttttgta

SEQ ID NO: 672504 - DNA, 183 bp, Homo sapiens
ggctaattttgtatttttcagtagagacggggtttcgccacattggccgtgttggtcttgaactcctggcctcaagcaatccgcctacctcagcctcccaaagtgctaggattacaggcataagccactgagcccagccctagttcagtatcttttatgtaaattataaacatctgcaccatt

SEQ ID NO: 672505 - DNA, 385 bp, Homo sapiens
  misc_feature (188)..(188): n is a, c, g, or t
tattcgttccttttgcccggtgccaagcttacggaacggttggatcacccgtcgccagagtttgtgacccgggggtcaacgcaaaagctgggccgcaccgtgggggggtgggggttttatctgtgctgtaacacgaagagggggggggatgtcggggttccctaggtcggaacaccatccggggaccngggggggtcctttggggggggccttggtccccccttttccaaaccctttcaggcccggggttcccattggggtttggggggggggccaacaagccaggttgggggttccttttttatccccctacttgaacccttttggccccggctttttcccttgtttgaaacctgattcctaataaagaattaataattcccca

SEQ ID NO: 672506 - DNA, 790 bp, Homo sapiens
tggacttataggtatgtattatctatttccgtttgatgacggtgttcgcctctgttgtctaagctggagtgcagtggtgtagatctcagctcactgcaagcttggccttgcaggttcaagcgattctcctgcctactaccttccaaggtgctgggattgcatgctgtagagccacgacccagccccagttgtgcatttctaacagccttctgggtatcgtgatagctataggtaattaggatgctatagggaaaaatatacttaaggtcaggccattgtttattcttccaagggccatttgaatatttgtgaaacacgtgcatttctttagctgctagttaaatcccttatattcagtgggtcgtatagcttttcctcatttttctttatccttgtctctctgttgagaagagcttcgctcttgtaagcccaaggctgggtgtgcaatggcaccgatctcggttcactgaaacctcctcctcccgggttcaggcgattctcctgcctgagcctctggaatagctgggatacaggcgcgtgccaccacgcctggctacattttatgtatctatcacgtagaaacgggtgtttcaccatgttggccaggctggttctgaattcctgacctcagtgtgatttcggccgccctcggctctgcagagtgcttgggattacaggcattgagccactgacccgggccagtaattttatttattgagtgcctataagcatgttggggccaggcaatttacgagatatttggccatcttcagcaaaactgcagggatta

SEQ ID NO: 672507 - DNA, 130 bp, Homo sapiens
tcatggttaaactctcaacaagctaggtattgaaggaacatacctcaaaataataagacccatctatgacaaacccacagccaacatgtgggttggctgaatgggaaaatgctggatcagcggatcgagt

SEQ ID NO: 672508 - DNA, 263 bp, Homo sapiens
aacagggttagaggggcaggcctaatcaactgaaactcctcggagatgccatctctgcctccctgggtgccagcagccctgctgccatgttcactggggtggcactggagagccatggcagacgtgagatattgcatgttgtatgcacatgatcatgtgtgtatgttcgtgcgtgcgtgtgtgcgagagcgcgctgtgatcctgcctcattcagtttctggggtgaaatcagcttcttctttcccaagtgcactcccctggat

SEQ ID NO: 672509 - DNA, 564 bp, Homo sapiens
aaactgactacgttactcatcagactgaagcgagctgcagccaggtgaactgtaacctggctcaaaggtgcacacaaggcgcatcctggtgcatgcactaaccatgacttgaacgttgccactgcacaacttaagataagacgactgcggtgggcatcggggggacctcgccttagatacatcatgtgccgctccatgcactgctctgtctcttggactctgtgagaaggatccacctagtgactctgcaggtcctctagacgggaccagcctgaagaaacatctcaccatttcaaatccgatcttctcggcttagcggtgaagactgctgctcggttgcctcggaagccctatagaccatcacggatgctgagctttagactaaggaaaagctatatgaggatacagcaagagggcagccaactacattccgtggaggacagccctgaaaccaacactgatggcacctagatcttcaacttctggccatctgggaactgtgaaacaactaaattccattgtttaagccaacaaacacacaaacaaagacacacacacaaaaca

SEQ ID NO: 672510 - DNA, 587 bp, Homo sapiens
ctgggcacttaagaaggcgaggctccatggctataatggaccccgtcccttctctattgcagacaaattggatcgtgatgtactcgactcctgtcctcctaagcaaaaggtgaggctagctgccacttcctgaggtcctaattgtcccagcttcccaattgccgcaccacatgacatcctctaaagccagacattcagccctttcctcatatcagtctctgatatcatgtccagggaagttcaagagtgggtttccacaagtttccatgttttcttacacatacatttccagaaataaaatgtgattcctttgaagaggaaaatgagataatacattgaattagatacactaaatatagaatgacacagtaatctgtgcaaatcacagttcttgttcaacctactttcatactgaagatgcagcaaaactgtgaatgggcaaaacgagatggcctcgagaagagagatcaaatggaaaggagaggaaagaactcagtgctgcctattagtagttaattctgtcactcaccactacatcaccttgagacaaatctatgccactcagaatctccttctttcctggactt

SEQ ID NO: 672511 - DNA, 195 bp, Homo sapiens
ccgcatactaactcaactcgagacgaccagaccctccagggatgcgaaatcaatctgtatgtcattaagcagcatattccctgaagaagattgctgatgacagtggatttgtcacccagctcagtgtcttttcctgagcaataagaatttcttccatggggaatgaaacctactgttgtttccctgtttgaatcc

SEQ ID NO: 672512 - DNA, 450 bp, Homo sapiens
tgcgggaccctatcctagaagctttttacaaacattgttttatttgacccttataacagatttggttcaggaataacgaacagattcaccaatgtgtctatagtatataagtgttgaaaacaggctcagaagctctttagaatatcatgagatgaagggatgtggggaattattcaattcaactatctgtattttgcacttcaagaatctgagtaccagagttaaaaatctggacttttggtggatgttcttaccatctgtgttaatgcaagagggttggattagtattatctcacagggtatgggaatggttggtgtgttccctgtatctactgtgtagtgtaaagttttttgatactagctcaatatattatattaagtggcattttatcatagatgaattacaggtaccataggttttagggggaatttataacattaggtagcagc

SEQ ID NO: 672513 - DNA, 485 bp, Homo sapiens
ctggtcattttaaggtgacactatgattctatttccattttaaaaatgacaaacacgaatgcacacatctcctaaaggaaaatgtcatttatgtaataagttgctttaatacaaaatgataagaccctgaaatttatttatttgctttttgaacccttgtgactagattatcaaaattaccatttgggtgtattttttttctttctactcgaagcaggaatatgatagagaaatagctccaagataagaaaaaggaaaacactgttgatgtatgatatgcaagataataataataatagaagatttaaaatgaccgatttaagaaaatcctattctctcctaactttttcctaacttttacttctattaattattcatacagtagtccctttttgtggggttacagtattagggatgaaacaggaataacacaaagctcttcctaatagatgtgctctgtaagggaatacaagctgcttatggcc

SEQ ID NO: 672514 - DNA, 820 bp, Homo sapiens
gagacaatgtggggcgcctgtaacgttgacggtgcacgattccttgggcaccattggcactcactctgagacggtacctgagattgggggcgagcatggcaaaaagcaatgttcgagctacgtgtagggacttctgaggctggacgacagctgcactgggcgcacatgctgggtggtacgtgcggcgcatggactagccgggaatttccatcgggttctagcttgagaacgcgcaagttctgcagaacccaatagacacgcctgtcgcgtcatccaagactcgatgatccaaattgtgcgcacgactagtgatagtgaagaactcagtacggattcatctgtcgcttgccggcggttactgggtacctcgaagctggatttgaagggtaccaggcatatgtagttgattgccacaggcgggaaagaaacgccaagtatcgcgctgtttgacaccgagggaacaggacggccagcaagaggttttcaaatggaacttcatcgttgggcctcattccgcaggtattgaccataccgagcctactggtggtgtcaggtgtgtgtgagagtttgactctcagaaggggagcgcagggcccacttttgctgatattcgccgcgcgagggcatttcagtaccgtggaggaggaagatccgttcgtctcgattactctcccacgggataggcgacgaagcatgtgtctaaacggggacgtgacacattcaagtattgggcggatcgaacgcacgattacgtggaaccctttagataaagtgcttgacatgagatcagcatggtggtcttgtgggcgactttgttaag

SEQ ID NO: 672515 - DNA, 402 bp, Homo sapiens
tgatgagctggtaccgacatctgcaccactgggcttggtcaggtggctcacacctgtaatcccagcactttgggaggcagaggtaggcggatcacctgaggtcaggagtttgagactagcctggccaacatgatgaaaccctgtctgtactaaaaatacaaaaattagccaggtgtggtggcatgtgcctgtggtcccagctacttgggaggctgaggtgggagaaatcgcttgaacccaagaggcggaggttgcagtgagatcacaccactgtgctctagcctgggtgacagagcgagactccatcttaaaaaaaaaaaagaaggccgggggcggtggctcacgccggtaatcccagcaactcgggagactgaggcaggagaatcgcttgaacccgggagg

SEQ ID NO: 672516 - DNA, 739 bp, Homo sapiens
agtaccgcctgcggagtaactgcaaagatgctgtccgtgacgcgttgactgcggccgatggtccgcgcccattccatcggcgggccggactgggtctcacagaaatgctttgggttcatcttatacattgcatgcaaggaacttccatgcctctaacactcatcttcaacacagcactgggcactgcatgagcatgtcctctcattctctgcacagcagcgtcattctttggcagcatgataacctcatagttgcatcttgcaagcaaacgtgggcgtagtcttacagtcattagcggtgcatcggtcattgccccgcgtacatggggcctgaggcaatagtatccaagccagcacagcacacataggtcagcagtataatcatacaagaggctatacacaggcgtccatgtcactatgcacacctactggcacacccttgccaccaccaaatggtactggatcgatataggtccgatggttctccgcgcacaatcgcattcacacacctcacagtctcaacagggcacagcgccagcattcatcagtgcacaagcaaggcaccaggaagacgccattcgggtgggaccagatagtccacgatttggcgtcgaccgcgcacgcactgcatcgaggatcaagtggtcaggtctgcaaatgccccttggagtacaatggcttacctaaggcatagggaaacacgggggtacccaacttcgggcttcccaacagaccgcccg

SEQ ID NO: 672517 - DNA, 594 bp, Homo sapiens
  misc_feature (7)..(7): n is a, c, g, or t
  misc_feature (74)..(74): n is a, c, g, or t
  misc_feature (93)..(94): n is a, c, g, or t
  misc_feature (96)..(96): n is a, c, g, or t
  misc_feature (160)..(160): n is a, c, g, or t
  misc_feature (164)..(164): n is a, c, g, or t
  misc_feature (183)..(183): n is a, c, g, or t
  misc_feature (190)..(190): n is a, c, g, or t
  misc_feature (248)..(248): n is a, c, g, or t
  misc_feature (273)..(273): n is a, c, g, or t
  misc_feature (368)..(368): n is a, c, g, or t
  misc_feature (375)..(375): n is a, c, g, or t
  misc_feature (377)..(377): n is a, c, g, or t
  misc_feature (381)..(381): n is a, c, g, or t
  misc_feature (394)..(394): n is a, c, g, or t
  misc_feature (446)..(446): n is a, c, g, or t
  misc_feature (466)..(466): n is a, c, g, or t
  misc_feature (529)..(529): n is a, c, g, or t
gaaaatnaatgaacattagggaaatttccttaattaagactctccaaaccaggtgtggtagctcatgcctgttntcccagcactttggggggnngnggtgggtggatcacctgaggttaggggttcgtgactagcctggccaacatggtgaaaccccgtntctnctaaaaaacaataattttntttcttntattagctgggcatggtggcatgggcctgtaatcccagctactgggggggctggggcnggggaatctcttgaacccagggggngggggttgcagttagcgcgagatcatgctattgcactccagcctgggcaacaagagtgaaactccatctcagaaaaaaaaaaaaaaaagactctntgggggnanggcncatatgacctggngaagctggttgtggtgtaaggtcatcactttctgcaaagcatttagccagtnagcggtgtcaggtggcagtnacagcccaggttcttgcctctggcctgggtgcttagggggttcagaatgagtgagtggaagtnaaaacaagagggatctaacctactacataataatctaaaaatacaaacttttaactattttaaga

SEQ ID NO: 672518 - DNA, 221 bp, Homo sapiens
gccctccctgtttccagggccccacccaaggttccaagggctgagactttcttttggtaacattccttcagccttcccttcccttgggaccccaaagaagttggccccccccaagaaaggaaaacgggcagccccggtttggggacgtgaacgttttaataatttttggtggattccctttccacttaataaccccggattttggtattaattaaatttgt

SEQ ID NO: 672519 - DNA, 721 bp, Homo sapiens
  misc_feature (398)..(398): n is a, c, g, or t
acaaaccctgtctggggttgggtgtgggtataatactaagttgagatgatatcatttacgggggaaggcgcttggtgaagtaggccttatttctctgtgtcctttcgtacagggaggaatttgaagtaaatagaaaccgaccttggattactccggtctgaactcagaatcacgtaggactttaatcgttgaacaaacgaacctttaatagcggctgcaccatggggatgtcctgatccaacatcgaggtcgtaaaccctatggttgatatggactctaaaataggattgcgctgttatccctagggtaacttgtcccgtgggctcaagttatgggatcaatggagtatagtaagttcgctttgactggtgtcagaagtcttacgcatgtactggctncggacggttgagcgtgttctggctccgaggtcgccccaaccgaaattttcaatggcaggttcgggtagtttaggacctgggcgggtttggacaggtactggtttggctattaatcaaattaaagctccatagggtcttctcgtctggctgtgtaatgcccgcctcttcaggggcaggtcaatttcacgggttaaacagtaagagacagctgaacccttcgtggagccatccatacgggtccctatttagggaacacgtgattatgctacctttgcacggttagggtaccgcggcgtaaacatgtgtcactgggcaggcgctgc

SEQ ID NO: 672520 - DNA, 248 bp, Homo sapiens
cccccctttttttttttaaaccccccccttgtttttttaaagggacattttttttttttaagggggggaatcctttaggggccgggggggggggaattcccccccttttaaaaattttcttttgggggccccccctttttttttttttttttaacaaaaatgaaatttgggggggttgaaaacccgggccccccccccccccctttccccttttttttttttaaattaaaaattttttttttttttta

SEQ ID NO: 672521 - DNA, 133 bp, Homo sapiens
attgggttcactgtctggtgggggctgcttattagtctcctgtgactagtgtgttggcaaagagatcacaagtgtcatccaactgtggtcatgaagtgtcatctgtgcatggtttccatgtgtcatcatatac

SEQ ID NO: 672522 - DNA, 422 bp, Homo sapiens
ttcgattggcgggcacatagtgagacttgtctctacaaacaatacaagcatagcggtgtggtgacatgcaccttggttcagctactagggaggctgaggcaggaggatcgctggaacccaggagttccagaccagcctgggccaccatagtgagaccttgtctcttacgaacaatacaagcgatagccgtgtgtggtgacatgcacctatggtttacagctaccagggaggctgaggcagggggattgcttgaggcccaggaggttaaggctgcagtgagccattcttgtaccactgcactccagcctggaacaacagagtgacaccctgtgtcagaagaaaagaaaacagaacaaaatcagaacagaggaccaattattgtagtgataagttgcccggcaatcgggggtaccgagactcga

SEQ ID NO: 672523 - DNA, 428 bp, Homo sapiens
  misc_feature (56)..(56): n is a, c, g, or t
caaattcccggggaatttttattaatattataccttttaatttttaaaggaaaaanggtagtagtatctgtaaaggcttactggaaatacacaagtgtaggtattatgcccacactatgaaacattactcagctttaaaaagaatggcctagatctacatgtatatatggaaaggatttctgaggctcagttaaatgaaaaaagagctgcaatgtatgtatgttataacgccattagtataacagcaaacccaaatgctgttttacaagtgtacattaataaataaaggcatagaaaaacttctgggaggatgacagccagttaccaggtttcctttgggtcgggaagtaaaactgggggcagggagacatcctgcctatcctctgtatttgagtttttaccaagaaaagtgttcacgattaatttta

SEQ ID NO: 672524 - DNA, 970 bp, Homo sapiens
tccaaaaaataaaacgaaagggagaaagaactagatccctaaactgtggacatggtagcattaaagatgccggacaaaataaaagggcctctgtttctagatgcaaagtcctccctcccgggtgccagcctggccctgcctgccgatgagtttgctgggaggagccgtggatggtcctggtggttttccttttgccactcctggcgccgccaaaaattaagacaataataataataataataataataataataatgagacccccacacaaactgccacaaccaggaaggcaggagtaggccatggctattaatactcccaaagcatttgttcccattaaaatggaagacgcagctactgtgaaataataaacattcatttttattgtgatttctaaagcctgtagctttggatcttgaaagtaaatgggcttggcttctgcattttccctgcagtttttggcagggcttcctgcacggaagatggagggctctgaaatagaattctgagtttggagaaccaattagagggaggacacgtaacaggcaccggggcacaagatggcagcaccctcggctcgtcttcacgacagaaggaaagaaggtgacttacccgaggtgccggaggatggaggcgtcttctccaaagccaggaagtgaaaatgacgtccctgggcccagccggtcacccgggtgggggaggagggcaggtcccgccggccagcaggctgcccggtgccagccccagctatgggcccacgggccccctagtctctggccgccgccgtccctcggtccagtgggcccggctgggcctcggccaccccggcacagggggcagggctgccaggagccatgtggtgctgggggaaggccccgctgccagccccggagtacgaggaaaatgctacttttgtctcctgctctcatctggcactggctgcccggggagggggggcagaggcggccgc

SEQ ID NO: 672525 - DNA, 186 bp, Homo sapiens
ccaaacttaacaattcagtatttctgtttcatattcctatggatgaccataccagaatgtgtctgattttcatactgtcctctgtgatctgtaatcctaagtgtgtgcatccatttaatcaacacataataataggtaattccaattcatggagtccaacatatgtactatggcataaaaaaaaaa

SEQ ID NO: 672526 - DNA, 159 bp, Homo sapiens
atcatatagatgtctttatgaaaatgttttgatatatgtacagagattttgtttcccaagtcttacccagacgagtatggcaattagatcagacatttctagcagcagatttcccctcccatgtaaccgagctatcaaatttctgtcttagctaatgca

SEQ ID NO: 672527 - DNA, 201 bp, Homo sapiens
cgttgccatgtctgctgctgtgactgagctcctcgtaccttggtccggtaccaggactcgaggctcagaccggctcctctgagcgatctcctcgtgttgggccttgacctcagcgatgatgctgtccaggtccagagttgctggtatgtgttgtaccatggtagtagcaccacgagatgtgtctgaaatgtgggtctgcat

SEQ ID NO: 672528 - DNA, 353 bp, Homo sapiens
ctttatcagagctgtatctcattaccgtgacttcagcatagggggggccacttccaggacaaaatttaaatgattgagtattgatattttagtgaaaaacagaaaaggaagtaaaagtcaaatctaaatattttttctttattttttttttatgaaataaagtctcgctctgtcacccaggtctgaagtgcgggggtgcaatctccagcacatgcatgctccgcctcccaagtccacgccattctcctgcctcacactcccaagaagctggaaccacaggcgcccaccaccacgcccggcatagcagttctgtaataaacatttgctggcagagatgaaaactaattagtaaa

SEQ ID NO: 672529 - DNA, 378 bp, Homo sapiens
  misc_feature (313)..(313): n is a, c, g, or t
catacctacgtaaaaccaagatctctagggctcgatgctttcaagactccagagataactgctaatacaccatacggacggagatctgaagaagacattaatgcaaaaatgcaagcacgcttagaaaaaggtggtttatttgcaaacgtggaggccaacttcatgaactatgggacgaattgctatcgtatgtatgaccaagagtctattcatgatttctggtagtgatggcactactctacactcacagcaatctgctatacatgatttagagtagaagcgcataactgcttatctgacactgaaacagagnatacatagaagggtcagtgtcaaaaaatcatcagcagcagatgaaggacgggggtcagacacgag

SEQ ID NO: 672530 - DNA, 433 bp, Homo sapiens
gatgtttcatacacggatcccccctcgaaacccagtaggctgaataagcaggatgagctttcccgttagggtgtagtagataaacacattctggatcctttcaaagcttctctatccaaatctcaccatctcatactcctcctattaagatcaggctttccatgtctaattgcactatacagttctacgctgctggacacattcatgatttcccttctttcacatcctgtgcccctcctaaatatacccattctgagcccttatactactttaccgtctatttggtcggttagtcgatccctattgcctctctttggcacaaaagtatcctatactgcctttgtggatcagcttgctatccccgtcatggctgtccatatctggcgctcacagtttccttttcaccttagtctctcccacatctattagtaac

SEQ ID NO: 672531 - DNA, 349 bp, Homo sapiens
taagggacaggacaccaaccactacatgcagatatgtgtgtgactggacagagggtactattgacatacagttaagctatatagaaacagaatgaataaatgaactttcttcttatttctttattattgcaagaggtaagtaaaagattcaatttgattcttctagaggggggaaaaaggagttgaaagtaggtcttcattttgcagtcatcatctgtacgaattcttcatagttagacttgtccgtctccatcaatatctgcttctctgatcatttcatctacttcttcatctattagtttttctcctaagtttgtcatgacgtgacgtagttctgctacacggctat

SEQ ID NO: 672532 - DNA, 190 bp, Homo sapiens
gggggtaaaaaaacggagccaaaaaaaccccttttttatttttttttaggggttggggccaaggccttaaggaatttcccccttttggggtattctccccctgtttttttcccgggtttttttttccccaaaacccaacccttgggcctttaaaaccaaaattttccctttccccctcccccccccccta

SEQ ID NO: 672533 - DNA, 155 bp, Homo sapiens
cgatgcgaataagccttcccccatcgtgtactgcagagttgagctggcaggtgaggggctgcgagggtgttggctggaacccctccccgggtcgagtgacatctgtgtcttccatctagaactgtatacatgaagataagatactcttcgggcat

SEQ ID NO: 672534 - DNA, 1111 bp, Homo sapiens
ttcgagcttcctagttgctggatccacgccaggtttctgagatcactaggtagtgcgattgctcatgacttgcagagaaatgtgctttcggttcactatagtgactagtctagagataaagcccattcatcctcaatgcgacttgatcaatcttctgtgtgcgcaccatggtctagtggagagagaagaagcaagtcgtggattggacttgcattcctctctcaaacataatctaggccatccctcctttatgtacacttgtatcagctatctgcttcaaatcgctgcgtcaagagatggttcatgagtaagactcaggattgatggggttgctgcagaggacgatcgttaaaatgggctagagccgatacggtgggcgtgagaccgtttagggtgtggtgtacgtcttgaaccctagatggtgtgtgtagcggcctaatttaatccgcaggagtatccttctggagtttctgcccctctttgctcattccttgtaagacaaaagctaaccgaaactgaaccgccaatttgttatcaatcacatcgtttcatacatcgactaagtaatgttcgttggaagtattactcccccaggttcatatcccttacaataggaaaagtagtgccatggttaatttaaatgggaactctaaagtgatttaggttgggcaaagaattatctcccactacttatataagctaatcgggaatgtataggccgcgtactcatatccttttgtagggacttccaaaagcccttaaggtactaagattgccttcgaagacattccgggtagacacacttaaggactcttttgaaccgcgttgtgccctggtcaattcggacaccgggaatgcggacccttacatgacgattgatgggtatccaagaataaccatttacgccagaattgagcaaagaggacgtttcaaattccccaacttgatagaccacccaagagaaggctacctctggattaggaagcattcgccccaaggccctctgcagggttccaggtacgaaaaaccccccaataagcgcttcaaaagccccatgctggttttacaatgaagggattgaccccccttctataactattgaatggaacag

SEQ ID NO: 672535 - DNA, 214 bp, Homo sapiens
cggatattaacagctctaactgataatgtacaacatgcacgagggcgagacattttcacactgggatgacagctcgctgtgataacgcacatattaggctttctgtgcctggcactatacaacgtctgaacaattgtttaactgtcagtccatctgttgattctcaggcctgccacggtgggtgcgcacatatctggccttggcgcagcgtgcc

SEQ ID NO: 672536 - DNA, 624 bp, Homo sapiens
tcgagctcggtccctcttgatgcaagtgtcgagaacctgccgttgcacgaaatggctctgctccatgacactgtaatctgctgttcagaatacaggcgatgaggtattcgcaggtctttacttgaattcagataccaggtctacctcacagacaaccgtggaactccagagatggacttgactgtgtctccaagactcttactgagggacatggtggaaatggatcggggtgtttgccgtggacagacctccttgttatgaagtgagaagtgcgaggaagatggcttggtcaagccttacgcacacaagctaaatttgagattaggaagatacattggatggagaaagctaacaacgcccagaccaatatggtagggttatttcactttctagatgatgaaaacagagtgtcatatggaaggcttaggggagaggggtattagattgttcagctgattatctgttctcttatgttgtagtagtggctttgttccttgtccagaagtaattcgaacttgtccaattattgctctgtaacatcatctgcctctacaaaccctgctttaagtcttttaaggaagcatcagcaatcaaacgatttttatgcaattgtgggtgagtgta

SEQ ID NO: 672537 - DNA, 416 bp, Homo sapiens
ggtgaggaggtgaataagatacagtcattgtcctaaaggagctcacaacctggtgggagaaataggtgtaaaaacagataatgaccgtaatgtactaagagctgggctagaaggctgtctaggaattgttttatgtacatgtagagtatagggcaaggacgaatcaaggaaggcttccaaaaggaagtgatatcacaagctgggtattgaaggataaataggagtctgcctggtgaagaaatgtaggaacgttattctgcttatcaaagcagaggcaaggcaaggaggtagaaagcagattggagtgtgctggaactccgggcagagggatggtcctagagcccccagctcactaccttctccctccatattcctcacagccgtgccatctccaccccgaggtgtgatctccaatg

SEQ ID NO: 672538 - DNA, 618 bp, Homo sapiens
  misc_feature (376)..(376): n is a, c, g, or t
tcacgcctgtaatctcattactttgggaggccgaggcaggcggatcacctgaggtcgggagttcaagaccagcctgaccaacacggagaaactctgtctctactaaaaatacaaaattagccaaatggggtggcacatgcctgtaatcccagctatttgggaggatgagacaggagaatcacttgaacctgggaggcggaggttgcagtgagccaagattgcgccattgcactccagcctgggcaacaagagcaaaactccatctcaaaaaaaataaccaaagcaggaagattgcttaaatcctggagttcaagaccagactggccaacatagcaagaccccatctctacaaacaagtttttttttaattagctgngtagggtggcacacacctgtggccccagctacttgcgagactaagaaggcaggaggatcacttgaccctaaggtgtagaggctgcagtgagttatgatcacaccactgcactctagcctgggcatcacgagcaaaacttcatcccatgaattatctccccgccaaccccatgttcggccgcttcgtcccagtcgactctagacttgggcaagcttattgatcccgcccgaattccggttccc

SEQ ID NO: 672539 - DNA, 166 bp, Homo sapiens
aggacttctaaaaacttacggcaggacatgtaagggttaactgagagggtagaacttgttagtgtaattagggataattggtagctgtcaaagtttatctctcaaacattgtcttagccagtgtattcttgagactcagactgaagacagaagcacaagattctgc

SEQ ID NO: 672540 - DNA, 660 bp, Homo sapiens
  misc_feature (483)..(483): n is a, c, g, or t
  misc_feature (492)..(493): n is a, c, g, or t
  misc_feature (504)..(504): n is a, c, g, or t
  misc_feature (509)..(509): n is a, c, g, or t
  misc_feature (514)..(514): n is a, c, g, or t
  misc_feature (517)..(517): n is a, c, g, or t
  misc_feature (521)..(521): n is a, c, g, or t
ccgtagctggcctacggttcctggcatgcgagccttcgtgtccgcctcgtccatgtcgttggactttaggcaccggccggtcacagctccggacacttgagtgtctgtgagcgtacctaggtgcttatagggtctagcttggattcttccacgagctccagcttgaggttcctctacggcaagaggagcttgtcccgggcgttcgtcatttccgacttctctgcttcggaggggcgcaatatcagtgtcattcagtcattcagcagtgtctacttcgtgatgggcccttcagcaagggttgccaggtaggccattcggcacctgtcgaagctatgtgagccccctgatgccaccgagcaggggcagtttcatgaccgatgtctggctgaggctgtggcggacactcttggggttgtttgcaggaaagcaggcaggagggatatgggcctggacgacacggcctcgcagcaaagtgggtgagangagcagtgnngggggtgcggnggggnggggnggntggntcccccacacctcccacctgcattgctctccctcgtgctccccaaatcaccacaaccaaccaataccgcaatccatgagggactcctcctgtggaaaaggagagctgttccagaacacagaactgatctcaggtttttg

SEQ ID NO: 672541 - DNA, 901 bp, Homo sapiens
agacacgcgccaccacagccagctaatttttgtgtttttagtagatttggggtttcactatgttggtgaggctgatctcaaactcctcacctcatgatctgccccctcagcctcccaaagtggtgggattacaagtgtgagccaatgcgcctggcctttattttttatgttttattattattattattattttatttttttttttttggagacagggcctaattctgtcaccaaggctgaagtacaggtggtgggatctcagctcactgcaccctcagcgtccgtgggcttcagcagtcctcccttctcagcctcccaagtagctgagattataggcatgtaccaccacagcgtggctaattttggtattttaagataaagaccgtggtttcatcacgtttgcccaacgccgtggctctgtgaaacctccggaatcctcaagtggtaactcgtgcccaacctcgaacacttccaaaaggtgtgtgggaattacgaggttgttgaagccaagcgacaccgaggctctgtgaattaaccactgttgtgtgaacgcggttctccacagaaagagggtacagcggtttctcgatttatctccctcttattagccagtgggggtaacaaagcagcatctatacaagaccatttgtttgcgggtgcatcttacacagcttgctacataacctcaacgataacatgttgaaattcctccgtgggtcatatctcatatttcagggggattccactttcacgtcgggaagacaccaggggcctctggggccaccgtgggtacaaccccaaggggccttaagaaagcgtgaccaaggggggcgtgaaagaaacccagtgggggttcaagcgcggaaaaggccgtgggagaaatttcccccaaggggtcgca

SEQ ID NO: 672542 - DNA, 272 bp, Homo sapiens
ccttcggactggaaatgaaagagctgcaagagagagagaaaacatggataccgatatgaaaggcaataccaagatttctcgaagatcttgaagaagatgatgcaattcgaacaaatgtcaacatttacagatgattcagtccatccctgttggaaagtgacaccgataatgaaggagcacctcgaattagtctggctgatatgctttaagaccttcatatttcccaagatgccactggtgaataaggtgcatcaatgcttacgtcctgagat

SEQ ID NO: 672543 - DNA, 979 bp, Homo sapiens
gccactgcgtcggcgacgacctagcagagccctggggctgggcgtgccctcgcctgccatgctgcgcgctgccctcagcctgggccgctggggccgtgcagtgcaccgggcacgccgcgccagtgctggtgttgtgcagtgcacctgagcctccgtgggagtgtcccgaggcagcttcgcctgctcgccctggctccagccctcacctgcctgcagccttagctgagcagcctgccctgccaagtgggctgcccccctgctccccacttctgccagcgcccgctccatccggctcggccctggggtagttatgtagggacgcagctctccactgtgcgcgactgcgaggctggacgctactgggctcctggaaagggagacaccagcatttgccacaatgctgtcatccactgacctttacatttgcttcctggggagcttgttggtccggcggttgaccatcccaatagaagagcagcagaaagacgtcacactgagaggtatctggagaccttcatgttcggaggagtgatgctcaagttagtagaacatgatcaatatatcccaatgactggtcagactttgctcttttggtgggaacagaagcattgctggcttctgaaaacccactggacccttggacaaatatggggtccaggcagatgcaaagctttctacttcacccctcagcataaaaatggctgcgccttcgtctgccgaatttggaaattggtgacggttgcgagtacagcttctcaactgtggttttaaagctgtcagtgatatcccggcaaatctgaatattagaaaatcgaagaactttccttgttaagacccgctagtgaacatccagaaacagaagacaaaaacacacttagtaggaccctattgaaatatctaaccgaaagtcccaagtcacggtcaaagcaaccggttacagaaacatgaccatattacgcaaggaaagaatcacaaatga

SEQ ID NO: 672544 - DNA, 271 bp, Homo sapiens
cccccaaaaagggggtttttccccatttaaagagccccaagggtttaaaaaagtgggaataagccaccgtaggtttttgtttttcaggggcccccaggccctttaattgggcttaataataatccggccaaatgccccggtttccctaaaggatttttatttgccggcaggtaaaaaaaaaaccctaaaaacctttttattttttttactgagggcattgtctgttttttttggaaaagccggcccaaaaaccaatttttttattccccca

SEQ ID NO: 672545 - DNA, 125 bp, Homo sapiens
ttgactctatacgatcccgaagtatcggctctctgagttcaagtattatcctgcctcttcctccctcgtctactagtacatacaggcagtttccaccacacctggtcgtaatttttgtattttta

SEQ ID NO: 672546 - DNA, 412 bp, Homo sapiens
ccccttcccttttttttcccctcctttgggggccggccccccttttttttttgggtgggcccaccccccccccggggggggggtttcccttccttgggcttgcctttggggggggcccgcccctttttttttccagggggggggggaacccttttttttaaaccaaaattgcctccgggaagccatttttttttgggcccgcccccccccttttttttttttggttttgccttgccttaaattaatgggtttttttgggtggggttaaaagccccggccaaaagggttttttttttttccctttctttttttgggggggggtttttttttttttttccctcccttttttttttttgggccaatttttcccccccccccccggggcggttttttttttgggttttttttccca

SEQ ID NO: 672547 - DNA, 453 bp, Homo sapiens
caagggcagtggatgcgcctgtgtaccagttccacggatagtaaggtggcccgggtcaacaccaacctcagaaatgccatggtatctcatctagatggcactactcatagtgtgtgaggacatcggacgcagcctcttgacctatggccaccgcatccccctgagtgaatgggaaagccggattgcgaaggtggatgccagtgtggtatgtgagatctgctccaagtacatctatgtccagtgcccagcagtggctggatatggccccatttagcagctccctgactacaaccggatcagtaccggcatgttctggatgcgcttctagtcggaaagcctatgtaagcaagagggcaaggccggggtttgtggtcccccctccaccacaatctcagcccttcggctcctctaacttgtgccacaggtgacctccaattatatcctctgctgaga

SEQ ID NO: 672548 - DNA, 198 bp, Homo sapiens
cttctttttctttgcgccggggttggctcccctcccgctgtgcccccttctttcctcctggcgtcctgcctgtgtttgtgtggctccccggtccctgggcccccctgttgggttgggcgcactgtcacccctgggtgtctgtcacgtcttgttggggacttcaggttgttctgtataaaatacaaaataaaagattta

SEQ ID NO: 672549 - DNA, 337 bp, Homo sapiens
cgggctcaagttttctgcccgccttggcatcccaaagtgctgggattacaggtgtgagccgctgcgactggccattgcttttcatgtttattcctatgggtctcattatcaaatcatttttcagataatagtttatacaggcagccctttacaatttttcagtgaatgactttttatggtctttccttgatgagcttgtttcctagtttgtgttaacctagttattttagggagttttagtgaggaaaatttgtagtttcctagatacttgggagctattgtgtcccctccccacccccaccatattattaaattctgaaaactggacagacaatgg

SEQ ID NO: 672550 - DNA, 431 bp, Homo sapiens
ggacgcgtgggcaggtgacagttcctgaaggggcttctggactccagcaccacccctcgtcatgttgtcacttcctgtggtggtcgggagcgcagggtgtgacaacatgacgaggggtgggtgctggcagtccaggtgacagttcctgaaggggcttctgggaaatacctagtgagaggtctagtcacccagacccagtgccgctctccccctctaccgctgggcaccagagtcttccatcagggccggagtaaatcccttaagtgcctcaactgcccttctccctgtgtagccatctagtcccctctattcctctagggagcactgtgcccactctttctgggtttccaagggaatgggcttgcaggatggagtgtctgtaagatcaacaggaaataaaatgtgtatgagcccaggcgaagaagaaaaaa

SEQ ID NO: 672551 - DNA, 101 bp, Homo sapiens
gaggacttcgcatctttactaactgatgggcatctttactagtgccggcatcgttactaatgcccggcatctttactaatgaacggcatctttaataatgg

SEQ ID NO: 672552 - DNA, 120 bp, Homo sapiens
aacctaactgataataggtaataaggttaaatttttttatggcgttttttttttacaaaaatcaaaccctgctggggtttccatatgaaaggaaataaagtccatttattattgcctcca

SEQ ID NO: 672553 - DNA, 191 bp, Homo sapiens
ccggtacccatatacgcattcaataatgcaaaatcacctgcaaagggaatgtcttcagccttaggtgttagggcagacacctgagaggatatgaatgttagtacaatttattaccttttctgccaaggacagcacagtactggcctgaattatagccacttgctcttcgtttcttaaattccgtggtatgg

SEQ ID NO: 672554 - DNA, 208 bp, Homo sapiens
gttttaaatgcccccttttttgggggaaccctaaatccaacttccaagggggggcaacgataagacccaattttcctaataattttttggaaacccccttaaggaaactgccggtcattccaagccccccttggttttttccaacaggccccgtaggttggccaagttccaagccctttggggtttttggggaaaaagaaactgttta

SEQ ID NO: 672555 - DNA, 154 bp, Homo sapiens
atctctacgaaaaatacaaaaattagccaggtgtggtggtgcatgcctctaaccccagctactcgggaggctgaggcaggagaattgcttgaacccaggaggtggctgttgtgcgctatgccgatcgggtgtccgcactaagttcggctcactg

SEQ ID NO: 672556 - DNA, 997 bp, Homo sapiens
  misc_feature (996)..(996): n is a, c, g, or t
gggcggttcccgaccagagagaacgaacgtgtctgcgggcgcgcgggagcagaggcggggcgggcggcggcggcaccgggagccgccgagtgagctagggagaaaacgggcaaagacgcaagcgcccgagcaagtgagtgtaagtcacgggggaggtgccacaggaatgccacgaacagagagggcgggggcaagatcagtggctacaggcatatatgaaaagagagagctgagaaagacttttacaacaacccacggtggcatccggcagaggcggaacgcgaggaaacagacaacagaaggtgggcacaacatgtaggtccagttggaaaaacaccagtgggctgaagaaaaagggagggaataaaaaggggaaacaagagaggtagcagcaccgaagaatttcacgccgggacaaagcgacaaaaatctggaactgaggcagaaaagacgatggagccgtacgcgtgtaaagtactcgagcaacgcaggtcggagagcgcggagcaacaacgagttggggggaccagtaggaacacaaaggacagcacgggagaaacgaccaatggagcggactacacaacgtgtgagcgggaacgaactgacacacactgtttgaaacgccaagatattgggcctcagaggtgacgaacgacagcgcgcgaggcataggacgtattagagaatcaaaacaacagacaaggataactgtgggtccacgcgcccaatagaaggtatataattcaccgagttaatccaaatcaaggacgcaccgtggtagatggacgacggaagtataaggtggagatgagtgaatgaagaccaaggagacaccaatggattgacaggcaggcggcattacggaacacacacacaacgtgggtagacaatagtggagggggccacctgagaagtgaaacaaggatctggaaggcaccgctgaaacactagggccgaaggtataaccgtaggattcatctgttcgtttcgcttttna

SEQ ID NO: 672557 - DNA, 853 bp, Homo sapiens
ggctggttcttcgcgctcgcccgacttcccagcggccccgtgctggccgggcatgcccatgtgctggtgcgcagctgtgccctgtgccctggaagctgcccccgtgcgggagctggccctgcggtgggctagttgtggcatgtggcctgtgagcctgcaggcggcggagctgtggatccttcatgatgagagatttggggacacttctctctcctgtgtgtagttgatagtttggttggtgaagagatggctgacagtgtcaaaacctttctccaggcacttgccagaggcaattcaaagatccaatctggggtatatgtaccatctcaaacgctagatgctcgaatccaggcaaacagagagaggagccacgcgtcgacagaagggcagagtagtgtcttgggcacccgaccaagagccccagagtactacaacggaagcaaagagagtgagccaacataattggtgaggtaacgaaatatatacgaaggtggtaggatgctatggaaattggtttggaagatgatgcgggattaatgagagtgcgtagaagtggctaaaggtgggaagataagaagatgcagaaggaggttacatagtaaggaaaaagtacgagaaataagtgggaaggaaggccgcgaaagagaaagctaacagaaaggccagcaaaggagagcccggaccggcaagacgtgaggaacagcgacgacacacgcaacggacaaacgaaaagccacagagacgcgaacagagggaaggaacaaccaaaggaggagggcgagcaacaagcacaaaggaggggagaagatggacaacaccggactaccagaggaacagcacggcagaacgcgag

SEQ ID NO: 672558 - DNA, 915 bp, Homo sapiens
tggagcaaaaatgtaccataaacttgtgtttactcttttcattcggatcatagtcaaagggctgtagcattactgaaacagtcacagttgaccctgggtcaataattccactgtgggcctcacacagtaccggtgaggcacggtagtcttcactttgaaacacacttttctatccgatggatttcgcaatttaagattgtagtgactacatctgtgaaggggcctttgaatttgaggtctatgggcgggtcgaggaccaggatctgctcgtgcttcgccgtggccccggaggcagacgccattggagagacagcgcagagcagggggcggcttgctcgctgggggcgggggacgatggcgagaggggagggggagcgagttcgcatctctccttttcctggttagactctgttcaaccacattcttatgttggcagatctgcttccagattgatttttagagcaccatcactttcacattcctgattctgatttgtttgtttgttgggttttctgaaacttaaaatgtgcccgaaaatactatattttgagttgtgttctgaaagcctccgtgctgtggatcttggggggaaatacaggatccttcaacactgaggtgtttaagatttggaatagcatgcattttttctaatatggggatatttactttatcagaattattctaaacatggagttctgatcattaagtgctcatatacttgatctactatgaggtggggggaacgatcctttcacacaagtgttgttttgtgtcggggttcccaaatgagttagttgtaaaaaagggggggaaaactcgggggagggtcccttgttagggcctgagggtaaaaagggaaaggaaacgtgtggacctggtggaacaaaaaattgttgtgtagtttatgagaaagta

SEQ ID NO: 672559 - DNA, 641 bp, Homo sapiens
  misc_feature (42)..(42): n is a, c, g, or t
  misc_feature (69)..(69): n is a, c, g, or t
  misc_feature (78)..(78): n is a, c, g, or t
  misc_feature (129)..(129): n is a, c, g, or t
  misc_feature (139)..(139): n is a, c, g, or t
  misc_feature (151)..(151): n is a, c, g, or t
  misc_feature (156)..(156): n is a, c, g, or t
  misc_feature (204)..(204): n is a, c, g, or t
  misc_feature (209)..(209): n is a, c, g, or t
  misc_feature (319)..(319): n is a, c, g, or t
  misc_feature (335)..(335): n is a, c, g, or t
  misc_feature (340)..(340): n is a, c, g, or t
  misc_feature (344)..(344): n is a, c, g, or t
  misc_feature (358)..(358): n is a, c, g, or t
  misc_feature (406)..(406): n is a, c, g, or t
  misc_feature (430)..(431): n is a, c, g, or t
  misc_feature (436)..(436): n is a, c, g, or t
  misc_feature (450)..(450): n is a, c, g, or t
  misc_feature (482)..(482): n is a, c, g, or t
  misc_feature (510)..(510): n is a, c, g, or t
  misc_feature (518)..(519): n is a, c, g, or t
  misc_feature (543)..(543): n is a, c, g, or t
  misc_feature (568)..(568): n is a, c, g, or t
  misc_feature (638)..(638): n is a, c, g, or t
caaatctggactaaatgtacagactcccaagcaacaatgaanagctttcttcgccccccatgctaaganatgtaaaancttaagggccaaacaataccaattgtataggcttcaaaaaccatctaagtnagggcattcnctagttttagcnaaganacacctggaacactgacaagtcaccacttacatagaataatgtgaagnaagtnttttgaaaaataaattttaggggaacaatcctgaaggataacaccagaagaatagcaggttaccagtaaggggtcagccaatttgtcccagccacttttgaatccatgtnctataatctaaaattnattcncttnccctaagctgagancttcctatcatgtcagtatctatgttatgaagaaaaggagacttaggngagatgtttttatttatcgcaacnnccgcnttaattgcctaggncctcaacagcttcatgaaagcctgggaaatgntcatgcataaggctattgccttagctgncttaaaanngccccatacaatggtacatatcancccttagtgcagccttttaaaaaanaaacaggttgaaaaatgggttaaagtaggcaaatacagcatatctgcctttagagctatcaactcagganttc

SEQ ID NO: 672560 - DNA, 1519 bp, Homo sapiens
  misc_feature (476)..(476): n is a, c, g, or t
gcctgcgatggggcccccgcccagcgcccatggaccaggcactccctagaggttacctctcgtcgtcgcctgtggtggcttctgaggcatgcctctgagtctcagttccgcatgtggcccgtcttctggggccccaggatagtcttcctgggccacggacggctgcccacgttgtggatggttgcttgaaccccacagagcccttggggtgacacgcacgaatcccggaggtcgccagacctcctagttctaacctccatgaatacccacgtcattgcagccaagcctacagtagactcacgtactctagtggctctagcaacgaacttgcttcgtgcacacgaggtcgcgcatgaacaccctcacgccagaaccaaaccatagacaagagttcgcgctgtgtcgcaccgtggcaataaagcggtgcacagactcgcgcctggcgattagcagagcaccgcattgaggtgccaaancagactacccttgcgcaacgctccgtcgaggtagtcctgccaaactacggtacccactgcgtcacaccctgagaccacggtggtccccctaggacctcctcggagccccagaggatccccctggtccccggggcttacacattccaagaaagttgactatgctaaggactcgtcaagtagggttgagttgccgacgatggggcgcacaaaaacgagtagactctttcgcacacactaggagaactcccgtacagggagaccgcttgccctcgcacacaggggacattgacccaggaagcccaaagtcccattcactgggacaagagggatccatcgcccaaaagacccccatgagacactttggaaaacgtggaaccccccgagattgaggatctgtaaaaggttggccttagccgtagattgcacaccaccatacgcggaaagacaatcatccacccagtccaaaggaagacagcccgttcgtaggtatacccaccggccacagagcacgtcgcgcaacgactgggtaggccccgccaccacacgagtgcaccacacacacaggggaggactccccagcgttatagctactgggtactatacatacacagccttacacggaggggcacaactcaagcacctcggaagggccccgcattggggcacaggaaccgcagccacacgcaaacccccaacaaccgacaccagcaacacagaggaacacaaaaaacaaaccagagaacagaaacccacaaacaccacgacacaaaccacaaccacaacaacagaacaaagaacaaccacaccacagacgacaagcacgaacagacaaacggcgcagagaacaacaccccaggacacaggagacacacaacccacacaccagacaccacccacaaaaaaaccgcagacccagcagaaccacacaccacaaccaccccgtgtctagccccagcgacatccccacctcaccaaagacgacgtcaacaaaaacataccagacacgaagacgaacactcataacacaacacatcggccacaca

SEQ ID NO: 672561 - DNA, 182 bp, Homo sapiens
tcttgtttcctgcacttcattctgggtaattccttctgacctgttttctggttcactgattttcacttcactgtatatattttgttattaaacctgtacacactgaattattattattattattgagagagggtcttgttctgtcacccaggctgcagtgcacttgcacaatgatggcttgc

SEQ ID NO: 672562 - DNA, 113 bp, Homo sapiens
tacgaggcctgtacatgtatcgtgccccctggagggccttcaaagctctcatctctgctcagtacagcggggctcatgtccgcgtgctctccgcaccaccccacttccatttt

SEQ ID NO: 672563 - DNA, 371 bp, Homo sapiens
tgcacgatgtcaagactgtctgtctttgacaatttgtatataggatgcctcagtgtggatctctttgaatttatctttcttgagtttaagcttcttagatgtctagattcatgtctttcatcaaattggggacatttttggccattatttctttaaacattccttttgtccctttttcttcactttctggcagtctcacagtatgtaattttgtctgcttgatgatgtctcaatgacccttagactgttaatctttaatttctctatcttagtgatattgtcattttcctgattttttgttctgcatgttttcctttagctcttttagcatatttaaggcagtgtttttgaagtctttgtctactaaatct

SEQ ID NO: 672564 - DNA, 414 bp, Homo sapiens
ccgccactccacaccaacactgtgaacaccatctgtaggcaaaggtggctttcttaacttcagggacaccaatctggggtggctctggtctggcaaccttaaagggccttatagacctcaggcaagtgacgttaaagggaaagagagaaacagatggaaagagacaaagccaggtctacacaaacccttgagaaactaatattaagttagctggagcaattcacatggaagagaaaactctgaaaatgcccagaatttacaaggtggtcctcattagtgaaaaaaagacaattaaatataaacaaccggccaggtgatcctcccaccttggtttcccaaagtgttgagatgacaggtgtgagccaccatgcccaggctttgtttggttgttcggcgtgtgcagggtaccgagct

SEQ ID NO: 672565 - DNA, 369 bp, Homo sapiens
tctagcaggatccccgacctagacgtacacagcactgagtttttattagtgactttccttaaggttaaatttctagtgatatgatgtagtcctagtttagaggacccgaatagcccactatgcctcctcagatctcatagtgatccacccgctctggttctttgtagggatcaccgcctcgttccaggtacagattattgtaaggatactgctttgttcccacaggctggtagaccgggtacatcgtcccccacccagcacatgaatttcatgacagccgggtcaccgaagagctgcatccatcattacatgccaatgaaacacgtgtgtgggggatgtatccacacggttcctgtgttacgtctaggt

SEQ ID NO: 672566 - DNA, 758 bp, Homo sapiens
ctgagccggcgggagcagccgcccacagagccatggccctcagagtgcctcagagtgtggagaagatcgctctgaaattggagtgtggtgtgccctcagccagggcagcctcagtgacggtggacccagtgaagttggtgctggtcatgtgaccctgtgtgtgagtgcatgtgcatgccctgcctgccatacccctgtgtgatgccagtggtgtgcctgactaatggttgatgtgaatgctgtgagtgaatgtgttggatcgatgtggttgcttggtggacatgttgcttgctgtgtgtgccatgttggttgtgttgcccatgtaccttgtggcccttgcctggtgtcccctgccccatctggtggcaccccaatgtgcttggacacagtgatgaactggggttgaggagtgacacaggaatgtgtcgaactgtggtgcccaaatgaagtgtaccccttgggagcccatctgggagaccccagtgccccatgcccaggcatggaccttgcaagggtgactgatgccatgcctgatgatgcccacattctggaggaccccaagtgccccctgccctagcaggggacctgcttggtgtgactgatgccatgcctgagagcccccatcggaggaccccatgtgccccatgccccgggctggtaccttacataggggactgagcccaaggcgaggagcccatcgtgagtaccctaggtccccgggccaggggtacttctggggacgagccagccgagagcca

SEQ ID NO: 672567 - DNA, 452 bp, Homo sapiens
tgggagatgcaggaacttgattgaagacagatactcgatgaagtagtccacctcattatatgcttatctatgtacactctggccttcagggtgcatccagtttcttcctcagtccagatctggtgctgtcagaagctgagatttagtttatggatgcataagacagatcccacaccttagactgggtcaaattaaatttttcatgctgccagctggtactcttgaggaacggtgtgtctgcaataaatacccttaatcatcaggtcagaatccggcatggtgccggtcctgagatggaactgtcttccttttgacgtttgagtgtcaacagagttacccgttgtttccgatgtttgcctcacaaatttcaccagaatccgggttcctgcctcatcggagattagtactgttccagtgcctcattctgtccggaagcacgatcctgggagtat

SEQ ID NO: 672568 - DNA, 280 bp, Homo sapiens
aggctgatgatcggtcttgtgaggccttgtagccatgatggcaatggcataggccacgtaggtcatcggctcgctgtgttggccaaggcagaacagcttaaccacagtgttatgcaacgtccagagcctcagttaaaccggaccaagatctcatttgtgctgcagtctgagttgtttacgttcacctcaggcatctcggtgctcgttgttcttcactctctccagaggctcatctccttatgctgcgagctgcctcctcctccatcttgagcctgtgtct

SEQ ID NO: 672569 - DNA, 137 bp, Homo sapiens
ttataagcaaaaagcttcgaacacagagaacaattgcaaccagcagctcctgaaagtatccatcataacatatcattaatggcatctaccatatcttgcccagaaatatttttgaaattcctggaaaaccagcctgc

SEQ ID NO: 672570 - DNA, 238 bp, Homo sapiens
cggtgatactggaatgcttctctccaccgttatgaagctgtctactttcttatcatctgggatttggttcctattgggttcttttctgactatgttgtgtaacgttcacaaccttcctcagtggagtcatctctgtcttttcacctggtttcattttcatccagcacttatcgctatccaaaaccatcttctttcttatgtacatatttgttatgtttctgtaaacttgcatagagaa

SEQ ID NO: 672571 - DNA, 312 bp, Homo sapiens
gaggatacggggccagtatcaagtatatgagggatcaagtcacaacaaagaacaaatgacccggtgtatgcaagaaatgctcagtatcaccaaccgttagggaaatgcaaatcaaaaccgcaatgagagagatcacctcatacctgttaggatagctgttattaaaaaacacaagataaagaatgttggcaacaatgtggagaaaagggaaccctagtgaactgttggtgagaatggaaattagtacagcctttatggaaaacagtatggcggttcctcaaaaaattaaaaatagaaccaccatttgatgca

SEQ ID NO: 672572 - DNA, 333 bp, Homo sapiens
tggcggacccgccagctgcacctactacttcagcgtggactctgacgtggccctcaacgatcccatcagtctgcggctgctgatccaccttaccaagaacgtcattgccccgctgatcatccggcatgtgaggctgtggtcgaacttctggggggctctcagtgcatatcgcctactatgtcccgttccgagcactacgtgcacattgtgcacgggcggcgtgttggtgtctgcaatgtgccctatatttcaaacatctacttcatcaagggcagtgcccttcggtgtgagccgcagtcctcagatctcttccaccactgccagctgaacccc

SEQ ID NO: 672573 - DNA, 214 bp, Homo sapiens
  misc_feature (28)..(28): n is a, c, g, or t
  misc_feature (58)..(58): n is a, c, g, or t
  misc_feature (69)..(69): n is a, c, g, or t
  misc_feature (86)..(86): n is a, c, g, or t
  misc_feature (112)..(112): n is a, c, g, or t
  misc_feature (136)..(137): n is a, c, g, or t
  misc_feature (166)..(166): n is a, c, g, or t
  misc_feature (173)..(173): n is a, c, g, or t
  misc_feature (181)..(181): n is a, c, g, or t
  misc_feature (203)..(203): n is a, c, g, or t
ttgagccaggcctgggtctgtgtctctnttctctttctccttagtcttctcatagcantaactaatctnttgggttcattattggnattaacctggtgctggatatcctcanattgtatctagtgcagctgatttnnacaataactactgtgttcctgggaatagngtgttcngattaganatgaccaatattatactgaggnagatacgactt

SEQ ID NO: 672574 - DNA, 1387 bp, Homo sapiens
  misc_feature (935)..(935): n is a, c, g, or t
  misc_feature (1047)..(1047): n is a, c, g, or t
gctcaatagggggttacctagcctgtatatgcggacgaggtccgaaccacgcagcaccccacggtgtgcatggctgtgcgctctactggtccggggatggcgcttgcgcgagcccagacggctggcggcgccgaaggacggctggtgagggatgtgtgtggaatgatgtgaccacgggtaccaggtagtgccatccattgcgtctctagccagaaggcattgattccggcttgttcgcgggtgcttgccgtgatactaggctcgaatcgtgcgcgcggcggattgtacggtagagcataaatttctactacaggaatctagcggggctggctcgacaggtgtgtctacctcagggactattacgaaagcgtctaataggcgtacagattcacgcgcgtgcgggaggtttgtattgcctagagcggggtaccctccttgacttgatgccccactagggcgcagacgagacgatagataccggagggtatgcctggggtgtcgttgcgcgtgatttgcagggttgcgtacgttccatgcatcatgggggcacggaaaagcgcgatcaaaacgacacggagtaaccttaatgaagagtaggaccgacaggcgaattgcggaagaaaaacgtgtggtgagtgcttagcaaggcgtacgacctaggagagtaggaccccagtctttacttgtcccaaaacctatcattacggagcggaaatggattggcggctctttcccagttgggtaaggacgcgcacgacgaaaaatcacacggatccctttgagctagagagcgcagaaggactactcacggcacacgacctgcaagggggggccccagactggtctcacattgtcgggcgacctctttgtagggaagaccgcatcttaacgacaagagaaagaagaggaactagctggggcaggaaagcaatagnctgcacatgggtcgagaaggtggtgaacctctaaggcaataacacacgcacacaggcgctgaggcaccacgcgggacaggtcacgacaccgatgggagcaaacagcggaacnagaacccatgagccgggaaacggaggaccaaattacagttagtcggacgcgttacccggggtgcgacggaagacgatttggggccacgcgaagggggacaggcattgctatgcacaagaaaggaaggccagcgagaggagcccatgagcgacactgcaggacggggaaaagtggccaccattacagtgagatacaagaactgcatacgcgaacaaaataggaaaggatacacggagacgcgacgggcaaatcggacagcagaatattaagacagccaaagggtggtatacgtaaatacggcgcaataggcaggaaccggcacaatatttggaacacaaag

SEQ ID NO: 672575 - DNA, 278 bp, Homo sapiens
ctatctgaggatccactaaattgctgtacagttgatagcatgggtctggatcagggagactggagctgctgctcatggtttcgtgtcccacagcagcagcttgcaggaacctggttcatgccttgcttgcgatgtctggtgctgagaagtacaccttgtgaagtgaggctcggagctgctgccgaacagacgaaagaggccctgttgtggctgcatgcacagaagacagtgatctgtgcatgtctgtcgttatatatgagtatcacacgagacttctt

SEQ ID NO: 672576 - DNA, 809 bp, Homo sapiens
ctcgcggcgcagtcaccggcgcgtctatggctgcgattctctaatgtctgctttggtgcccggtgtgacgccggcaagtgtcccttcgccttcgccctttccacctcgcggcagtcgggaatctctccctaggtcaggttgagtgcagtgttgcaatcacggcttactgcagccttgacctcctggctcaagtgatcctcccacctcatgttaaatgaagctgttgtcatttctggaaggaaatgcccagcagatccaagcaggaagtgcggcagggggttagacacaagtgggtggcctccaggcaaacaaacggcacaacctgaggtgtgactccttggttggcgagaatcctggcagtcactcctatgtcctcaaaaaacaggggcagtgcagttgtgggaatcacccagtgagacacattatgaaaccacgttcaattccagaggacgactgttgcatttaatcaataacgtgactatgtgatcatgtagatggctccttgtcagttggctcttccagagcttattgtgacgcgagggtctgcaagcgggtctccaggaccagatgtgatgcgctcatgcatcaatggcgccgaatcggtcggcacggatcccaggtacgggcaccaggggtgggggaaaaccaggatgggttacccagaaaattgtggcgcggacgcaaacgggatccctgatgtgcccaaagggtagccgggggccgacatccgtatccgcggagaaacctgttgactgggcaccacgtaaacgacttgtaccactccccagcgggcgcacaaagcgaataga

SEQ ID NO: 672577 - DNA, 495 bp, Homo sapiens
cgtgacggcatatgcctgtaatcccagctactcgggaggccgaggcaggagaatcgcctgaacccgggagacggaggttgcggtgatccaagatcccgccatggcactccagcgtgggcaataagagggaaactctgtctcaaaaaaaaaaaaaaaaaaaaaaaaaaaaaaaaaaaggggggggcgggcggggggccccgggaaaaacttttaaaaacccacggcgggggggcgcgcgggggcccaaaagggaaagggacaaaggggaaaaaaggcggtccccagggaaaacccggggcaagaaaaagggcggggggactccccccaaataaaaaacccgcccgggggggacacccgagaggcgcgtcgagagaaaacacccaaagagaggggagaccagagggggcacaaaaaggggggggcctatctcacacgggggggcccacagggaggggcccgagatcacaaattacccccgaacggggggggacagct

SEQ ID NO: 672578 - DNA, 331 bp, Homo sapiens
  misc_feature (19)..(19): n is a, c, g, or t
  misc_feature (71)..(71): n is a, c, g, or t
  misc_feature (76)..(76): n is a, c, g, or t
  misc_feature (146)..(146): n is a, c, g, or t
  misc_feature (299)..(299): n is a, c, g, or t
  misc_feature (304)..(304): n is a, c, g, or t
  misc_feature (331)..(331): n is a, c, g, or t
tgaagatctttatttttanccccaaaataagcgtgaaagtcaaaaatgggtgtgttcccctgtccgggcgnagtgnctcatgccctgtaatcccaacactttgggatgccaaggcaggcagatcacctgaggtcaggagttcaagnccaccctggccaacatggcaaaaccccatctctactaaaaatatttaaaaatcagctgggcgtaatagcacgtgtctgtagtcccagctgtttgggaggctgaggcaggagaatcgcttgaacccaggaggcagaggctgcagtgagccgagntcatnccactgcactccagcctgggcaacagn

SEQ ID NO: 672579 - DNA, 225 bp, Homo sapiens
ctactctcctttgttatcggtgtaaaatttctatatttattataataacactagtagtcctattatttatcttaaagcctagactaaatctagtaagctttccatatgcactatagaataaaagtcctcaaactacctattcaagggcaattaataaatccggacactatagctataaatactaccatattttaaactactacaatcagtaacactatatattta

SEQ ID NO: 672580 - DNA, 640 bp, Homo sapiens
gcgagcggccgcccttttatttattatattatccatttaattcgttgactgttatatggtttatgtttgtaatattataagtgcaatgtgatagcatgcccgcggctttctggcaggtgtgtgactaatactctgaaaatactggcttcagttagacgccaagatggctcacgtcaagctaactttcgtaagttatgccatctttatatttgtcttcactctctattcttgtcgggtgagcagagcgcggggcagccaaaacggtggtgaccacacggccgcgtaattacgtcccacaaaagagagggtcgagcgcgcggggcaccgacgagagagattgttcaatagggtcccaaaatcgatcaaaacccactgggggctttcccggtctccactatctcccaagtaagtaagagtgggcttttctaaaagaggatgtgtgggttatctcactcctaatcaatgctgtgtgtaaagctacaacacgtcaaactcacaggcggcgggccgagcgaggtaagagacagcgcctaaaacaaaggcggccagcggctcccgttgggaaacccaaggacatctaaaaacaacaaccatggcgacacactagggtaaacacccccactctatatcataagacaaa

SEQ ID NO: 672581 - DNA, 419 bp, Homo sapiens
acataaccgatatggcggtcttttcatggaataatatcttatttgtattaaataaaattaccagaattagcactggacttccatttcagttcagctgcactcaattcaccctagagaaccctcacattgattgagcatcagtattgtatgccaggtactatgtgacatgatacacaaacacaatgtgagatgtgtttgtgagatgtacaatacgaaaatgtgagacacaaaaatgtgagatggacacaaacactagtaagaagtaatgttgccattgaaccacaggctctttgagggcaggggattttttcttatttgccattgttttcccataacccattcctgcctggcacatagtaagtgctcagtagataagggacaactgattaaattatcagctcaagcagtccgtggtctcc

SEQ ID NO: 672582 - DNA, 432 bp, Homo sapiens
  misc_feature (214)..(214): n is a, c, g, or t
  misc_feature (263)..(263): n is a, c, g, or t
agacaccaacctcagagacaaaaattgtctacaacccgtggatggtaccatgtcccttgatatgaaagagcaccctgatgctgaggtacaaaagaaccaagtactaaccctggaagactggaaagagaagtgggtgacccgtcacatctcattccatcaggagcaagggcatcagctgttgaagaagcatttggatacatttcttaaaggccangagtggactgcgagtgtttttccccctctgtggaaaagcccgttgagantgaaaatggttcgcagatcggggccacactgtagttggtgtggaaatcagtgaaattgggattcgggaattttttgcagaacagaatctttcctacacagaagaaccgctcgccgaaattgctggagccaaagtatttaagagttcttcagggagcatttccttatact

SEQ ID NO: 672583 - DNA, 835 bp, Homo sapiens
tcaaaccagtctgattataattaggaagttaaataaggttgaggggggggggagggggactcatcaaaaggctgactgtgggcccgctggattgggcaactcatagcagtggtgaggttgtggcaaggggagcaacccccttctcaagaacaaggcacaaactattatttgtggcaaggagaagaatgaggggtgtgggcaccctccacgtgcgtcaatgtggcacattgcctcgagggaaggccaggtgggtttcacaagtgcaacaggagcgcattcattccgaggcacacttctcgcaggccctagtgagagcgccggtgggcctatctgtgtgtgagaggcgcttgacagaggtctctccagagctgtgttctctctccaagagcgtcgtgtgtgtgaagtctcacacctgtgggaaagaacagttgctctccccaccgccctgtggtgtgcagtctctttatctccacacaactctcctctgtggggccagagcgcgaagtatataaaaaatgtgctcgccagtatacttctccccacagtctcacttgtgtggtctgtgaccccccatgtgtgtctcccccctacgtgtgccccgctcttgtgagacccacccatgggtgtttgaaactctctatatgtgtgggcggtgacacgtctccaagtgggggcacccccctttggatctcctccctttctgtgccccaccctgtgggggcggcaaagctttctccctcctttaagccaggactatggtgctccaaggctttagaagccaggccccctcttgtggtgttcccaccgccgtggaaaagggggctttcatggcctt

SEQ ID NO: 672584 - DNA, 409 bp, Homo sapiens
acccgggaaattgggccattagggccggaattaagggttaattaaaaggaccttttccggggggaggggcggttttttaaagggagttggaagcctttttaaaactataatccaagggaagcggagtcctaagggaccagttactcattagggcattccatattaatgggctttttctttaaagccttaatcttttttttggttaaattccggaaccgaaaataacttaagggaaattaaaaggctggaattggaccttaatccaggatacttttggaggttcctttaaattttggaaggatgaacggtttcttttaaataaataaaaaccaattaatactttcctttggattggggccaagaggttggaccatgagggcttggaggggaatggggaataggggatttt

SEQ ID NO: 672585 - DNA, 1196 bp, Homo sapiens
ttctttgggctcacatttcagcgactgatagccttcacctgtcccttaattccctggggggacataagccctttccacagacctggacttgagtatctcttgtacctattttcatttggcacgaaatctcccggtttttgtgggacaaatatctttaatctaatgggatagacccggggtcttgaccgatatgcttcatgtatcaacgttcctcgcgacaggattttcacaaagtgctgcccaaataccaactgcccttctttcctgcaagctttcttctcttacgcagccattcctggtgaacggtgatatgatttatgggcaagattttaacacggtagtacttctggtctatctgttatcttatagattctgggggcactaataatgtcctcgagtcacttacaacgccctaaaggtggattgtgattggctatgaggaatggggtatggggatggcatggaagagatgggttctgactctgagatttcatgaaattgcaaaactataggacagctgctcttccataaacagattattattatgtagtttctacgatagacagcttgatagcagccattatcttctttctgggtgtcttatcaagttccggctgtgtgcagcactgggtgataaggaaagagacaatgtcacccatgggattgccaaggacttatttctatgcactgctgttcagcaacagccaatctctcagaactgagaagaagtcctattgttcacgctgggcagttgctattctgactatcccaagagagcagaaaagggatgtagttgccattgtgcaaaagattgatatttcattactctcagctaaagttctgaaaagcagaatcatcatgaaatatctttgaagagagaaaagacaagggaagaaaagaagaatgaaatgagttcagagctttttagaactgtgagggagtgcgaaaaaagaaaggtgtaatactttcaaacagtggaagttaaaatgccaggcgtgtaagcctcagtgaaattgagcagcatcacgtcaccacgacttgtggtccagctgtttattgcaaagactccatcctgcgttactcatcagaaaatagttaactttgtatctggcattattttaattaaaaaaaaagttaacttactagatttctgtttgtctgtgtttcatacaaggttctgtacgccatgtcgttga

SEQ ID NO: 672586 - DNA, 1773 bp, Homo sapiens
  misc_feature (1373)..(1373): n is a, c, g, or t
taaaaggcgcggacccggttaattggggcaggaaaacaaaacaacccagcccccccaggaggggaacggggtggacttataaactcctctcctctccttcgtttggttctctccgagccccagccccaccgctgggccctttcttgggaatttcttccttctttacaggcggccgggggggccaccccgcgttaggaagaagcgcaaagaaaaagtctcagatgtggtgcttctctgtggagaatctcccagggcggaacaactgtagaagagagacgcggagactgttctcaacacaccctgtgtcttgtgcggagaccctgcgtgaaatatgtgggccgcgtggggaggatctcagacaccgacagacgcgtgttggtgtgagatgtgagctctcgtgggcccaaaagccccacgagtcttcgaaaaacacctctggggtgtctctgagaaggagagggcgatttctctctctcctagaagaaaaatatctctctctctataattctctcacgaggggcccccgagagatatgtgtttatatccccgagatctttcaatacatctggtggccctctatcatatcacgacgagagaaacccccccagtagaggggggcgggaaaacccaaagcagcgcgcgcgcggaacaacaacgaagggggggcgagatgagcctcctcttcgcgaaaaaaagaagaagccgcgcggcgggggggggatcactctatcttctccactattcaacgaggaggtgcggtcacagaagagaaaagataccccccggcggggagggagcacctctatgggggggaagatatttcctgcgcgggggccacagggagtgtacaaatatttgtgggcagcccctctcccgaagaagaaacctctccacagcagttatgagggtgccacccggggaaacgccccacataaaactagcgggcgagagtaaaacaaaagtgtcaacacacagaactcactgggagagtgcccagaagagaaccgaaaaaacaatctccctcgcgaaaaaaggggggtacccccccgcgggagggggggccacacccactaaaaactcttctcgggggaggacaaaaaaaccccccaagagtcctccgtgaggggcccaaattgggggggcagttggtagaggaccaaccagcatataccccacaggtttttggggggccataaaagcgcaaccagggggaggagtgggcagtcctccttataaaacaaccacggcgggccgaccaattcttctcacaactcatggcgggagcgacattatccaccagagggtcgcccacaaatatgcacagcgattgctcaccccctatcaacgagcagagattttccttctcgccgacnaaaaaccctcttttgtggttgacgaccacacagatagctgctcgtgacagtgcgttgggtggcgcccgcccaaagaatagttattttataagtcgccacccacacgaggagttaacaccagagcgagaaaggagctgcgcgcaggaggggggacgacatatagacccgcgcgcacgacagcagggggtgtgactccatcaacacccacctctcatcgcaacacaactgtggggcggcccccgctcgaacaagaaaaagcggcagcaaaataatcaccgggcgctcggcaaagcaagcagccagaagaaataccgaacaatgggcagcaaccatgagggatagtaacaacgaacaacacaacctgtagaggggaggagcacacacacggagatcggcccgg

SEQ ID NO: 672587 - DNA, 994 bp, Homo sapiens
  misc_feature (971)..(971): n is a, c, g, or t
  misc_feature (979)..(979): n is a, c, g, or t
gctatgaactcgtgtgatcggccgaggctgtgctgagttctgagaccagtgttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacgggcggcgggctacggcggcgtcctgaccgcgtccggacgggcttgctggcgggcaacgagaagctaaccatgcagaacctcaacgaccgcctggcctcctacctggacaaggtgcgcgccctggaggcggccaacggcgagctagaggtgaagatccgcgactggtaccagaagcagggggcctgggccctcccgcgactacagccactactacacgaccatccaggacctgcgggacaagattcttggtgccaccattgagaactccaggattgtcctgcagatcgacaacgcccgtctggctgcagatgacttccgaaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattcgctccgggcaccgatctcgcaagatctgagtgacatgcgaagccatatgaggtcatggcgagcagaaccggaagatgctgaaccgtggttacagccggactgaagaattgaaccgggagtcgctggcacacggagcagctccagatgaacaggtcgaggttctgactgcgcnaccttcangtcttgagattgact

SEQ ID NO: 672588 - DNA, 210 bp, Homo sapiens
cagctggccctgcaggtttccctcgagtatgagaaaagtggaagcttctaccacacgtgtgcggtcatgcatcgcccccgactggttgtgactgccggccactgactctcgagctctggacctaccagtggtgttgggcgagtacgacgtgctgtgaaggagggcccgagcagtgatcccatcaactctgggactctttgtgcatcactc

SEQ ID NO: 672589 - DNA, 701 bp, Homo sapiens
gctatgaactcgtgtgatcggccgaggctgtgctgagttctgagaccagtgttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcactgtgtgtgtgctcctgtgctgtgcctgctggctgtatcctgttgtcctcctgaccctgcttttgttgtccctctgtccctcctctgtgtggtgcctactgtgcagtgctgtgctactgtgctgtgctgtccgtgacctgctgtcctgactgggcttgcttggctgggcaacgagacatgcttaacaccatttgcatcgaaagcccgtacgagactggaactctagacacattgtggaccttacactaaaacccttgggaaccgaaatgtggtttgtctgccgacccactttgtggatgtggcctgtgcacccaaaactggtgacctgaataggccttaaagagaaggaggttttgaacagagaaattccacagtcaagaacacgttgggtaaccccatgaacaatgcaatgtggtgcccattggtggcacacatcccgcagacagagcgtagccatggccaacgttaaccttaaccacgttgaaccacagattcaccaagaggtgaaacccag

SEQ ID NO: 672590 - DNA, 864 bp, Homo sapiens
gaggcaggagaatggtgtgaacccgggaggcggagcttgcagtgatccgagatcgcgccactgcactccagcctgggctacagagcgagactccgtctcaaaaaaaaaaaaagtcagggattgggggaaggagatccaccctaaattctgcggggcacaatctaattcagcttctccagcaaattattaaagcagggtagaaaaacgtgaaaaagagagacagggccttagccttcccactttatacattgtttctcccgtgctggacgcttccttgccttttgaacgtcggactttcaagtctctctcagtttggggactgtggactgggctctcctttgaatccctcagtttgcaggacaaggccttaattggtgggaaacctttgctagatcaatatttacggaaaggacaccgacacaaggatttgtcgcatgggttattcccatagaaacgccgacctaacaaaattagggcattcggacagcgaaacaaacgattatttggccagggccaaattgaacgaaggaaatctcggggacacgctgcgatttgacgacgacacacgtgttgttaccctgtgagagacatttaggtcgggacccgaggagcaaaagcgagggttttaaccgcccccagtgtgaccaaacccttacgaagaattttttttccaaaggtgcacaagacgcccaggggattatttcggcgaggggggagccacatatatgttgaagtggcccgtctcgatttggtgaacacgccccatcgtagtacaaaacacttaaatgttgccacagggtggtaattggcgccttgtcaattaagaggggcattttgcaacaagggccccccccaaccccttgg

SEQ ID NO: 672591 - DNA, 121 bp, Homo sapiens
tcgcgtgtatggctcggacaggaaggcccagaagtgacgcagccctctatgggccaaatcttctacagtcgctccagtgtcttcacggagctttgtagtccagaccatatggctaggacct

SEQ ID NO: 672592 - DNA, 446 bp, Homo sapiens
tgatacaaccgcgttgacgagctctcccaatgtcgacctgcaggcggacgcgaattcactagtgattggtgcgctgagatcgccaccactacactatcagcctaggcgatagagtagagacgactcctccaaaaataaccacataaattacttgagtgctcagtgtgagtggctcactgtctatatatcccagccacattggtagagctgagagcaggaggattgctagagcccaaggagttcgagaccagcctggtataacctatttgagatcatcttctaccaaacaataacaaaaacttagccaggcatggtggcacactcctgtggtcccagctacttgggaggctgaggcaggagaatcacttgagccttgggacgtggcggttgcggagagcccagatcacgccactgcactccagcctggcttgggtgacagagtgaca

SEQ ID NO: 672593 - DNA, 413 bp, Homo sapiens
  misc_feature (237)..(237): n is a, c, g, or t
  misc_feature (247)..(247): n is a, c, g, or t
cgggtgtagtggctcatcctgtatccagcccactttgggaggcttcagcaggaggattgcgtgaggccagtggttcgagactggcttgggcaatgtagctagacccagtttctacgagaaatacaaaaattagctggatgtcttggtacatgcctgtagtcctagctacttgggaggctgaggtgggaagatcacctgagcccagggaagttgaggctacagcgaagcatttagccnctgcactccngcctaggtgacagtgagactgtatctcaaataaataaaccagtaaaaatgtttacctgtagggagagagataaaatggtaggactgaaacttttcttagcgtaggtttgactttagaaccagtaaatgttttacataattacaaatcaaatgaaaaagagctagcc

SEQ ID NO: 672594 - DNA, 592 bp, Homo sapiens
ctgatggtgaaacatggaagaatatagccagatgaagacgaagttgatggcctggagaaaaagatgtttgcctactgtgatccgaaaaaattacctgggggtccctacttatggttttacatgcttcgggctgctacatcaaactctctcagtgtgtgacttcctggagagaagatggcatctgtgggggtatcagcaccccaaagtaccaatatgccattgatgaatattatcggatgaacgaaggaggaagaagaagaagaagaggaaaacaggatgtctgaagaagcagaaaaacaatattcaaccagaataatgttgccagacttgattccatttgtttcagacaggattccacccagagacaaggggatatccaggctccattctgtgaactgtcaactctttggacatgggcggcgaacagtcgcagtatttttggacacgcacgcaaactccaggactcggtcgcaccataaaatgaaatgacttcaaggtactaacctctcaagtatttttatcagtcacaaaattcacatctcttttcaggggactaataaacttctcagtctagatacgctcggacgcacac

SEQ ID NO: 672595 - DNA, 360 bp, Homo sapiens
  misc_feature (11)..(11): n is a, c, g, or t
  misc_feature (281)..(281): n is a, c, g, or t
  misc_feature (308)..(308): n is a, c, g, or t
  misc_feature (336)..(336): n is a, c, g, or t
ggcgcctgcanttgctgaggcttgagtaggtaaacaaagcagccaggaagctcgaactgggtggagcccacgacagctcaaggaggcttgctgcctctgtaaactccacctctgcgggcagggcatagcaaacaaaaggcagcagaaacctctgcagacttaaatgtccctgtctgacagcttcgagagagcagtggttctcccagcacagagtctgagatctgagaacggacagactgcctcctcaagtggggtccttgacccccgagtagccttaactngggaggcaccccccagttaggggaggnacttgacaccttaacaccttgacatttnacccctcttgaggacaaagtttcc

SEQ ID NO: 672596 - DNA, 168 bp, Homo sapiens
ggcttttgccccccccttttttctttttgcccaaccccttttttagggaggggcttttttttgggcccctttttaccccttttcccttttaaacccggggaagggggttatttctgttttttttggcccagggccccccataaatcctatgggaatttttttttttta

SEQ ID NO: 672597 - DNA, 1377 bp, Homo sapiens
gacagtcccgccttgtgtgtggtacccttgtctgtatacaacggtgggtgtgttccgcacggtcctcccccccgcccgccgtgtgctgacaccaggaagataacgtcccgagtggtgtggtgcgtgttgaccttcgctgcgcccccccaccacaagatggggcggctggcggctgttagttagaccacccgcaccaccagaacaaaaggcgtgcggcaccataaattattgggggggcacccacatgcggcgaaacacaaacgagtgtgtggtggctgggaagagtgtatccccccgcgccccatgtggtcaccccccccccccccccgcgggggagtaacaaaataaggattaataaagtgtgaagagcccccctcaggtaaccctccctcttccccgcgggatagagagtatagcacccccgctcctctcgctagtgcggggtttcgcgcgtgtaatcacacgcgcctcgcaagaaataaacactcttcgggagagaaaaaaaaaaaaagttgggccgcacaaataccaccacacaaggggtcttctctctcacaagagaatccccccccagaggaacactctcggtgggtgtgtgtggcgcgccctcccctctactaagagagcctgcgtgtgttagtatgtcgtctctctacacacgcggtgtgttgcgctcgcccaccctctcgtctccgcccccctcgtgtgtgtgcccctctcccggacgatatattattcctcgcgagacaccaccacgcgggtcgcacacaccacacgctgctcacacacgcgggcgcccacacacgcgccaccactcccgcggagacacacacggagagagaactgcggtgagacacacacacaatatatagagatgtgtgtgagatgtctccctccctctcgcgcacacatgtgtgggctgtgtggaatcaccacccccgagagagaagtgtggcgcacaccgggtgcgcgctgtgagagtgtgtgagagcgcccacacagagagagagagagagccacaccccccgcgtggtcagagagagagaggaaaaagagagagcgcccacacacaagcgggagagggagagagagcgccacaccttctgctgctggggagaggggggcacacaccgtgtgggaactctgccccccgcgggacaaaaactctccgccacccgcgcggtgagaaaagggccaccccccgcggggcaccaccacacgagagcctggctctggtgggacacaccccgcggatgtatgtgttagagaacaccaccaaagaggcgggggagaaaaccccccccccagggggcaccccccccccccccccccccccccccggggtgggggaacccccaaaaaaagggggtgtgtaga

SEQ ID NO: 672598 - DNA, 177 bp, Homo sapiens
tgtacaaagatcagactctgtatcaaaagtacctttgccctaaggaagagtgagtataggagtcatcttatctattacgtaccaaagcctccctttttatttcttgagccaggattggagcttggccaattccgattggcaatccttcataactggcaacatttgttgttgtcatct

SEQ ID NO: 672599 - DNA, 205 bp, Homo sapiens
ggagcagtgtccgataatcattcctctccatgtattaaatatattgcatatatcatctccagtggtcagctggaaggccaagggccgcataggttgctctccagacacagcagtgtcatttgtacaaaatgggccagctacacttccagcattaaacaggaaggagtaggttctcccaaggtgatccacatacatgaatggtggc

SEQ ID NO: 672600 - DNA, 286 bp, Homo sapiens
  misc_feature (201)..(201): n is a, c, g, or t
cgagtagctgggactacaggcggccgccaccatgcctagctaattttctgtctttttagtagagacgagctttcaccgtgttggccaggatggtcttgatctcctgacctcgtgatccgcccatctcggcctcccaaagtgctgggattacaggcgtgagccaccgcggccggcttctctccttcatttctatgtgccagntatacttggttctttctgctcttctaacatttttctttgttgttgttgttgttgttgagacggagtcttgctctgttgccaggct

SEQ ID NO: 672601 - DNA, 259 bp, Homo sapiens
ggataagagagaggcatctaaaaaagccatcattttctccatctatcaagaaaattccggggggctggtgactttctcattggcagatctgaggacatttggctaagagatgattctctcaaatgggtaggctccggctccaaatgatgtccgccagtatgtggtaagaaagcccttaaataaggaaggtaagaaacctaggaccaaagcacccaagattcagcgtctggtcactccaggtgtccggcagcaggggtac

SEQ ID NO: 672602 - DNA, 1501 bp, Homo sapiens
  misc_feature (208)..(208): n is a, c, g, or t
  misc_feature (1335)..(1335): n is a, c, g, or t
gatggacggtgtcgtcagtagtctctggcaggcttgcctcattcaaagtgcggcgaaagacttgaaagacgctcctccgtacatttagtgggatgagatagccggtgcccagctggtacacagctagcaaagatgcattagatcgacctatgactgacgaacttgggttctagctacagccgagaccttgactctctcgacgagctgncggcaccatgtagccttctcggggctcgagctcgcttgggggattgagcttctcgagtgactcgatagactctactggagggacgcgtcagttagaaacagtgcgtcgatgccgctagggcgcgacctcttcgacgacgcggacgcgtcttcaccaaacgcaaagtggttggggcacctgtccgggagatcaccgtgcaaggacaccattgcgacgggggagtctcgtaaacacttgagatggacaaagggaaccatagtaaatggccgagacacgggaaacactttggaactacctctagtggaaacatacataagtactccgtggccgacgagcataattcagtcccgcgtgacgcaggggtgaggccaccgttctaagctcacaaccaaaaggtacaagacgaaatctcaggaaaaccaaagatcgcgattgtcctcggtcgctcttacattaatagaaatttggtcaccttcctagtctcccggttagaggagaagacagaagatagttgaaaaactatggtcaacgaaggtgggctacttcaaattaaggtggggcctgggggggaatggccgaggaattaaaaaaaggccgcagtgaagtgtcaggggtgacaccttggggtggggccccaacaggtggtggtgacccctcatattgagttgtggtgatggtccccacctgtaggtaaccccccaaaagcgcaagttctttcaacggggaagccctaaattaagagttggggcccgctaacgaaaatttggatagcctcgggaaggaggtccctggcgcggtgtaatcacgtttcgaagagtttggcagggaaaatggaataactttctgcggcactacaatggggcgccaaggggtgctattttcccaccctcgctgcgagggaaataatgattggtggcaacactctctgcggagggagaaaacaaccccagggaaaacacgggggtatccgccataaattaccccccgttaccccgagtctctttaagccagccgccaaagaaaagggtatttgtgggccaaatttacttggcggaaacagcagcggggtttcccaacagccttatatgcggggggacaaaagcacggttattaacacaacagggaancacaatggagtgggagcggaaacggcccagcgggccattcctatggggtaaaccaggttttacgctatgagataggattacccccattcgtttgggtaggacaccccaagttccatatagcaaacacggaccccattcgtcgaagctcacccgccgtttagtagaa

SEQ ID NO: 672603 - DNA, 352 bp, Homo sapiens
  misc_feature (170)..(170): n is a, c, g, or t
  misc_feature (307)..(307): n is a, c, g, or t
gtcgactctaagacctgcaggttatatcaaagctgaagtctagaacgaagaccatataaaagatgattttaatggaccagcaccttggaatatatttgaaaacatgatttaaactttagaaaataaaattttaatacttaagagataacatgatgcaaacgttgcttgtnggcctgactttccaggactaagcacctctgtgaatcaatggggctcgggtgaacatggcgtaacctgctacgtgggtgtggcctcagacaccaaaatccccactgcatgttgggtctacagacggcaggattctctncattgctaggatgactctggaaattaagcctttgcaaggtaccca

SEQ ID NO: 672604 - DNA, 657 bp, Homo sapiens
gagagagacaggcagacccctccagaggcccgccagggtgggcatggtccccgcagtattctttaaggcagacagctggagtggacgagaggccactccctctaccagcgcccgcgatgtggacccggggaggggaggctgaggcgttgggccccggactggaccaggagaggcccatctcctcagggtcagtttcaggtgtccggctgggcctctgaatgtcgaaggatatgtatattagccacgtctcctgggtccttggagtctgtggccctttgtatctacgtgttgttgtccattgtgttgtagtgcgtggggggaacacgagggcactgagaacattgtcggatgagaactagtaacatgatgaatggcatgagtttttgttgagaaaggtccaaggcaagtgttgggacagagtcgagtgatagttgaggacggaagattgcccaatacgggcttgacgcttggtgtagagattgagggcataactgtattctaaacaccatgtgaactattgatgctagtttagacattgggaaatttgacagactttgaaaaaataggggactgtcttacgtgccaattgctaacattctcaatcacggtttcatccaattagtattccggacagctagtgtacaggagtatatgaaa

SEQ ID NO: 672605 - DNA, 392 bp, Homo sapiens
  misc_feature (196)..(196): n is a, c, g, or t
  misc_feature (207)..(207): n is a, c, g, or t
  misc_feature (213)..(213): n is a, c, g, or t
  misc_feature (308)..(308): n is a, c, g, or t
taccttcctggtccccactgaaaaagatgagtatgcctgccggtgtgacatgtgactttgtaagagcccaagatagttaagtgggatcgagacatgtaagcagcatcatggaggtttgaagatgccgcatttggattggatgaattccaaattctgcttgcttgcttttttaatatttgatattgcttatacactntacactttatngcacanaaatgtagcggttataattaatgtttaacattggacattgtatcttctttatatattctatctttgatgtgctgtctccattgtttgatgtatcntgagcaggttgctccacagggtagctctaggagggctggcaacttagaagtgggggagcaggaactagtgagggaccaggaact

SEQ ID NO: 672606 - DNA, 128 bp, Homo sapiens
acgtgctgacagcatagttttaagtttcttgtcctttttttgatacaagtgtctcactctcgtcacccagtgccagtatcttgcgcttatctgcacacttctatcctcccaggactcaaagcgattct

SEQ ID NO: 672607 - DNA, 107 bp, Homo sapiens
atccccaacagtagagtcacaccacctgagtcacaccaactgcgtctaccacggaccagccattgagtctcattggagagtacatcaaatatcaaactagtgttgcc

SEQ ID NO: 672608 - DNA, 130 bp, Homo sapiens
tatccgtgtcggggttgcccaggagcgtctgcccgcggcgggggcctgatcatccccacagtccaggactagtcgtctactcgttgccttcctcagtggctactctctcgtgctgatgtgagccttacgt

SEQ ID NO: 672609 - DNA, 1448 bp, Homo sapiens
gtaccgtggtgtgatgatgaaggagaactctctcccgtgtagtaataaattaatatgtagccggcgtgtgatgggatgcttctcgactcacctcacgtctgcgggggggagagcaacatattttgttcttacacccaccctcgtgggtgcctcccaccttcctgtgtgaagaagtatctgtcggtacaagctccgccttgtgataaaaaatgggtgggttgaatagatgccgccatatttcttcctgccagttatatgaccccgactgactttttgtgcccccaccctccctatttttgagagggtatcgcgggtgtcttctagcaaaaagaagctcaacagagcgggccccctcgtcggacactcgtgaatgtgggtccccaacgaaaccattaggcactttgagaaatttcaccggggccgccaacagcggaaatctgtttatatgcggcactaactggggacactgcttgataaagtagtcgtgctggttgctgcgacacagagaccaatggggggccctggataggccccgatggggtacccaataacctctggtgaagggtttatccgggatatctctcaaacacaattctgggggggaaagcctgtgcttacacaaagagacgccgagagtttaaaccaggaggtgtcccccccccgaaggaccacttccacggaaaccccaaatagtgccttagaaaagttacacacgggagccttgggagtgcacatgcacaaagggtgacttgaggggagaacccgccctgaaaggtgaagagaaacactcacgtccacgtgggcacagaccacccgtgggaagaatacaaggaggatatgaaaagctttgaaagagaggtataaaagagaggagaggggtgcgccacaaagagagagtgacacttttgggaatggagagtggaaaaggcgtaatgtccacaaatataaggagcccgcggcacacaaagtatgagaatttataatattccgcggaatatcccacaatgaaaggttgcttgaatggggcacactggaaagaaagggaatttgttctttcacataaagtccacaagaggtgaaagagggcctcaatgcctgaagaattcggttattggagccactcaatttccggaaagccacgccaatgaataataaacgtttcacgctggaagaatcaaattttggagacccttggccgccccacggaacgctggcggcacaggggaaggacgaaggtggaacgtgggcgctggtgggcgccccaaaccgtggcagcacggagccgaccacagtcaaagtgcttttgctcctgaatgtggaatgaacccacagagggcacattcccaagctttggccttaaacttggatgccataagacaaccctggttcctttgtgaacccttctgttcaaagcttttgcaagcttaaggattcccaacgaactaaga

SEQ ID NO: 672610 - DNA, 196 bp, Homo sapiens
atccaggacacaggacttccctgcacatcatcatgagtaccccagacagctcgtggatcctgctcacatggcccatccaaccccaccagcagcgtaggactagggacagcacgctaccccagctggggcagtgtggcactcagcaccatgcagccttgctccccagtggacaaatcagctctaccgtacacctaat

SEQ ID NO: 672611 - DNA, 224 bp, Homo sapiens
ataactccttcgagatactctgctaagggtaataaagaaggaataggatgttgtgaatcagagtgaaaatctaaaacctcaaacactatcggaatttactgtggtttaccttcaaagcaactgtatgacattagattatgaagatgagaaatatttaaccgattcgcacactactttttattgctaatagcagccaacaacatagtcagcgagctagataccct

SEQ ID NO: 672612 - DNA, 198 bp, Homo sapiens
cagaagaaaaagtgctgctgcactatcagactctgtaacactaatcgatacgtgatctctgttacaaaagacaacagcaagtacaggttccaacatgcaatacgtggtcaacttaaggtatatttagttgcagtccagctctttagactgggtggtatgggggatacaaacttaaagcaaaaaactatcaactacaaa

SEQ ID NO: 672613 - DNA, 1502 bp, Homo sapiens
  misc_feature (79)..(79): n is a, c, g, or t
  misc_feature (312)..(312): n is a, c, g, or t
tggctattaatcctgccacaatattttaaattacgtacaaagatctgactttgtcacccagggacccatttacacccangtgctggctgaccagaggcccccctgaaccccaaggccaacaagaagaagaagatagactcaggattattgtttggaagaccttacaaacaccccgggccatggtactgtgcgccatctccaggccgggtgcttgttccctctctatacgcctctctgtgggccgcaccactgtggcattgtgctcatgtggacctctgtggaagacgggggttcacccaaaacggggtgccncattcttacagagggctatacgcccttccccccacatgagcacatctcctgtgtcgtatctgtgagaccctgtggctgtgagcccggagatccctgtgaccagatatatatctctctcatgtagaagaaatctcctctccaacgtagaagacagagaggctataacagcgctttcaacgcgaacacaagtgagcccagaaagcgggagaacactcgtgtgcgcgcaaaaaactccagagagagaaaaaagccgtggtgcacatagcgttccgcccgcgtggacactctgcgaagctcgaggaagtaagtggccccacgcgagccggaaaaatcactctcccctcttctcctcgtgggagaaaagaagccttacgaagtctttgccccgaattggcggccgaggggctacactccacccccagttgggggccaaaagtcgaagacgggggtctccccaggagtggtctcacgggaaaaagaggcgcccattgagtctccaccaacgcgcattctcaactatctaccccagtggggaggattaattggcagaacacttcattgtggagcgggggacacatatcccacaaggagaaaaaaaacacactctttttccaaaaatatcccacaacttcaagtggaaccacgtgcggttggcacgggctgcggcaacaactccccgcagaaaaaagcaaaccccgtggataagacggccacaacaacacacggggtgtagcacaagacacgagcgggcgcgggggaaaccccacaccacaatggtaaatcccgcgggagcacttgacagtacacggcggagtttcacaaaaagggaggaaatcaaccagcacgcttgtgggcgcacacagagcacaccacagagaaagattaacgaaaaatcatcggagcccccaaaagaaggcgaaagaaaaccgggaggagaggaacaagagggcccacaccacgaggacccaaccgaggacaccttccacgcaaattggcggttgaccacgcccggagggcgaagaaacagacttggcggcaccacaaatagaaccacacaacaggcttaatcagaagacccgaagcagaagcaagcacgcgacggcggaagaaaaaaacaaaaaagacgcgcacagagacgacacacatctaccacaccaatacagcacacgacaactagccacataatacag

SEQ ID NO: 672614 - DNA, 945 bp, Homo sapiens
  misc_feature (50)..(50): n is a, c, g, or t
  misc_feature (88)..(88): n is a, c, g, or t
  misc_feature (163)..(163): n is a, c, g, or t
  misc_feature (173)..(173): n is a, c, g, or t
  misc_feature (179)..(180): n is a, c, g, or t
  misc_feature (182)..(182): n is a, c, g, or t
  misc_feature (194)..(194): n is a, c, g, or t
  misc_feature (202)..(202): n is a, c, g, or t
  misc_feature (207)..(207): n is a, c, g, or t
  misc_feature (215)..(215): n is a, c, g, or t
  misc_feature (239)..(239): n is a, c, g, or t
  misc_feature (241)..(241): n is a, c, g, or t
  misc_feature (246)..(246): n is a, c, g, or t
  misc_feature (286)..(286): n is a, c, g, or t
  misc_feature (290)..(290): n is a, c, g, or t
  misc_feature (306)..(306): n is a, c, g, or t
  misc_feature (309)..(309): n is a, c, g, or t
  misc_feature (321)..(321): n is a, c, g, or t
  misc_feature (326)..(326): n is a, c, g, or t
  misc_feature (335)..(336): n is a, c, g, or t
  misc_feature (339)..(339): n is a, c, g, or t
  misc_feature (351)..(351): n is a, c, g, or t
  misc_feature (391)..(391): n is a, c, g, or t
  misc_feature (402)..(403): n is a, c, g, or t
  misc_feature (414)..(414): n is a, c, g, or t
  misc_feature (422)..(422): n is a, c, g, or t
  misc_feature (424)..(424): n is a, c, g, or t
  misc_feature (434)..(434): n is a, c, g, or t
  misc_feature (440)..(440): n is a, c, g, or t
  misc_feature (442)..(442): n is a, c, g, or t
  misc_feature (450)..(450): n is a, c, g, or t
  misc_feature (456)..(456): n is a, c, g, or t
  misc_feature (523)..(524): n is a, c, g, or t
  misc_feature (528)..(528): n is a, c, g, or t
  misc_feature (536)..(536): n is a, c, g, or t
  misc_feature (609)..(613): n is a, c, g, or t
  misc_feature (616)..(616): n is a, c, g, or t
  misc_feature (623)..(623): n is a, c, g, or t
  misc_feature (741)..(741): n is a, c, g, or t
  misc_feature (801)..(801): n is a, c, g, or t
  misc_feature (883)..(883): n is a, c, g, or t
  misc_feature (938)..(938): n is a, c, g, or t
ttcatgaataattgtcattaatacagcagtttccgatatgattataaaanttaccaaaaaatcagaagaatgttagccttcaataganattaaaaccgtgagctgagggctcattagagtctgacacttggcaccattctcatggaagtgaggacacatgttngccaggtctncttaanncnattcatgtcacncagcccgngttanaatttcancaagagagcataccatcgtcctgncncattncgactcttgttgttgacaaacatttaagccgggctatctnttgntcacagtcttgttggntgngtggtgtgtaanttgtntggtttttnnttnatgccgttagcnagctgagatttttcttgagtaaaatagtttgttatattcntgtcgatctcnnaggctggctcngtttgtcngngcccaggagnttgccngncgaggtcnagggcntggggatgtatcgacatgaatccatcccaacttgtggtaaacaaacgacacagcagttaccatcacnnaganctctattngtaggattagaagacttgaggtccaattcagttctcatttggattctatagtatctctcagaatttggttaannnnnacnaaacaancaaaacaaaaaaagggaaatccttactcctttcattaacaactgtccacaaggagaagaaataaaagacttctaatatagataggccttactgattaaaaatctgtgagcttgaatanattttaatatgttgaatctagagtgataaaccaatggttaatatactacaaaactttacnaacaaaatctcatctgttgcagaacttcaaaagtagtggaattgatttcttctcccttttaattttttcttccacaaaagtnctaaaactgagtagtcattggcatgcctgcactttcacaaatgtatcctcaaaanatgatgg

SEQ ID NO: 672615 - DNA, 712 bp, Homo sapiens
ggtagctgccacccggcgagccggccccggtgccaggaagtgatcgtgttcgggagatcctgctggtcccggggcactccgttcccacacggaagctcctgggtggaagactgcaacagctgcctgctgcctggatgtgcctgccgtgactgcagcaaggtgtggtgcggatggaagccttgtcttgctggccgtgccagccctgatggccctgacgctgcccagtgcccacctgggtgcaaagtgtgcctggacgaaggccccatgtgccatgctgtcttgccggaacccaacccttgtgaagtgcctggcgtggctgacgttgcgtgctgcaagaagacgccaccgagcaaccaccccttgcctgcacaactggcttccttgtggcgacaacacctttggggaacaacacgttaacacgcatttggtttggcccccctggccacccttcaaccccattatttgcccaagtttttccagaaccccctgagatggaaacccccaacacatggttttgaccgcccacacatagatcatcccgccttttatatcaacggaccccccctttgcaccccaccgggcgggacacccccctttggtcccttcgcaccccaaggcgcaacgtcaccctttgaacttcaccaatggggtcctggcctgcggcaccccatactggtccgcaacttccgcttcgtagccacacggaccaaac

SEQ ID NO: 672616 - DNA, 110 bp, Homo sapiens
gatgccacgtcacaggacctgctcactctctgtctcggacggagcggagatggtgtctcggcctctgcaccctcctgacaggtttaacttcccccttggattaaagaaag

SEQ ID NO: 672617 - DNA, 957 bp, Homo sapiens
tgggccggggaagggggtctcatgggttgctcaccctggtctcaaactccgtgggcttaagcagccctcccactttgatttccaacagtgccaaatattacgaggcttaagccaccacccctgtggccaagtttaaattgtgtgtctcagtggctgtgaaaacgagttatagcctcggaaaatacttctacttgtgtttttgtgggaatatacgggaattccctttatttcgtgagtgtgagtctcacgaaattgaaaagcgtagataaagtgcttttctgtgtgaacacagggggcacatataacaggtctcatctcccctgtgtggatatctcccatgtggggagagatgtgtgtttctcacaggagaaaccccccaaactgtgtgaaatatctcaaagaaatctccagagtgggtgtgcctcaaggtctccccatttatatctcagaaaacatgtgggttaaatatgtgcgtatattgtgtgccatatattatatagcctataaaatattacaaatctcccctccgcgtgtgtggtgtcactttgtataacatctacatctctgtgcacaacaaaagtgaaatttatacctattatataatagcactataatattataagaaatatcacctatagacaaaaaatcttccacttctccatatgtggtgaacgatgtgcggaattcatccaaacacaatctaatgtgtggcctacttgtgggacggtgttttcacacacaggataaaaatcttctccacaaggtgtatgtgggggccaatcttcttgttggtggaggaacacccttttgttgtgtggtgaacacaattttttcttctccattttttatcccagtagaagactatatctttttgtgcaggactgtggtgaagaccaagtgtgttgaggtttatagaacaccgccccactgtgagaatgtctgcaaaaacccccccag

SEQ ID NO: 672618 - DNA, 382 bp, Homo sapiens
  misc_feature (216)..(216): n is a, c, g, or t
  misc_feature (235)..(235): n is a, c, g, or t
  misc_feature (257)..(257): n is a, c, g, or t
  misc_feature (265)..(265): n is a, c, g, or t
  misc_feature (269)..(269): n is a, c, g, or t
  misc_feature (312)..(312): n is a, c, g, or t
  misc_feature (318)..(318): n is a, c, g, or t
  misc_feature (326)..(326): n is a, c, g, or t
  misc_feature (335)..(335): n is a, c, g, or t
  misc_feature (360)..(360): n is a, c, g, or t
  misc_feature (362)..(362): n is a, c, g, or t
  misc_feature (364)..(364): n is a, c, g, or t
  misc_feature (367)..(367): n is a, c, g, or t
ccaccccagcccccctgccctccaggggcaggattcaggccttttaggagcccccggggcaaaactgctgggccagtggccctctgtgtgggaaaatggcaaaaaaatggaaaggcatggggggcccaaagggagcgttgggaggggcttaggataccccaaagtccaggctaattaaaggatgtggcaggggcagtggcctggatgcccagtgcntgatgggagtaggctccanacaggaggagtggggcagacancagctggncttnaaggtttgatgccaaaacagacattttcctcccccccccctgntgctgnatgaaaanctggggatntgtttttccataagattttgataanananacnaacccttagctgtga

SEQ ID NO: 672619 - DNA, 649 bp, Homo sapiens
  misc_feature (61)..(61): n is a, c, g, or t
  misc_feature (63)..(63): n is a, c, g, or t
  misc_feature (149)..(149): n is a, c, g, or t
  misc_feature (152)..(153): n is a, c, g, or t
  misc_feature (192)..(192): n is a, c, g, or t
  misc_feature (232)..(232): n is a, c, g, or t
  misc_feature (235)..(235): n is a, c, g, or t
  misc_feature (268)..(268): n is a, c, g, or t
  misc_feature (304)..(304): n is a, c, g, or t
  misc_feature (316)..(316): n is a, c, g, or t
  misc_feature (318)..(318): n is a, c, g, or t
  misc_feature (342)..(342): n is a, c, g, or t
  misc_feature (351)..(351): n is a, c, g, or t
  misc_feature (354)..(355): n is a, c, g, or t
  misc_feature (390)..(390): n is a, c, g, or t
  misc_feature (419)..(420): n is a, c, g, or t
  misc_feature (452)..(452): n is a, c, g, or t
  misc_feature (455)..(455): n is a, c, g, or t
  misc_feature (467)..(467): n is a, c, g, or t
  misc_feature (481)..(481): n is a, c, g, or t
  misc_feature (484)..(485): n is a, c, g, or t
  misc_feature (552)..(552): n is a, c, g, or t
  misc_feature (565)..(565): n is a, c, g, or t
  misc_feature (613)..(613): n is a, c, g, or t
  misc_feature (623)..(623): n is a, c, g, or t
agcggagcatagctcggagctggagccggcgccagcggctggagcagcaagggagtcaggncnagggccagagagccggagagaggagcccccgaccgagagcccagtgacatgtcggaccctgagatgggatgggtgcctgagccccnaanncatgacgctgggggcctctcgggtggagctgcgggtgtnctgccatggcctcctggaccgggacacactcaccaaatcncanccctgcgtgctgctcaagctctactctgatgancagtgggtggaggtagagcgcacagaggtgcttcgntcctgttccagncnctgtcttctcccgggtgctggccnttgagtatnttnnggaggagaagcagccctgtgagttccacgtgttcngatgccgaggacggagccaccagcccccnnaaatgataccttcctcggctctacggagtgcnccnttgggccagatngtgtcacaaaccanggnncactaagccattattgctgaagaatgggaagactgcgggcaagtccaccatcacgatcgtggccgangaggtatcaggcncaaacgactatgtgcaactcaccttcagagcctacaagctggacaacnaggatctgtncagcaagtctgaccctttcatggaaa

SEQ ID NO: 672620 - DNA, 200 bp, Homo sapiens
ttcagcctccccccccccccccccccccccacccatttggggggtcccccccccgggcagggtttttaaaagttttttagggcccttttttttttttaacccccggccctttttaaaagtttttttttttttttttttttttttttttccctttttttttttaaggggtaccccaaaaaagccctttttttttttgttta

SEQ ID NO: 672621 - DNA, 528 bp, Homo sapiens
ctgtagagataagctcccactgtgttgcccaggctggtcccaaactcctcggctcaagcgatcctccgcctactaaagtgctgggattacaggtgtaagccactgtacgtggtcttttttttttcattttttgtagagacagggtattgcttttttgcccaggctgctctcgaactcctaatctcaagtgatctacccacatcagcctcccaaagtgctgggattacaggcgtgagccaccgtgcccagtgcttttttattttcataaaaatatctctgtacagtaccaatccttcttacactgtctgcttcagtttcagtgcctgtatcatagaagtgtccatgttgtaaaagaaatcaaaagcagtcttgaataattggaacccacctgctggattgtctaatgtcagtttgttgtctgggcactgcttcttctgtcttcttcctcactgtctaacactggttcagaaacactcatctccatcaagtaggcttcagttgatttcctcaggtgtggtgcctgtccgc

SEQ ID NO: 672622 - DNA, 267 bp, Homo sapiens
ttcattagcgcaatttataagttgaactagcattctatcttgtacaaccatggctatcaccaggctcggatagagtttgtcgtcctctacctataaatcttcccactattttgctacttatacgggtgttgctcttttagctgttcttaggtcgctcgtctggtttcgggggtcttaactatggctctcctatgcaaagttattatctcattcattcattttgcagaatgtataggggttagtccttgctatattatgcttggttgt

SEQ ID NO: 672623 - DNA, 388 bp, Homo sapiens
tttggggctaaaaatatcaaggatgggcacttcaaatggctttgcatttgcttgttgcagtgcgagagcgtaggattagaccctggcgtccactgtgagatgttcttcagctaccagagcatcaagtctctgcagcaggtctttcttgggtaaagaaatgacttccacaaactctccatcccctggctatggctatctggccttgcgtattcggcatcatctccgtgaataggttgactgtcacgatgtgcatagtacagttaggacaagcctggggtccatacagacctgtggagaacatacggcaatgtccccttggtagccagattcttcttcaagctcccggagagcaagctagctgctggggtaaacaccatcatctatgagc

SEQ ID NO: 672624 - DNA, 263 bp, Homo sapiens
cccctggcagagctctgtgcaggtagatttctaatttaaaatcatcaaaggcggagaagaggaaggaaagaaaaacaaaggacagtatatcagttatgttcctttcaagtgatcagggtgccagctgaaaccagggtaagcaaaacaaggaaattttagtggcaaacaagtccagggataattctagcttcagttatgacagtattcagggttcaaaaactgttgctagtactcagtttttctccagcattcagctctgccag

SEQ ID NO: 672625 - DNA, 193 bp, Homo sapiens
  misc_feature (153)..(153): n is a, c, g, or t
acgagcagggctctgcccggggactcctgtccgctactcctcatcttcactaggaacatgatgatccgagtcggtaacaggcataccaggcacgtcgaacggccttcagagccgagagaacgcccgaaggtacacacaactggcgaccctccncggatgaggttgtcccgcagcaccggctctgcccattgct

SEQ ID NO: 672626 - DNA, 416 bp, Homo sapiens
gcagtacggactgtggacaagaacttgggacccaaggaatggccagactgaaagagctgtaacacaaacaggggtgatcctccccctcccctgctcactacattgtggtgcgacgatgaaggagagaagagctgcggcccttcggggagcccagacctaggggctccctaagccaggtctgtgacatcctctttggggctctgcggttcctggtgtctccaagtttcggggtgccaccgtgttcccagtgcccacaatggaagcgacctgcagtatgcctggtccagccacagccttgcacggagccagtgcctgtgcctggagctgcctgccccaccacagtcggcatgcccggctgtgcacagtggccggatgaccctgaactcactcacgaactcctcgccacatccgtactg

SEQ ID NO: 672627 - DNA, 376 bp, Homo sapiens
ggtgttaacagactgtcgagcagtgttgcgttctgttatgacggtgacgagatgcccatcatgactctggtccccgccaaacgtggcctccaatgaatgtcatccctgccctggaactggtggagcccattaatgaagcactgaggtcccatgcaacagtcttgattgtttacttgtgcaggttgtgtgacattccttggtgacaggacggtgaccacagctgcattgacaaccaaacaacgacttgagaacagaaatacctcgaccgcttcttgccaaaactgttgctcgaagcttgcctgaagtccctagtctggaacgagtgccacggaggttggttggaccaccgtaccggaaggctccactccttgtccac

SEQ ID NO: 672628 - DNA, 288 bp, Homo sapiens
  misc_feature (63)..(64): n is a, c, g, or t
ggggggaaaaaaacaaatttcccccccgccccccccttttggggggggggggttttttttttnnaaccccccccttccccccggggttcccccccctccccgggggggaattttttacccccaaatgggttttttttttttttttttttttttttttttaaaaaaaaattttgggggaacccccccccccttgcggggggtttttttcccctttttcccttttggggggttttttttggagggggcccccttggggccctttttttttaaaaaaaaaaccccttttta

SEQ ID NO: 672629 - DNA, 370 bp, Homo sapiens
agtatacttcgatcgcggagaatttgtcagtccgacttgcgagggagggatcctttcagaagaaccacaggcgggtgacttcggcgcggagtgcccaggttcacagtgcagcttgtggatcgtgtccatcttgcaggtgagctcttcctccacatcatgactgggttttcgaaaaggacgggggatggaaatcctccaggatcttaggaaatttcactccggtttctcctgtttcaagtggtctctttggctcggcagtggtgttcttctcctgcgatcgaagttgtgcaacacttcgattcgcggaataatggagtgtaagagggtagggagggaggcaaaggtcgggtacggtaggaaacaagtgaag

SEQ ID NO: 672630 - DNA, 1559 bp, Homo sapiens
  misc_feature (119)..(121): n is a, c, g, or t
tgaagttcgttctgctgctttccctcattgggttctgctgggctcaatatgacccacatacttcagatgggaggactgctattgtccacctgttcgagtggcgctgggttgatattgcnnngaatgtgagcgatacttagctcctaagggatttggaggggtgcaggtctctccacccaatgaaaacgttgtagttcataacccatcaagaccttggtgggaaagataccaaccaatcagctataaaatctgcacaaggtctggaaatgaagatgaattcagagacatggtgacaaggtgcaacaatgttggtgtccgtatttatgtggatgctgtcattaaccacatgtgtggcgcaggcaatcctgcaggaacaagcagtacctgtggaagttacctcaatccaaataacagggaattcccagcagttccatactctgcttgggactttaacgataataaatgtaatggagaaattgataactacaatgatgcttatcaggtcagaaattgtcgtctgactggccttctggatcttgcacttgagaaagattatgttcgtaccaaggtggctgactatatgaaccatctcattgacattggagtagcagggttcagacttgatgctgctaagcacatgtggcctggagacataaaggcagttttggacaaactgcataatctcaatacaaaatggttctcccaaggaagcagacctttcattttccaagaggtcattgatctgggtggtgaggcaattaaaggtagtgagtactttggaaatggccgtgtgacagaattcaagtatggtgcaaaacttggcacagttatccgcaagtggaatggcgagaagatgtcctatttaaagaactggggagaaggttggggtttggtgccttctgacagagcccttgtgtttgtggacaaccatgataatcagcgaggacatggtgctggaggatcatccatcctgacattctgggatgctagaatgtataaaatggctgtcggatttatgttggctcatccttatggattcacaagagtaatgtcaagttaccgttggaatagaaatttccagaatggaaaagatcagaatgactggattggaccacccaataacaatggagtaacaaaagaagtgaccattaatgcagacactacttgtggcaatgactgggtctgtgaacacagatggcgtcaaatcaggaacatggttgccttcagaaatgtggtcaatggtcagcctttttcaaactggtgggataataacagcaaccaagtagcttttagcagaggaaacagaggattcattgtctttaacaatgatgactgggctttgtcagccactttacagactggtcttcctgctggcacatactgtgatgtcatctctggagataaggtcgatggcaattgcactggacttagagtgaatgttggcagtgatggcaaagctcacttttccattagtaactctgctgaggacccatttattgcaatccatgctgactcaaaattgtaagaatctatattaaagagatttggattaagcatca

SEQ ID NO: 672631 - DNA, 481 bp, Homo sapiens
ttaatatatgaagctgtctataggcatgatagaataaaaagtttaaaaattatttgggtcaggcttaaataactttaacaggtaaaaaaagtgtttgacaatattcaacaaataattcttcacctaatttcttattgaagcaatcaccttaatattcattggccttgataaatgtgaacactggtcatatttatgtaaataatggtcatgtggctttcttggcatatctaaattcatgttagatctggcttaacctgtgcttatgtatgtatatgttacagttatgtacattaaatgtgtgtgtaagagttggaattatttgaaagatagcaaaattttaactagaaaaaataagttaatatctaatgattgttgactcattgattaaaataagtagttattatgaaagagaaaaaaggtgatttcaaattgattcagaagaactggcccagcaactaagattgtatgctttcctttttaa

SEQ ID NO: 672632 - DNA, 1139 bp, Homo sapiens
  misc_feature (119)..(121): n is a, c, g, or t
tgaagttcgttctgctgctttccctcattgggttctgctgggctcaatatgacccacatacttcagatgggaggactgctattgtccacctgttcgagtggcgctgggttgatattgcnnngaatgtgagcgatacttagctcctaagggatttggaggggtgcaggtctctccacccaatgaaaacgttgtagttcataacccatcaagaccttggtgggaaagataccaaccaatcagctataaaatctgcacaaggtctggaaatgaagatgaattcagagacatggtgacaaggtgcaacaatgttggtgtcattgatctgggtggtgaggcaattaaaggtagtgagtactttggaaatggccgtgtgacagaattcaagtatggtgcaaaacttggcacagttatccgcaagtggaatggcgagaagatgtcctatttaaagaactggggagaaggttggggtttggtgccttctgacagagcccttgtgtttgtggacaaccatgataatcagcgaggacatggtgctggaggatcatccatcctgacattctgggatgctagaatgtataaaatggctgtcggatttatgttggctcatccttatggattcacaagagtaatgtcaagttaccgttggaatagaaatttccagaatggaaaagatcagaatgactggattggaccacccaataacaatggagtaacaaaagaagtgaccattaatgcagacactacttgtggcaatgactgggtctgtgaacacagatggcgtcaaatcaggaacatggttgccttcagaaatgtggtcaatggtcagcctttttcaaactggtgggataataacagcaaccaagtagcttttagcagaggaaacagaggattcattgtctttaacaatgatgactgggctttgtcagccactttacagactggtcttcctgctggcacatactgtgatgtcatctctggagataaggtcgatggcaattgcactggacttagagtgaatgttggcagtgatggcaaagctcacttttccattagtaactctgctgaggacccatttattgcaatccatgctgactcaaaattgtaagaatctatattaaagagatttggattaagcatca

SEQ ID NO: 672633 - DNA, 209 bp, Homo sapiens
  misc_feature (131)..(131): n is a, c, g, or t
  misc_feature (137)..(137): n is a, c, g, or t
tcgatcgagctcggtccctatggtcctttgaaactttgctgctaaaatcaccagatgttcaaccaatctgcctcagctgcttacatttggagtgaaatatgtcgagataaaaatgatgctgttttgcagcnaagttntcaaaggaccatagtactctgaaggaagcacgtagtcttctgtataacatatttttaataaggatcccctag

SEQ ID NO: 672634 - DNA, 258 bp, Homo sapiens
aggatggataactggttaattctacaaaacatttaaagaggaattattactagctcttcacaatctcttccagaaaagagaagggaacacttcccaagtcattctatgaggccaatattacccagataccaaaatcagacaaagatgtcaccagaaaactacagtccaatatcctttgtgaatatagatgcgaaaatcctccaggaaatactagaaaaccaaattcagtgatatactaaaaggattatacaacatgaa

SEQ ID NO: 672635 - DNA, 1844 bp, Homo sapiens
  misc_feature (119)..(121): n is a, c, g, or t
tgaagttcgttctgctgctttccctcattgggttctgctgggctcaatatgacccacatacttcagatgggaggactgctattgtccacctgttcgagtggcgctgggttgatattgcnnngaatgtgagcgatacttagctcctaagggatttggaggggtgcaggtctctccacccaatgaaaacgttgtagttcataacccatcaagaccttggtgggaaagataccaaccaatcagctataaaatctgcacaaggtctggaaatgaagatgaattcagagacatggtgacaaggtgcaacaatgttggtgtccgtatttatgtggatgctgtcattaaccacatgtgtggcgcaggcaatcctgcaggaacaagcagtacctgtggaagttacctcaatccaaataacagggaattcccagcagttccatactctgcttgggactttaacgataataaatgtaatggagaaattgataactacaatgatgcttatcaggtcagaaattgtcgtctgactggccttctggatcttgcacttgagaaagattatgttcgtaccaaggtggctgactatatgaaccatctcattgacattggagtagcagggttcagacttgatgctgctaagcacatgtggcctggagacataaaggcagttttggacaaactgcataatctcaatacaaaatggttctcccaaggaagcagacctttcattttccaagaggtcattgatctgggtggtgaggcaattaaaggtagtgagtactttggaaatggccgtgtgacagaattcaagtatggtgcaaaacttggcacagttatccgcaagtggaatggcgagaagatgtcctatttaaagaactggggagaaggttggggtttggtgccttctgacagagcccttgtgtttgtggacaaccatgataatcagcgaggacatggtgctggaggatcatccatcctgacattctgggatgctagaatgtataaaatggctgtcggatttatgttggctcatccttatggattcacaagagtaatgtcaagttaccgttggaatagaaatttccagaatggaaaagatcagaatgactggattggaccacccaataacaatggagtaacaaaagaagtgaccattaatgcagacactacttgtggcaatgactgggtctgtgaacacagatggcgtcaaatcaggaacatggttgccttcagaaatgtggtcaatggtcagcctttttcaaactggtgggataataacagcaaccaagtagcttttagcagaggaaacagaggattcattgtctttaacaatgatgactgggctttgtcagccactttacagactggtcttcctgctggcacatactgtgatgtcatctctggagataaggtcgatggcaattgcactggacttagagtgaatgttggcagtgatggcaaagctcacttttccattagtaactctgctgaggacccatttattgcaatccatgctgactcaaaattgtaagaatctatattaaagagatttggattaagcatcaaaaaaaaaaaattctttttcatatgctctgtactatatttttatttctattttgtttctttatttttatgtttccatgtgtgctttgtcttctgagccctggagtgtatgtaggatgtttgaacaaccctgtgctgtggcataacctctctacattttcccatgagctgtgctgatcaaactaaatccatgaggcttccctggaactcacttttatctgctattctatgttgttatctcatatgccctttaattcttgcagtttatttccttgtagtaaaaacca

SEQ ID NO: 672636 - DNA, 142 bp, Homo sapiens
  misc_feature (64)..(64): n is a, c, g, or t
  misc_feature (70)..(70): n is a, c, g, or t
catattcactgcaaaatgtaagcagctgaggcagatcggttgacactctggtgattttgcagcnaagttntcaaaggaccatagtactctgaaggaagcacgtagtcttctgtataacatatttttaataaggatcccctag

SEQ ID NO: 672637 - DNA, 507 bp, Homo sapiens
  misc_feature (332)..(332): n is a, c, g, or t
  misc_feature (389)..(389): n is a, c, g, or t
  misc_feature (405)..(405): n is a, c, g, or t
cgaggatcaggacttggcacggtacagctagacgtgggcttcgcatctttccactttgcaggcgttgccactgcatgagaagaacttgctcagccaggctcctgggccccaggaaaaggacaagtgtcacccagaacagagccacctccagctgcactcagctccagaagctggcccggccggtccagtacaccttttaaataatgtcctctacgtgccggtgtggcaagtagcccggatgcaattgaatgaacaacagacggtgctttccaggacggcgctgtgctttccaggatggtgctgtgctttcattcatttgggtagctcctctngtgcagcctccccaaggctggcccggaacattggcagagcaccccaactctccagcnctgcaaggaccccganaattcaagccacacaaagaaaggaggagggggccgttggcatttactgaactcttataacaaaacttggcttccaaggtcaaaaaacagcccttaggcttgg

SEQ ID NO: 672638 - DNA, 140 bp, Homo sapiens
gcccggtgttgtggatgcatcagtagatcactgtcactctgcattagtatgaattgaatatgcattctggaaatcaattcatttatagtgtttttgataaagtatgtttttaaattatagttttaatggtttgatttggt

SEQ ID NO: 672639 - DNA, 172 bp, Homo sapiens
ccggtatgggggccttgctcaatagaagccggcgtaaagagtgttttagatcaccctctacccaataaagctaaaactcacctgagcttgccaaagagtcgcagatgacacacaatagactacgaaagtggcctgatgttattgaatcacacagttagcaaagaccccgagg

SEQ ID NO: 672640 - DNA, 537 bp, Homo sapiens
tggaaatggagtctcgcctctgttgcccaggtctaaagtgcaggggccaatctcggttcactgcgacctccgcctccgtgggtttcgggcgattctccgtgcctcagcctcctgagtttgctgggattgcgggcacctgtccaccacacccggttaattttgtgagggggtttcaccattgtgggctcaggcgtggctcttgaactcctgaccctcgtggtctgcccaccttggcctcccataggtgcgtggggattacagacttgagccattgcgcctgggccgatgactttttattaattggaaattctgtcctacttttaacctaagtttctctacttccctggattactgaagaaaaagagatggggaatgatttggactttttgggcctgcttagtcccaagagaaatccgacttcattggctggcttttgggaaggcaaggagccagtttttctactctacctgattttgatcgaatgaccttgagcaagtgacttgtttccacgactcggattacttcaaaaacccccaa

SEQ ID NO: 672641 - DNA, 311 bp, Homo sapiens
gccgggggggggtttagggttacaaaccccgaagggttgggagggttaagttccaggccccttaaattgaagttcaacttggcttgggggtgacaggattggttagggccctgaagcccggggggaaaatcctttgggaccggtttaaggggtttccggggggggattttattgggccttgggggggggccaagtttcaaaccaagttcaaggtgaaatttgtggggaagggggggttccctgggaacccgtttttgtttccctccggttccggggggttgcccctcaataaaaaatttttttttggtgga

SEQ ID NO: 672642 - DNA, 276 bp, Homo sapiens
ggtagatgagcgaatcgatgagtcagccactgtgaacatgcccccaatgactggcgcacacacctgtacaggaagtgggctgaaggacctgtagcttctccgtcagcttcaccagtcatgggacgagagctcatagtaggacgaagactccggagaaggccttgctcgcccacacagccgcattggcaaccattctcatgtctaggtcacacgcgaactgcatttgtcctcacgtaccatctccagtccggccttcatagtacaacagtgggcacc

SEQ ID NO: 672643 - DNA, 139 bp, Homo sapiens
aattttgcccactggccgttgagcgcccccgagccctgactcctggactccggaggattgagccccccccggaactgggctggcgcttggatttggggtgggagtaacagggcagaaatgattaaactgtttgagccca

SEQ ID NO: 672644 - DNA, 311 bp, Homo sapiens
gggcactcctgccttactttgtttatgtggtcagtggggtgaaatctgtaagccatgacctggagcaactccacgtgctgctgcaggtggcacgaagcctattccgtaatccccacctgtgcttgggccctatttccgcttgtctggtgggaattgccatctactgtgtctgggagcacttggctgcctcattaacccccttaattgaccactgaactctgggggatggggctgccctcctgctcagccacatcttctggactcatggggaccttgtaagtggcctctatcagcatatcctgctatccctg

SEQ ID NO: 672645 - DNA, 441 bp, Homo sapiens
ggtccgtcgacggagcacagtagtccgtgtgtcacttaggctgactctgtccagggtgacgtatgctgtcactgtcttgaatcttcatcgtttacagcgagccagtgtttcactttgcacattgggtatctggtcttgcctgtcctaccctgaacctgggttccctgggccatgtaacacccaggcagctctgatgcccctgggtacttggaggagctcccaggaagtccaagcctgcgccaggaatctctggctttcacagtcttcaaaggctggagcggtgcccctgccacccacagactccacatagctctgacaacctgctttcctgaacgcctcgttcctgggtcctttcacccaccagacctcactgtgtggcctcaactctgaggcacctgccctctgaacccccagttctacaataaacggggtggattccaa

SEQ ID NO: 672646 - DNA, 325 bp, Homo sapiens
ttttggggtttttttgaaaaaaaaaaattttttgggggaaacaagaattttttttcaatggggcccccgggggaggaaagaaattttggggtttttcaaaagggaaaattaaatttttccccctgggggggggccccttttttaaaaaagtagggcccaaagccctttaatgggggggcccttgttgtttttttgtttttttgttggggggccaaagggggtgcccccgggggtttttttttttgtttttaaggggaggtttttggttgggtttttcctgtttctttgtttttaattttgggaattaaaataaacccttgttgga

SEQ ID NO: 672647 - DNA, 546 bp, Homo sapiens
  misc_feature (42)..(42): n is a, c, g, or t
tggaaaatgctcaaccctctccccttgttggggcagttgacnagcagtttaactgtgtgtcccggctggcaaactctcgcaaggcgaagaccagtactatttgcgggtctccacggtggctttccacacttttgaattggacgttccttccggggtcccttagggggttgtgaagctcttttactttgatcccatccctgtggcgggccctgtagaagtttccaggaagaacccttaatttatggaggccgtggcggagaaagcgcttcaggaattcccccaaaagccccgggaggagtgagatgtggatgttgcttttgcccctacggggggattttagtccagctccccccaagatgaggtgcagccccccagagagaggtttgcacgtcaccaagttaccagggcccagccttcagggccccaactccgcccagcctttccccgctttgggtcctgccctttaacccttggctttgctggtcatgggaagaacagaattggtcctgcctgccactaattccataaaactgttttgtggggtga

SEQ ID NO: 672648 - DNA, 923 bp, Homo sapiens
ggaggccaaggcgggcagatcacctgaggtcaggagttcgagaccagcctgaccaacatggagaaacccccatctctactgaaaatacagaattagccaggcatggtggcacatgcctgtaacccagctactcgggaggctgaggcaggagaatcacttgaaccctggagtgcagtggcatgatttcagttcactgcagcctcgacctcccaggctcaggtgatcctcccacctcagcctccagagtagctgggactacaggcagtgtgccaccacatccagctaattttttacagttttttcatagagacagggaactcactatgttgtccaagctggtctcaaactcctgggttcaagccatcctcccacctcagcctcccaaaatgctgggattacaggcatgagccactgtaacccagccaaaattgtttccttttttaagtgaattcaaccaatttctgtgagtggctcttttgcatgaacactgtgccaggtgttggcgaaatccaaagctgaccaaacattggtccccaccttttggagcttacagtctgttctgggggaaccgagattcagaccaaggccaggaaacacttggatgcagctagatatctggactgtgcttggtgtctatacgtacatatgtggatcttgggtcctttatccctaaatttgttccaaacagcattataactactcctaatctactgagctaacttatattgacactgccgacaaactatttctatgtaagcttcccatggacggcggacgcaatttcggcttccaacaccatcgtttcgctcgagtttgaccagacctcacgcggtgggagaaaagcggcacggaccttataaacgggagaaacgagagggtcaagaaacaccttgcacatagcctctccccaccccacccccccc

SEQ ID NO: 672649 - DNA, 240 bp, Homo sapiens
cgcagcttgcctgccgtggcctccctgggctcctcactgtcccacagccagagcctctgctcgcaccttcttccgccgcctgaagaaagcgaaaggtgcccaatcttctgaatggttccggccggcaaccctttcttggtgttctatcggtaaacctttcgaacctggcttctttaaatccttcccttggcttctgggaatcaatcgaaacttgaaataaccaaacaaaagggaattccg

SEQ ID NO: 672650 - DNA, 660 bp, Homo sapiens
atttttttgactctgattcacagttctgcatgcagctggtttgacatagacttatgtatttgccctgccgaagtgaattgtgtggagaatgtaaaccgccttcacgtggcggaagacttactaaggccccatctcgctggcctcgcgctgggcggctgagaaatccacctgagaacaggtcccgcaaaccggcgacggaaggacattagacttttatttttgcatataattgacatgaatgtaaaggagacagctcacgcttgttttggagcctagtgactgtgcatctatggctgtgatactcttttctaaatgaaactccatgtaccaacccggacgcagctgaaaaggcgcccaatgctctggttattagagtttaataggtaagctgtgatgcacttgggggtagagttccacaatgatcttttggtttgtaaacacttgagaaacatgtgcctcagactagatgatttgtctatgattttatgcacttaatacctgacagtatgagcgatctatgcgccattattggggcggacacgctggcggtaggattgagacgtacagttgaaactgcatgactgtaattgtctggagagataaccttttagggattgccaaggttttatggaaggcccttatacatggcatgttttcgcc

SEQ ID NO: 672651 - DNA, 115 bp, Homo sapiens
cagtgggcacatgtggggcacgttccgcttagaaagacctgatggctcccactttgatgttcggactccttccttcttcctggaaagcaataaagatgagagcaccaccaattca

SEQ ID NO: 672652 - DNA, 116 bp, Homo sapiens
gtggagtccgtgtagtcttgtgtgtgtgctgtgggggctcgctgtgcctcactggcctccctgtgtgccgtcgctgtgttggaaagttgtccccacagccatgctgtgagtcccaa

SEQ ID NO: 672653 - DNA, 191 bp, Homo sapiens
cccccgttatatcgagcgaggagaatggggaagaggaaacacgagtgtgtcgagaacgcaaagctgtgatgactgaacacgttcattcaggtgagatgtctatactaagttgagtggaacatcaggaaaagctccatatggactcatgtgcacatgtctggaggcaccagatccctcctcggtcggtctta

SEQ ID NO: 672654 - DNA, 351 bp, Homo sapiens
attgctttcttgtattaatcattattatctctgttcggcatttcaagggtctgcaccccgaagacattggtgggtccccaggataggtggccgattggctcatgatccctggggctcacaccaatgccactcaaacccctgaaaatattgggtggggggctcctcaaaagtcgatcgtcaggagtcagagctgggcaggggcggccgatgatgtggagagataggaacacttttacactgttggtgggactgtaaactagttcaaccattatggaagtcagtgtggcgattcctcagggatctagaacaagagataccatttgacccagccatcccattactggatatata

SEQ ID NO: 672655 - DNA, 282 bp, Homo sapiens
ccaggtagacctaacccaggtagaccccaggtagacctaacccaggtagtaagttttttaagtccacttaaaaatacaatgagcacaaatccacatttatttattagatttttacgttagtttaaataccttgagagggtacatgcatcactgcggattctggtgtccaatgggccttagcagtgaagattgctgtcggaatttggcacgaaccatgccactgtttccatgggcccgagttaattttccccagatgactctggttttgtgaggtctacctgg

SEQ ID NO: 672656 - DNA, 173 bp, Homo sapiens
atacctttcttgcctccgactcgtttcttgcccagacgcgtgactcagtgagggaggcagtgcaatatctctgtgcccttctcctgccatatgatcgtattatcgccacgtccaccaaaagctgggtgggcaggcagtagtgatctacaggcttgttaatttgtatttattta

SEQ ID NO: 672657 - DNA, 983 bp, Homo sapiens
ggttctgagaatctattacttggcaggatgaagacccgtagggtgataactgtaggctaatactacctatggatcgcatcttgcagaatcttctactctcctctttatggagcatctggtgtatcgtcttgggggttggagcacgagaatctgtgaacctaaccggatgctcgttagagctcggttcgaccttcccatagggatagctggaaaaggtacggatctatacgcgattgtatcgtggatgtgcgtaccgatcgtatgggctcttgctactgcggatgtctgtcgatgaccatccatatactgcttcgaatgacccatcctgtgacaggtggtcatatctgcgttgattttacgaatacaatactgtacagagttacaaggacatgagattggctagaagctggtcacgggaagaggcacgtacaactgaaggagactctcccgatagggcggatgtgtgatgctccgtgacatcggtcaccgtcatcaccattccattctattgcaaagcccttgcgaacctaggacagtttagctaatcgtactgcgacattcgctccaggaattgatacgggggtgaatatgacctaagaacaaggattccctatgttggagacccagatcagttcactcattacctggtcctggggagacgcccagtcagtttcctccattggagaccacgctttggatccagttggccacttccaggaccttaaacccatcttgccagtgcgaggcggcccaatggacagatttccctttagaccccagcaggggtcggcaactgatggcccggtgtcattcatgtgattgattgcaagtttcatttctgggagctccatttgttttgtttctaaactaacgaatgttaactccttgggtgggtgatctcgagtgtatttctgaatgtgggtgttgccagttgcctcccagaacacttttaagagatactttatagcctagggtggatgaca

SEQ ID NO: 672658 - DNA, 508 bp, Homo sapiens
  misc_feature (216)..(216): n is a, c, g, or t
cacaccactgagtcgtctttgacaagtgcgattttcagaaggccctgtgctatgttaaactgtagaaattcactactgaacacaatgaaactgttcttcaaacattgggttccaggctatgaccattccaccgtattcttatctggtgacacacatattattgatatgcaacaagtgcaacctatagatctatctcataaaaactgacccttttangaatcttcatgttcttaataccttcatcaactctcacgaaaagaaatctgtgacgttagtcccatggcagcggtaggtcctgtgggtctagaaagtcagcagagaacatgctcggcgcggtggtgctgagaggagtgagtcctgaagaggagttgggcattgtaatgtccaaccactccatgttgtccaagtttgagtctgacaggtcgagagacagacagggagtacctgcagcaaactgggtctcggaagtctccatgggtgagtgtgaatggtccagcatacctgagtg

SEQ ID NO: 672659 - DNA, 83 bp, Homo sapiens
tattaaagaggctgcaaagtccagccaccctgaagatactccccagtgctcccaaactgctaaagaaacagttgccccaggaa

SEQ ID NO: 672660 - DNA, 640 bp, Homo sapiens
aacagacacacgagctgctctctgccagtgtacgagtcctcaagaagactgtcctcagcaaatcagaaagcggttggaccctcatcagacactagatgtgcctgcaccttgatcttgagacttgccagccttcagcaacagtaagaaagaaatgtgtgttgtttaagccaccctagtctatggtcacttgctatagcaccccactaagagaccccaagatatttaaaaccctcatcatcacctgctatctgcagtctggtaccctgcactcttctggttgggtttaccaagtcactcgtcaagtgtccctctgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctgccatgtaagactaccacacaaagactgccatctgcaaaccagaagcaggtgggctttcctcagacaccagatctgcctgcaccttgatcttggacttgccagccttcagaactctaagaaagaaatggtggatggcttggtctaagttga

SEQ ID NO: 672661 - DNA, 385 bp, Homo sapiens
tgaattgaatggaaaagcagtcatagagactgtgtgatgcatataatacatcggtgactgtgcactgagaatgaacgcactgctatttgtgtggcttgcgtaatacagttcttgttatatatcctatcggacatcttcaaagtccagatcagtactaacttcatggaagctcagattgttctagttcagggtaatatatgccttttctaagctgtagccagttttaagtatttgtgccatgaggctcagcgcttacatatgcctggtctgatactgtatgctgattataacatgctaacacatcatgcacatttttatttgctcatgtaagttatatcctccgtcaggcacagtcttcaggtttttgctatcttacacagtgccc

SEQ ID NO: 672662 - DNA, 789 bp, Homo sapiens
tggcatagggaacgaattaatggtattttaaaatgcagcaatctttaaatgaaatgtttccatcacatagtactgtgttcctggtatgaatccaaaactttggagcaataaaagtgctctgcataagtttataaaatatgcttccgggatttaaaatttaccagaaaaattcccaaacaagtcataggtatgattctaaaatatttatgtacataatattatgactacgaggaggaaatccctcactgtagtacaacacagtggtacaatttatgaagcacagggtttagttaaattcccctttaggtttccctcacatgggtgcataagtggctgactacttgacacaactatgccccattctacttgtggcaatacaaagtagaagaggattgtgaggacaattttaaagtagaaaaagtgacaaataagtggtggcaaaaatacgaggtgcaaagtgctttaaacgagggcactttataaaatagttggctttatccatacttttttataacggtgcaatattacttaaaacagagagcacttgtaccttaatattcctgcaatacccattaaaacaaatggccaggaaagagcagtgcaaatttaaaaacttacacttaagcttagcatgcatctcagaaggcgattcccggaatacagagtatggggaccttgagtcctaatatcttagtcttttttcaccttctttaaacacggttaaaaactacgcggtacccaccatgtgtacccttaaaaaaaacaaagttaaaacttctttccaaaaaa

SEQ ID NO: 672663 - DNA, 382 bp, Homo sapiens
gacacgatgaatgatattcacacacacacactacccccacaacccacccacacacacaccattgggaacatggagcgtctggaggaaatggtggagttcgggcatagtgaatcaggaccggtgtaccgaaaaaaaagttaaccctaaactgaatctcacggaatacatgtgtaggtacagtcaggtcacacagggcaaagtacggtgtattagaaacacactattaagagtccgccaacgacaacagtgtgtaaactagaaactgatagaagaacgtgtggaaatgtatgattagcgtagactaactagataacacggacaggagaggccaaaagggaccagatctatcaaaagtttactaatctgcattttaggaaagata

SEQ ID NO: 672664 - DNA, 433 bp, Homo sapiens
  misc_feature (180)..(180): n is a, c, g, or t
caggtgggtttgggatcgggctttgggggcctccccaagcccggcgcccaaattaagctgggggtccaactttgggtttgggggggggtccagctccttcaaccgcccccgctcccccagggccggggttgttaaaaaaatccaaaccccttatgggaaaatggggttttggtccttttncgtcctgccccagggaaaaaattggggggcccctccccgccttccccttttggggtgccccaaaggctgggaagggggccccttttcaggggggccctggggacaggggaccccccttggggtcagccctagccccccgcccccctggggggtttttttcctgggggccccccctggccctgccccccggtacaaaacaatttaattggtttttttttttgggcccaaaaaaaacccccgctgggtttgccca

SEQ ID NO: 672665 - DNA, 133 bp, Homo sapiens
tttttttgttttttctgatacagagtttagctcgtcgcccaagctgcagtacaatggatgcaatcacagacttactgcagcttccacctcctgggttcaagtgattctcctgtctcagcctcccgagtagctg

SEQ ID NO: 672666 - DNA, 302 bp, Homo sapiens
agcagctattccaacctagctgttacagaagcacatgccacaggcctggctaattttttaaatttttttgtagatatagggttctccccgtgttgaccaggatggtctgaaactcctgggctcaagcagtcctcccctttggcctcccagaatgctgggataataggcatgagccactgtgcccaggccatcttgtctatctagtttatcacgttggtggacatattggagtttttccacgttttatggatgttgtgaagtaatcctagctgtagattggggtaccgagtctcgaccttcgt

SEQ ID NO: 672667 - DNA, 156 bp, Homo sapiens
  misc_feature (23)..(23): n is a, c, g, or t
  misc_feature (39)..(39): n is a, c, g, or t
  misc_feature (140)..(140): n is a, c, g, or t
gcaccctagggctcgatcccagnacccggggatcatganctgagcgaaggcagacacttaaccgaaagagcacccaggaacccctaattacatggatttttcaccttatcggtagtatattcttggttttaggaggtgtncacccaagcttccaat

SEQ ID NO: 672668 - DNA, 263 bp, Homo sapiens
  misc_feature (6)..(6): n is a, c, g, or t
  misc_feature (14)..(14): n is a, c, g, or t
  misc_feature (36)..(36): n is a, c, g, or t
  misc_feature (41)..(41): n is a, c, g, or t
  misc_feature (139)..(139): n is a, c, g, or t
  misc_feature (195)..(195): n is a, c, g, or t
  misc_feature (230)..(230): n is a, c, g, or t
  misc_feature (254)..(254): n is a, c, g, or t
gatgtngtgtgggnaaattttcataacgtatttacnttccnagtgatttggtcatttatcacgagcaactgttaagggaataacttgggtataagatagctgaggcatgaagcattaacctaatttatgcttcgctgtntgtttccagagaggaagctttacaattactctcagttctttagggcagagcttttnaagaggttgcagagaaggattatgactaatgagtncgcttgtcagctaaatgggcaacntagcttgcg

SEQ ID NO: 672669 - DNA, 316 bp, Homo sapiens
tttatgcacaactagggtcagttttgcaggtggtaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 672670 - DNA, 622 bp, Homo sapiens
  misc_feature (593)..(593): n is a, c, g, or t
tcttagggaggattcgcctcaacaccctgcatgcgctcgaatgctctgcacccatctgctcaagttcaaactcctgagcaagctggctctcacagctgccgaacggctgacgagtcgtacattcctaccacttcttagcagtggttctgagtccatgctggttctgccactgtggtcctttaacctcgcaatgacccaacaacggcatgtattactgaccccactttcacacgactccggaaaaggaggctcacgggaggttaagtgacttgtcccgggtcacagagctggatcccagcccggagtccgactccaaagtcggtgctcttaaccgctttgcttcaggagaatgggagcccgagtcccgctcgtctgcgcggtgcagccaggacgggcgtcacgcatttctctcccatgggcgcgcagggagtgagggtccgccccgtctgctccagcagtggtcaccgcctcaggtctcgcctcgtggccccaggggagccccagcccgcggactttggactcctctctcccaccctcgccactcgccctctgcccgtcgcagggctggcccgcccgcctgggccctcacacantcgctctgccgccgccgcctcgcacgctc

SEQ ID NO: 672671 - DNA, 597 bp, Homo sapiens
agagattagatgtcgaagaggtctgttggagagaaaacacctttgaactgactgtaagacagcgggcatgctgtggaagcgccagcgttggctcttccttgcagggactgtgatgagagactggaacaacgactccaggtaatatttggccaggctgatgagtagtgctagagccaaagatgcggtgtcagggtagtccccgagtgtccacaggcaacagtctggcagcagaagcgtccttctgtgctaccatcactgactcaggcaccattctgtaacgtaggcgatggcccgtggccatgaacaggcaagcagatcctgagggtcagcagatgcaggtcaggagcagcaggagcgttgcaaaggagcacaactttatactccctgcaggtaggagaatcggagagcacataattcagtggtccagcaaagctatatccaagtagaattgtgtgtagggacatccatgtgtgtttaggcctctagaaattctgtatggaagctattattgatgtttgccagtagcttcgtccttaatgtgtgtacgtttgaaattcttagagcataactgaagagtgaaaatagacaaacaaaaaa

SEQ ID NO: 672672 - DNA, 136 bp, Homo sapiens
actatataagctatgctagtggctgagtggtaagaagttctgtcactaggaagtgtattaattggtcctagctgtttccgtgtggtttaaatgttcgaattcataagaacagggaggttagaaacagggtcttggt

SEQ ID NO: 672673 - DNA, 1042 bp, Homo sapiens
taatattgaccatttcctatctgccaggcactttttctaagcacactgaagaaacttagatcctaacaacactactgagatggactataacttgcccaaattctttctttctctttttctgtgagaacgtgtagttctcacctcgtgctcgccgtgggccgtggagtatcacacggtgaggtgcagaactcttccagccttcactgtgcccaaactttcacactcctctccacgcgtctctcaccgccgtacttctttattgcgcttcaagtatcctccctgtgagccacgctgtgcggcacttacctcgcgtaatacacccgctcactacgaacgccaccaccagcgctagcaaacttttatatcatatctattcctgtattagcgtgcgtatctctcttttctagcactggacagatatcaccacggtgtcgtatctcgacacctccagttgtgttgtgcgctccacacgcgtgcgacgtcgctcctgtcaatatcacatcgaagttgagcgcccccagttgcgtagtaacatcccaacacactcatcggacaactctcgtagagccctcccacctccacacacgacagcgacgcagtctacgcggcgcatatattttctcacacaagcactcgactagctgtacaacgcccctaacgtattggttcccactcgcacgggaggtctaaaaacctcatcctcgtcgccccacccaaaacattaacaaacaaagtaactacgtcactatcccaaccacctataccgcttgtcaaccatcctctctactttactctaccctcctccacatacatcacaccatatctacagcctacccatccacccccctaactctctactaacattcttgttactcatccctttatcacactcaactgtatctacctccacaataatcacacaatcacacatacaaccctatcacctctatcactacctaacaaacctactcaacatctccacttacttcattctcctttctattagcacactcataactacaatccttacaccactctcacc

SEQ ID NO: 672674 - DNA, 316 bp, Homo sapiens
tgtagataaatgtggtgggtgagtgagcccattgtgttgtggtcaatatgtagagggagtatagggtgtgactagtatgttgagtcctgtacgtaggagagtgatatttgatcaggagaacgtggttactacgcaagagagttctcccagtaggttaatagtggggggtaaggcgaggttagcgaggcttgctagcacagtcatcaaaaagctcattcagtgggcagtcccagtttgcacagtccttgcacgaggcattcatgcatgcgactgtgagtgcgtacgtcagttggcagtcctgccaggcagtcctgga

SEQ ID NO: 672675 - DNA, 231 bp, Homo sapiens
agtgctctacaagaactcgcaggtacattaccaggctgtgattctccacgtgaaatattctattcaagggagctcaaggtcacaagaaagaaatgaaaggaacaatcagcagccctgttcacaaggtggtttgaagacttcattgctgtatttaggataaactcccctcccgcctacccccatcccaaactgcatttataattttgtgactgaggatcatttgtttgttaa

SEQ ID NO: 672676 - DNA, 551 bp, Homo sapiens
ctgatagctgtctcttgaggatacccgaattcatcagccagcagtgcctttggaacaccgcttgagccgcgcctccagattcttgtctggcatggcgtggcgtacgcagggcgttaacggtctgctcgacataatcgcgagtggtcccgtaacgcccgcaagcgctttgcaacacgtgattcagcacgatgtcgggcaagttaccggcatagctgggcaggtgccgttccagaacaaatcccaacgcctgcacctggctgccatcttcaagacggcaggtgagccagtgtggccggtaggacgggtaaggcatctcgcgctgccacagggcataaagcgaggcctccagctgatcttccggcaagcggtaggcaaacccgctgcacgagccaccgcgatccaggccaaacaccaaccccggtgtttccggcgtgccccggtgctcatgggaccacaggtacaagccgcggtgataaccatggacccgcgcccgcatgcgttgtgtcgacgaacattcaggccgccagatcagcgaaccataagcgaatagc

SEQ ID NO: 672677 - DNA, 524 bp, Homo sapiens
  misc_feature (175)..(175): n is a, c, g, or t
  misc_feature (397)..(397): n is a, c, g, or t
  misc_feature (515)..(515): n is a, c, g, or t
  misc_feature (518)..(518): n is a, c, g, or t
tgacaccaccctgggcaacatagtgaaacctgtctccagtaaaaaatttaaaaattacccaggcatggtggcacacgtctgtagtcccagctacttgggaggcagaggcgagaggatcacttgagccttgaagttcaaggctgcaatgagctgtgattttgaaactgcactccancctgggcaacagagggagatgctgtcttaaaaataaataaaagtaaatgtatttacagaatcctaattaagaaaatgacaattgcggctgggcgtggtgctcatgcctttgagagccgaggcaggcggatcactggaggtcaggagttcgagaccagcctggccaacatggtgaaaccccatctctattaaaaatacaaaaattagctgggcgtggtgcagngcctgtaatcccagctactcaggaggctgaggcaggagaatcattcgaacctgggaggtggaggttgcagtgaggctgagattgtgccaccatactccagcctgggcaacagagtgancancatctc

SEQ ID NO: 672678 - DNA, 213 bp, Homo sapiens
ggtgaaaagcccggaatccccttttggaaaactttccccccttaattttgccaaccccggcccctgaggaaggggtaggggtttttccccctggttgttcaactgaaacccccccaaggcccctcctttttggtttttgggggccccctttcctcttttgccccttccccctcggaatgttggccaaagggaataaaattggggtttttttta

SEQ ID NO: 672679 - DNA, 160 bp, Homo sapiens
aagcgcacgatggctgcgtctgtcatggtcttcacaacgccagccccggagtaagccccagcggagggggcggggactccgaaaggggtgaggggctctggtctgcgatggggccacagatggagacgacgtgcgggtctgcaccatgccacttgcagtg

SEQ ID NO: 672680 - DNA, 547 bp, Homo sapiens
  misc_feature (362)..(362): n is a, c, g, or t
ggtctcattccatcctcaaaatggaggtaccttttattattcccatttatacaaggtgaggaaactcaggctaatagaagtcaaaaacctagtaaggtggtagcagtgataatgaacagtcaacaattccggagggcttactatgggctgggcactgttctaagcactttacatgtatggattcatttaattctcacaacaacccgatgaagcaggtttctataatccccatttaacagaagaggaaatggaggcacagaagggattctacaggcggggctgggtggctcaggcctgtaaatcgcaccaatgggggaggcggaggcgggtggatcacttaagccaaggagtccaagatcagncggggcaatgggggcaaaaccccatctctaaaaaattaatattaatacagaaaattagccaagggggggggtgcatgtctgtagtcccagttaccggggaggctgaggtggaagaatcaccggagtctgggaggtcgaggttgccgtgagccgagattgcccattggcctccagcctgggtgaca

SEQ ID NO: 672681 - DNA, 111 bp, Homo sapiens
  misc_feature (83)..(83): n is a, c, g, or t
gaacagcagcgcgggcggcggcaagatggcagtacaaatatccaagaagaggaagtttctcgcttaatggcatctttaaaganaactgattgagtttctgactcgggagct

SEQ ID NO: 672682 - DNA, 171 bp, Homo sapiens
aaacccactcagctggcgtgatgttgacgaacgttttcccggggacggcgtgccagacggagggcgagtccttgtagccccagatggccgcgtcctgacaggttccgtcagccatgaggttgtcgatgtatgcgttccacccggccatggcgctgctactggtgctgctct

SEQ ID NO: 672683 - DNA, 255 bp, Homo sapiens
ttccaccgtcaccatctttcttcctactattcccatccgcccacccacctaagatatcccggatgtattatttcatttgagctcttctcaaagtatggaaaattatattcaaaagctggacagattgtataaaggcgtcagaagaagaaactgaagccatctgcattttaaaacttaacagttctgaaaggaaaacacagatgaagatcctgtaggaaatatacttgctatgattcaataaactataaaatcctc

SEQ ID NO: 672684 - DNA, 115 bp, Homo sapiens
aagcactcgtcgtttcctttacatgctcctctccatgaggctcattccgtcagtgcagggcttgcctgatgtggacgatgtggatcctcagccctgacagtgattgttccccgct

SEQ ID NO: 672685 - DNA, 110 bp, Homo sapiens
ctggagtttctgttgtatgaatatcccaatatgaatatacctgtcctagatttgataggcatatggtaatactggggttcgggctattgtgaataactctactatgaaca

SEQ ID NO: 672686 - DNA, 217 bp, Homo sapiens
caggcggtacaaccaggaggaaaaagaggtgaggcaattttagtcaatacaggctcttctccacttaattaaagtaccaacaattggacaattacaaccaagttaattcgacccgggaggggaggtagctgaaatctgtctcaaagaataatttccaaccaaatagtatttaagcttgggccaggaggggattaagaccaagagaaccggctaggcg

SEQ ID NO: 672687 - DNA, 613 bp, Homo sapiens
gggcaacagagtgagattccgtctcaaaaaaaaaaaagaaaaggaaaaaaaaattagcatttatacctcttccttgttctcaaccgccattgaaaatttctgaacactccaaatttcagttgaaataattccaaaacaaaattttataagctattaaaataatttttaccttcttatagtaatagtataccttttaaaagccctcagcggtatattaatcttctaaacaggctacaatttcagttgcagctacatttaaccaactatgtttctctagttgagaacaacttaggcctattttcactgctgttgttagcctcagtgcctaacagtgggttgccaaaataaatattcgtagaatttacccttgaatttgctacaaaaaccatttcgcttttgggctcttaaccaaattttggcccaaaaaaattttttccaaaaaagcgcccccgtggataattttcaaagttggttttaacaattttccttttttggacaaaacacttttttaactttaaacttctttaactttttctacattttctctccagattattgtgacctggccttgcgggtgtttgactttagcctacatttaagttacttccaatta

SEQ ID NO: 672688 - DNA, 231 bp, Homo sapiens
  misc_feature (180)..(181): n is a, c, g, or t
  misc_feature (183)..(183): n is a, c, g, or t
gctgcatcgcgggaggcgcatggcgggggatggcgctggcgccgggcctggaagcagatgtccttgttctactaccattacctgctggtcacggcgctctacatcctggagccctgggaaccgaccgttttcaattccagccgtggtttccattttggtattgcactcttacacaaaatnncnactttaattcccaacacaaataatgccatatattcactctactttaaa

SEQ ID NO: 672689 - DNA, 669 bp, Homo sapiens
tgcagggaggctgcgcgttgggaggaggtagcagggtaggagtcaggtgcctgggtctgggtctcatccagagacccacgggcctaggcagagcatcctggctggagatcttggaggaagggcctgttctcacgacctaagtgttcctttctcttcagctgaggatggagtggacatgtttggtaaagagatgagggtaagggttgaggtgttgaacattgggcatggaggaattccaagtatgcccagttattaataaggggctctcaaattctgttgccttttttgattgccctggaatttgacatatatagaacatggttccattcagtgagccattctctaggccttggaaatcttctaacaataaaaatccttctggccgggtgcggtggctcacgcctgtaatcctagcacttagggaggccaaggtgggcggatcacctgaggtcaggagttcaagaccagcctggccaacttggtgaaaccctgtctctactaaaaatacaaaaaattagccgggtgtggtggcgggcacctgtaatcccagctacttgggagactgaggcagaagaattgcttgaacagaggcggaggttgcagtgagctgagattgtgccactgcactccagcctgggtgacagagcgagactctttctcaaaaaaaac

SEQ ID NO: 672690 - DNA, 243 bp, Homo sapiens
  misc_feature (165)..(165): n is a, c, g, or t
  misc_feature (198)..(198): n is a, c, g, or t
  misc_feature (234)..(235): n is a, c, g, or t
aacctcgggacacatggttatctcagtgataccttgaagaagctgaagataacagctgtggacaagactgaggatagtttagaaggatgcttggatggtctgcttcaagcccgtggttcaaaataatacggaaacaagtgaaaaagtccaagcaagtggaatacnttcagctgttggcaaggtctgtggactccacangtcttcctgcaaagcgccaaaagtagctaacatcanntagcagaa

SEQ ID NO: 672691 - DNA, 1095 bp, Homo sapiens
  misc_feature (1084)..(1084): n is a, c, g, or t
  misc_feature (1095)..(1095): n is a, c, g, or t
cacctcacaacgatctaccccacctaatttaactactatgcccctcggcggcgagctttagggggcacccgctactcatacttttcgccaggccctatgcccgttctgacactacactggtgaacaccgagctggcggtaggcggcaaagcgcgctcactatagatccgcctatcctcgaacgccgcatgtcttagcacgaactccgcgcaagttgcaagccccgtacccacgctaggtggtctcggcattctccaaagtacacagcatctccgcctgccgacgcgcctccatagaattgatatactgaccttcgaagcgtcgcaacgacctttcctcttctcgaagcactgcgtccacacagcttctcgcatccgcggatcgactgacagaccaacattaatccacctgccctgataatcgaccaccccacagcctacactcacggacgctactctcataccctctcgtgcacaccgaccaccctctcacccccgcttcgttctccagcgcactctcactcactagctccgcccaccgtctgtcacaacatgaaacaatcctgcgtcttatcaccgctcccactaccctcaacgtaactttcaacgccacacccccacgtttcttcggtatcgatccacggaaatcactaacaatacgcccctgccgcccacgagcactcgacagttgatgaccctcacactcctcctctcgctcccctcgctcctccattttgctccgttttcacctgcaatattatatgtggccccccctaccctccacttccatcctttccctcgccgctcttcccctctccctctccccttcctcctcgatgtttcacctatacaacaataccctaacccaatatctcacatgccgctttctaatatgcagacgtagctagacgcccattgatcatgatatacgtgtacacatcttccacgtacacgcacgcgcatcgaccctcgctcccactcccatctcaccatctcacccatgcgctccggtcttgtatcacctacgaccgacacgagcgccagtccgcccacgcgtcaccctgttcctccgtcccacctccgccnacgcatcccgn

SEQ ID NO: 672692 - DNA, 1018 bp, Homo sapiens
tgctttctgcacaaatggtagcccactgcaagctgtgccaactcacgagagcacagtgacattacattgcactcaaaattcaagaagtatgtctggtgcagcaacaggacattcgcactatcaattcacttgcaacatgctctcagcctaactgctcaacactgtctaagccaacagcactctgcagctcttcctggtcgaccattggcaccgccaccgcagctgcatcacgctctgctccgcgccagccagaaagagcataccgtcagtctggacatatttatagatctcacgagcgccaggacaccacccaattgggaccaacaggagacagtctcagcaagttaactatactgtgggcacagcctttaagcattccatctcgttatagttcaccaattctaaatacgcaacaagggcaggcggaaacaaatatctccaaaggacctaaaagctcaactggtgccagaggaacgcaagtgccaccccgttgtgaccacaggcctgcatgggggacaacactcgagcacaccacacttgtcggggaacacttggggcgctctcggcgacaaacaaccccctggagatgacgcacttccacgcggccttgctgcccttaccaagagactcacttaccacacattcaaggagctgcacgaccaccaaggcgcgtggcgcaccccccgcgccggggacactctgcccacttgcggaacacacaaagtatgaaaatcccacaatttctagcacaactaggcggcgcatcaacagacgtcgaggacgaaggcacccttgaaaccgttcgcgagttcacaaaaccagcaccactggcacagttattcctattctagccttcgcctttcttcaatttggacaagttggacacgtctccagaaacatactagcacgtattcatccacacaatcggggacaaacttgctcatacacacatacaactagctgctcaaccacttctcacagaacaagacggactacacccctagttcacccgttatca

SEQ ID NO: 672693 - DNA, 690 bp, Homo sapiens
  misc_feature (1)..(1): n is a, c, g, or t
  misc_feature (208)..(208): n is a, c, g, or t
  misc_feature (235)..(235): n is a, c, g, or t
ngagagtcgtcatctcaaccatatccatgccacggtgctacggctggggagcctgctgagttgagatggatattcagtgcgcttttccctccattccctgaagtccttcatatctgccatcttcatcatattctgcactgaagtcacggtgtgcacatgttcctttagtcttagaggctatcgtaccatcttcgattctgtgtgatcncagacagtttagttcatattctagtancttacggttgagctgcatgtgcaatcatgtactgtttcaacataatctgctctgtatttcaacctgtcactgcaagtggcattatacacggtagagtctacctcaaagcgtacagtcagtgcttgaaagtaaggaatcacaattccagcaggtgcagagagcttaatgtaggcactcgcaatggtctgctcaggctcgatgatggtgggcaacgcaaagtctgcgatcgtgttggctactgcatttagatccgtatcatcaatgccatctgaaacgctgtttgtaagcgtgaactgggactcagttagctaagattcaggcacggttatctcaaactagggaatcaaggagtcttctggttgagaatattcttgttagcacatcatcttcacgtaatgttacctcggctagtgttggtaggctgagggcaaatcattaagttcccagcctcttat

SEQ ID NO: 672694 - DNA, 674 bp, Homo sapiens
ggacgcgtgggcggacgcgtgaggtgcgagagttcaagcgtgatccctggacttgaataatatgtgtgacaaactgatttggaggaagcattcagcatctgcccttgtcctccatggtcacaaccagaactgtgactgtagcccggacatcaccttgaagatacatgtttttgaggcttcttcagagcttcagctgacctatccacgatggaacaatgtagcttgtatacgtcaagcaaacccaggatgcctgagatggaactacatcgtgcacgatcgtcgtctacaatgtgccacacatacccctgatggtgcgaatgccttgtccgtccaatgcacctgaacagtggagtattaggttgttgtagcattggcgcacacgcatgggtgccttcattcaactctggtactgccggcgaggtcatgcacagaaggagccagccagagtcggtctattccaggtcttccgcgccaatgcatctggtgctgctggcagaggtttccctcccgaggggaaccaacctcctatgcagaccagatgtcctgctgaagcgaggcctcttggagcacatcctttactgcattgtggacagcgagtgtaagtcaagggatgtgctccagagttactttgcactcctgggggagctgatgaagttcaacgttgatgcattcaa

SEQ ID NO: 672695 - DNA, 227 bp, Homo sapiens
ctaccaccgccacgcaccccccccgcccacccccttcagtgcccctttaggagcatgattacgattccgcagcgtatctactaacagcgttataccatgagtcttggaatactgaagaatgggaaaaaagtaaggctgcagcagacatcgcaagagtatatatcgggaaaatagctcatcagaaacaaatatcccgcaacgccttctacacatcaaacccgcctgcc

SEQ ID NO: 672696 - DNA, 897 bp, Homo sapiens
gtggtggctcacgcctgtaatcccagcactttgggaggctgaggcaggcataacacctgaggtcgggagttcaagactagcctgaccaacatggagaaaccctgtctctactaaaaatacaaaaaattagctgggcgtggtggtgcactcctgtaatcccagctactcgggaggctgaggcgggagaatcacttgaacccgggaggtgaaggttgcggtgagccgagatcacaccatcgcactccagcctgggcaacaagagcaaaactccatctcaacaccccccaccaaaaaaaaaaaaaaaaaaaaacttgggaggtgtttcccctttcataataaatcctaaaggtaacaaaaggcggatgcagttttccaagagaaggtacctttatgggaaaccaagtttcgggaggggtacattaggtattaagacctctttcacagtaggaggtatacctaatattataggtatctggttcccaagaagaaacaacaagaacaaaaaaaagaaaaaaaactgtgccgggccggccaagtgagcccccgacaaaaaagagctccgtgaaaaacacacatgtcttgtgggggagccgcgcgggccacccccacaaaaagagtcaagatacggaaccaacggcgtgcgcagaaagagcgacggactccaccaggaagaaaactacgggggaccgagaaagacacgcggcgggggggaggtattcccacccaccgatgaatgaaaaaagggacgccggcgtgggaaagaagagaacgagtcttgtcgagaacaaacacccccccgagaagggagcaggcgccagggaggcacaacgagggggtatcatctaacacggggagatcccacgacgagaagcccgaagatttaaatagttgccccaa

SEQ ID NO: 672697 - DNA, 435 bp, Homo sapiens
  misc_feature (45)..(45): n is a, c, g, or t
  misc_feature (54)..(54): n is a, c, g, or t
  misc_feature (264)..(264): n is a, c, g, or t
  misc_feature (282)..(282): n is a, c, g, or t
  misc_feature (315)..(315): n is a, c, g, or t
  misc_feature (327)..(327): n is a, c, g, or t
ctaaattcgcggccgcgtcgacctgtggacccaacgcctgcatcnaaccttcanccacgatctgatgggacttcatccctcacctatccaaacacagcaaagacacggggcactaaaaacagctttcagcaaaatactaggggtgatctcctgcccaggactcttctctgcacacacactgctgatgccaggggaaaagctcatcactgcccttcctggggatggggtggctgcagggcctgcaacatacaaagattacgcggngcctctgctctttaaatnccctgaaatatatggatggaatgagtgagaaanatggctgctcangtccatctggtagttatgttgcttacaagagtaatcattatgtgataccacttcccgttcttattgtaacaggcttattaggacactattagtcaaggggagacagag

SEQ ID NO: 672698 - DNA, 730 bp, Homo sapiens
ctctcgttctctgcgtgacgacccccctcccctcctcgatattcatcttcctcccgcacgcagaattagatcagggcgagcggggcaggaggatggagaacagcagcggccgggaggtgcttccgaacggaggaggagccggggggatgggcaacggcgcggcgaacgggagggcggtgcaggcgctgcagcggagcttcgccgaggtgcaggcgatcctggagaagaaccggattctgatccaggagatcacccagaaccaggagtcgctcgaggccggtggcctcagccgcaacgtcgccctcatccgcgagctcaacagcaacatagcccgcgtcgtcgacctctacaacgccctctcctgctccttctccagctccctcaccaacggctccgcccccgctgcctccgacgcctccaagggggcctacaagaggccgcgccctgcccagtagaagagacagaccgtcagcgccatcttctcctctgttcagatttagatttctgctgtggccatccatggccagggctcagcggcaggcagatttgagacttccttttttctttttcttcgttttcttctttgttttagcgttgagctgagagatatggacatggtcagcttgttgtcagagatgaaacaaagatgcaggcagcagtgtgtggctgtatcagtatgtatctgtgtggcgtgtgtgttgacaaacagcaaaaaataacaacaacaggg

SEQ ID NO: 672699 - DNA, 473 bp, Homo sapiens
cagagtgagaccctatctctacgaaaaaaacagagagaagctagcagaaataaggagtgaattgatgctggaagtcaagtgtgttagtctgttttgtgttgctataaaggaatacctgagactgaataattgataaaagaggtttatttggcccacagttgtgcagactgtacaagcatggtaccagcatctcctcggcttctggtgaggcctcaggaagcttttactcacggtggaaggcaaagggggagcaggcattttacatggcaagagagatgccaggctcttttacacaaccagctctcatgtgaactgacagagggagaactcaagcatcatcccaaggggatggcaccaagccattcatgagggattcatctcctgtgacccaaacacctccccttaggccccacctccaacactggggaatcacatttcaacatgagatttgaaggggacaaatatccaaactg

SEQ ID NO: 672700 - DNA, 226 bp, Homo sapiens
tgactcttagagatcccccgcggttatgttacgctggtcccagtattccctaatgcactggggtcttttttgaatgtgtcaccagagcaatgaagaacattttgagagattacactaaataactgttgagagtcagagacagtttttgtaggatcactactctaaagcagaatgctgttttagatttccacttctgacatttgatttcgtaagacataaccgcggt

SEQ ID NO: 672701 - DNA, 987 bp, Homo sapiens
  misc_feature (47)..(47): n is a, c, g, or t
cccatccctcatccaccaaaaacagaaacacgtccttttgtaactanacagcaaggctcgcgggcaggacttctgtctgaggaaaatgaatccacagctctacctcaggttctagcccagccttctactagtcgaaagcggccccgtgaaggggaagcctagggtgccgacaccacaaaacgcccagctgtgcgcgctgatgcgctgcgaactccgtggctagaacacccaaacacacgtaccttactttcattatgacatcttttttttctttgagactgctgttttatagcaagtaccaaatcattgcactaaccgctcccccacacaccactgtgcccccctcaccacctcctcacccctgtactaacatacccgcccgcggtcccctcctccatatctcccacacatcccccacaccccccacccccttacccttactttcttctctctccctctagtcgctccattcctctccccctctcctccccacacactccccgacctacccaacaccccaaaaccagtcatagcaccaacacaacacatcaactcacatacactctcctctcctcccctcttcgccccactcaatctgcaacgtaccccataccgcacccaaactctcatcccctccacacctactaccagatctacttttaccactcacctctcccccaccctcacatcccgcacacccctccccatatatcctcacctctctcatcccacctctactattctcctccatcatacccaactcaccttaaatcccgtggtcgtttcccatttcacatataccactctatcccctatctacaaccatcccacatttcaaatccctaatataattccgtgtttcctcccctccctttctatattatcttttcccgctcttgtctctccccccaccgtcacatgatattgtaattcacccctccacatgctccacatcccacacaccataactcctagcccgatcacatg

SEQ ID NO: 672702 - DNA, 374 bp, Homo sapiens
gtactgtcgtgcatatatctgctggcaccaggaaagctgaaggctgctgagaccctggaggaatgtgccctgcggtccggagacagggcactgaccctatcatgccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgccagaggagtggctctcttggcaagatccgggatgtgctccgaaaaagcagtgaactcttggtgaggaagctccaggggactgagcctcggccccccagcagcaacatgaagcgagcagcctccttta

SEQ ID NO: 672703 - DNA, 208 bp, Homo sapiens
cacgagggcgctcggcaaggtatgttggcggcctgctctccgacagaacttttcttcttgggttgaggaaaacgccttttggagtcaggccctggaggggcgagccttgctcacagggtggggatacagccgattacccgccctgtgctttccgatggcttctgcggggcgagcggggcctggccggggggtgcgggcgggagggcaa

SEQ ID NO: 672704 - DNA, 282 bp, Homo sapiens
tgcccattgagaattatgtccctgtgcatgctgctagcgggtcccaccgtgccaggtcagccggggctctacaggcctgtgttggcctttggacttagaaggggaaacagctcatggaccatgcagctcgggcacagaagatgtgttctggtctgtgtccacgacgtcccttctgggcattcaaccccctgcgccctaagttgctggtgactcagcgccggcctgacccttgagcccgcaggtggtagtccagtggcatctgcagcctggcgatttgccaat

SEQ ID NO: 672705 - DNA, 194 bp, Homo sapiens
gatgtccacaccccagattacaaaatcagaactacattttaacaagatccgcagatattcatacgcacagtcaagcttaaggagcatctgctgtaagcccaacgtggacctcttcagcttcagtacggtgcccttttctactccgttagcctgaattctagcccctggggggggggggtgggggaatgtgcaag

SEQ ID NO: 672706 - DNA, 87 bp, Homo sapiens
  misc_feature (39)..(39): n is a, c, g, or t
aggttcttccccctgggtggtggtggggaagatggaaanggtggggcaatatacagagaggatacccgaacagaagaccccaccttt

SEQ ID NO: 672707 - DNA, 175 bp, Homo sapiens
aacaccgaaccaatattaagcactgctattacaatttactgggtctctatttacctcctacaggcctcagagtacttcgggtctcccttcaccatttccgacggcatctacggcttcacaatttttgtggccacagctttcccacggacttccaggcattattggctaacttttc

SEQ ID NO: 672708 - DNA, 160 bp, Homo sapiens
ttcctggccctcgagttcatggaacggtataactggaaccgacgcttacggagcaagggtatgcgagagcggttcttcctggccctcgggttcgtggaacggtataactggaaccgacgcttacggagcaagggtatgcgagagcggttcttcctggccc

SEQ ID NO: 672709 - DNA, 164 bp, Homo sapiens
atacactggagagctatttcatttggttctactctgatctttattatttctttccttctactaatttgaggttggtttgttcttgcttttctagttccttgaggtgcatcattagattaagtatttgaaatctttctacctttttgatgcagattttttttttt

SEQ ID NO: 672710 - DNA, 505 bp, Homo sapiens
ttggatgcgaagctgtcaagacgacccgaggagactgttccatcccactgggggctgattcccaatgtgcggagtcgcgctccaaatcaccgagcccggcctgatctcagctagaccgtaaggatctctcagagagcataggctagtgtggaatgagacttccaaaactgacagatgtcatccgagccgggcctggggctcctttctccagccagcaatgatgtgcagaagaattatgcaggatttaacggatccaggattttatcaaaagcaagattgtggctcaaatctattcatgacaagcaacaggtataataaattgttttatgtactgattatgttatatttatactcatcctgaatctcctgtgcccacatcccaggcttcaccctgagtggttccatgtctaggggtggagactaagccctgtcgagagacttgccttcttcacccagttaatctgtagggctggacctatgtcctaaggacactttgcatccagag

SEQ ID NO: 672711 - DNA, 298 bp, Homo sapiens
atctaaacaaactggctcctgtttaatgctcagttaggggcctttgctcccctggttaagtggcccaatgggccaaaaattcttgggcaaaattttgggcaaagccccccaaatttgaaaaaagggggggggggggggtctcacacccggggaaaaaaatttggggggggggtttttgggggggggaaaaaaaacccccccttttttaaaaaacccccccccccccccccccaaaacaaaaaattaatttttttcccccaccacaaggggggggggaaaaaaaatttctcaaaaagtg

SEQ ID NO: 672712 - DNA, 613 bp, Homo sapiens
gaggggcacacactccggtccaggtaggaacctgcagatgctgccgcctgagtcaccagtgagggcaagctcgtgctttgcacagaccccccaacccccgtgaagccagaacagaaatgtcactcgtgggaaccctcctcccccactgcagggagagctggagtagcaccgtagcattgagaaagaacgacacacagaagggctcctcacatccgggggcccagtcctgaccttggtttaaaacggggggacgtatacatcacatctcaggttcctgcgtcagagactcatggtgtgaagacccttagcatcaaaatctaagccctgtcctcctccactttgggctgtggctcatggaccaacaagaggacctgcccggagcctctgtagtccacagctccgcgggcggctcctccccgcgacacccagtcccatgtcccagtggcctagccccacttcagcagccacacagcccagtacagtcacctccagggcccagacgcatgccagtgtggctgccacggactgcatgggcacacttgccaggggtcctaccctgcagtttctggaaaccctcccatagtacctggcgactgactatgcacctgcagac

SEQ ID NO: 672713 - DNA, 235 bp, Homo sapiens
tcctgggttcactctggagcaggcttcctcccttactgcaggattgaatgaggtctaactagaagggggtctcctgtaacccttccctgggcttctcttagtaagaacagtttttgcatcatggaaacgaaaggcaagcaacatgtgatgcagtcaccattgcatctccaagcatctcagtataccaggtttgtaccccagtgttgcactccacaatgttactcattccttccaa

SEQ ID NO: 672714 - DNA, 954 bp, Homo sapiens
  misc_feature (332)..(332): n is a, c, g, or t
agcgggcttttgtgctcccagctctagcgaaaagccgccggtatttctccatctggctctcctctacctccaggcaggctcacccgagatccccgccccgaaccccccctgcacactcggcccagcgctgttgcccccggagcggacgttctgcagctattctgagcacacctgacgtcggctgagggagcgggacagaggtcagccggcagaaggaggcaggccccgcgcggggatctcggaagccctgcaggtagcatcatgaagttccagtacaaggaggaccatccctttgagtatcggaacaaaggacaggcgaaaagatccggaangaaatatccggacagggtcccgcggatgtagagaaggctccaaaaggccaggatgctgatctggacaaagaggaagtacctagttgccctctgaccttactgtggccagtctatcttaatccggaagagaatccacctgagacctgaggacgccctcattcttcttgtcaaacaaccaaccataccctcccaacagtgcataacatggggccaactgtatgaggaccaatcatgaggaagaatattccatgtcatgtggcctacaggatgacgagggtctattgcgacactgagggtctgcaccccagcagagggagcaccatgactgcgcgacggaggggtgttgatgccgacaggcgaaacacggtggcacccaccgcaggggaccacggcggcgacctaaagacatagaccaactcacgcaaactacacatggccacgccactccgggatacccgccctggacaaagatcagacagtgaatgattcaaaaccgcccaaacgaacaacgggcaacggaagagcaagaacagcggacaaaacaaacacacaagacacaggcacgccagtactacacctaaaacacaccaccacaacacccgcactctcttcctcctctcca

SEQ ID NO: 672715 - DNA, 469 bp, Homo sapiens
  misc_feature (188)..(188): n is a, c, g, or t
  misc_feature (203)..(203): n is a, c, g, or t
  misc_feature (337)..(337): n is a, c, g, or t
  misc_feature (411)..(411): n is a, c, g, or t
agtatctatcggatccacacaaatccttagaaaggttttctgtgtagtcttcactaacgcaagtccttgggaatgtttcacttttactgtaggatcttgaacacatttcacaataatgaaactataaagtttttatgcagtgcattcgttattaactataaataacatttcgtattaaaaaagaaatnctgggtaagtacagntttcttccttatgtagtaagaagccgaagaagactgaagaatgttgattttggaccactaccccatcacataccatcatcacagtctccagaacatcatctttgcaaaacaaactatcgtgtacccattaagcngagataatgtaactaccccatattcctttctccacaccaagtcactaagtaactagatattccactgttgtttnttataaagttggacttctcctaaaaacttgcatataaatggaatcatgcgatgtaaaa

SEQ ID NO: 672716 - DNA, 123 bp, Homo sapiens
gagttcaaggcttgcagtgagcccaggatagtgcacacggggctgaagcaaagagcaagagcctgtttcagaaaaaacaactctgggactggagtgctttagacagatggggagaccaagaat

SEQ ID NO: 672717 - DNA, 99 bp, Homo sapiens
tcccccatcgggaaattttcataaaaagcagcatttagaaagaacaaaaatctgaaaaagcctttcggaggataaagaatccggaagtgttcgcaaaaa

SEQ ID NO: 672718 - DNA, 126 bp, Homo sapiens
  misc_feature (49)..(49): n is a, c, g, or t
  misc_feature (115)..(115): n is a, c, g, or t
  misc_feature (122)..(122): n is a, c, g, or t
ttttttttggggggggcagttttaagttattagtttttaaaaacaggcntttttaatgggaacaacttggccaaaaatttgtcccagaattttgaggccccttaaaaaggtgttnttggggnaaga

SEQ ID NO: 672719 - DNA, 400 bp, Homo sapiens
  misc_feature (141)..(141): n is a, c, g, or t
  misc_feature (320)..(320): n is a, c, g, or t
  misc_feature (335)..(335): n is a, c, g, or t
  misc_feature (382)..(382): n is a, c, g, or t
gaggactgggtcctttcacatccgggggggggaagtggttatataccaggtgcagctgcggccccttgagcacgtggatgggacgcacgtgtgacagctgccgggggcccagaagggaaacatccatctgaacaccttccntctccgacggtctcaagatgggcgcggatatcatctgtgatgtgtacacctgcgatctacaaaaagaggtgcggacagctcgctggagctacaacggagtacttcgtgtgcggacagtgtgtgtagcagagaggggtggtgtggacagacctagatctgctccaccctctctctgaatnaacatacaaccctcncctgcggggagggggaagacaagccgttctccccgccgtggggagtnccagtgcggatacttttt

SEQ ID NO: 672720 - DNA, 144 bp, Homo sapiens
taaatgttgtatctgtaatgtttgtatgcttatttaaagttttattcttgatttctttgtaaaacatccattgcactgaggccatatcattccttattacagccctacatcttgccttgtttatcccttagacaaagggaaaca

SEQ ID NO: 672721 - DNA, 342 bp, Homo sapiens
cacggtggctcacacctgtaatcccaacactttgggaggctgaggcaggtggatcacctgaggtcgggagtttgagaccagcctggtcaacatggtgaaaccccatctctactaaaaaatacaaaaaattaggcaggtatgatggtgcatgcctgtagtatcagctacttgggaggctggggcaggagaattgcttgaacccaggaggcagaggttgcagtgagccaagatcgtgccactgaactccagcccgggtgacagagtgagactccatctcgaaggaaaggccgaagtaggtgggtgtcccttcccaggagtttgattttttattattttgttttt

SEQ ID NO: 672722 - DNA, 866 bp, Homo sapiens
taatgtgtcttagattgagcaactatcctaggtgtgtagtcaatgtgataagactaaaattttgcttatagggatagttcacatccagtagagcttctagcttggaagacattcttagccttgttatttggaatgtatgtgtgtgtgtgtgcatgtgtgggaagacaagaagaaatacgagctctagagtagtggcctcagattgatttatattaggtgtgccagtctttcccctacctccctagatatttcaaaacttcggtgtggacaagtgacattcattttcataacctttatattgtcctgtgccaccagaaacgcaaaagcagcttagtgttgattctaatgaagtagcacaaatgttaaatacataacaaaacagatgtcctgtcacctagaacaaattagtgatgttgagtaattagggttggcatgtgtatatagaaaggctattgggcaaacagtggttcagtcgtgtactgggcacaggtgaattctgccctgcgattgccatctttagcacttgtcagagaatgggttgccatttatgacactgatcttcagacacactgtgtagtgcctgggcttaaactgtcagactggcaacaggtgaagctgccatcatagacacgtccttgacgatatgggtcaggtggacttgtcaacctttggggctcgtatttttgaaatgtcctcggaatcactcttgaaccgcgtcggggggccccataataaagagggcgacccgcattggggggacactaaccagaatttttaggcccacataaaagacgcaagggcgccgcaaaaaggggggcacacaaccacgggtttaattcccacacacagcacggggaagaaacatc

SEQ ID NO: 672723 - DNA, 124 bp, Homo sapiens
atacgttggggggtagactagtatacacagtgcataccgccaaaagataaaatttgaaatctggtaaggctggtgtaagggttcttagtaaataggggtaaggcagagatgtgtttaagtgctg

SEQ ID NO: 672724 - DNA, 362 bp, Homo sapiens
agtatatactagaatacatggtcaggggctgggctcagtggcttccaactgtaatcccagcactttgggacaccaaggtggctggatcacctgaggtcaggagttttgagaccagcctggtcaacatggtgaaaccccaactctactaaagatacaaaagtagccgggtgtggtggcacatgcctgtagtcccagctactcgggagtttgagacaggagaatcacttgaacccaggaggcggaggctgcaataagctgagagcttgccactgcactccagcctgggcaaaacagagcaagactccgtctcaaaaaaagaagaaatacatattcgatctttgctccacagttcctgacacaga

SEQ ID NO: 672725 - DNA, 321 bp, Homo sapiens
  misc_feature (176)..(176): n is a, c, g, or t
  misc_feature (190)..(192): n is a, c, g, or t
  misc_feature (304)..(304): n is a, c, g, or t
gtgtgtcgagtaagagaacactaaaatttaagtggagtatcatagctttcaccttgggaagacgaaaaacaacaaacatacaaaacaaaatgacccagaatattccagagtttccaaaaatccaactgctaattttggcagggtgagaagaaggggatatttaacgtgatacctcnttcatataacctcnnnactttctccttgacatttcactggtataaacaagagctcccaggtctacttgagaaaaagcgatcagtccgtgctaaatatacaggcctcatgacgtcttccaagtgccctntactctgtacacacggt

SEQ ID NO: 672726 - DNA, 121 bp, Homo sapiens
ggacagcaggggactcggcgtactcctctgtgctgtccacctcctctgtgcggtccacctcctcggtgctgtccaatgctgtccacctcctctgtgctgtccacctcctctgtgctgtcca

SEQ ID NO: 672727 - DNA, 468 bp, Homo sapiens
  misc_feature (214)..(214): n is a, c, g, or t
  misc_feature (219)..(219): n is a, c, g, or t
  misc_feature (221)..(221): n is a, c, g, or t
  misc_feature (230)..(230): n is a, c, g, or t
  misc_feature (249)..(249): n is a, c, g, or t
  misc_feature (337)..(337): n is a, c, g, or t
  misc_feature (346)..(346): n is a, c, g, or t
  misc_feature (408)..(408): n is a, c, g, or t
  misc_feature (425)..(425): n is a, c, g, or t
ggttcgcatcgcacgcggatttcaggtcggaaagtgttgggcaaggagccagacgctgtctctcggggctcggggaacagaccctgggctaccgcccaggtgagaacgtgaaggggatgaagagctcccgcggcgaggattattggatccggttgctgactgcgcgcagtaaacacttcttaaagatggagcgcttaacgggagggtgtgcgtntgtgntnccgggttgntaccttgcacacacccagntatgcccgcatgatcatgtctctgaggtgaggagacaggttgacttttccggtgtgcctgtctgatccgacggcttgggctcattgtncactgtgtnttggaagtgtctgattgtagggtggcatgtttggggttgttccttttaggccgcagaacttntgtctaacttctaacgncagacctgctttaaaaacaacacttttttttgggggggggtgc

SEQ ID NO: 672728 - DNA, 251 bp, Homo sapiens
  misc_feature (2)..(2): n is a, c, g, or t
anttgcggcacagattcaaagccacatatttcatactcgttaaagcggttagaataaaaaagacagacaataacaagtattggcaaggatgtggagaaaacgaaaccctcatatgttgctaatggaaatgaaaatgttgcaacctctttgggaaacaatttagcagtttctcaaaagttaaatatagtgctaccatatgagtcagccattctactcctagaggggtaccccaaagaattgggaaagtgttt

SEQ ID NO: 672729 - DNA, 1176 bp, Homo sapiens
ccgcggcgtcgggtttgggctggaggtcgccatggggcgaggcagcggcaccttcgagcgtctcctagggttttcaaggagacttcaagtgagacaccttccttgccaagggaaccagcaagcagactgagctatctcagccacacagacaaggcgaccagccagctcctgttggagacagattgggagtccattttgcacgatctgcgacctgcatcccgcccaaggggacacacaaagcaaaatatgctgtgaattccatcaacgcaacgaacagtcaacgacaagaacccacacgctcgccttgtatggccctgcgcaggtcactggcaactcctgctgcgctacaacgcaacctgtgcgccacgcacacgcttcactgcatgcagcgctggccaacaaagcaccaccattgggcaggcacgcctgcaacggacccctgccatcgaaggagcacaacgctggcgcgctacaaccgctccgctaacacacgatccgtgctagccttgatccagcgcctggcgccgccatgcctctccggaaacgagcaacaaagctaccaacggctggctccagcgacacgctaccacactccactcgccaacggctggagtgcggtctacgctctcacccagcaacttcaacagcagcagccgcactgcacatgtgtgtgctgcgcgagcaggagcccccagacaactgggctggcaccgctgcagcgaaactgccaccgcatgccagggcagccaccaccgcgcggcctgactgcacccgctaagcaccaactgcccggcacgctctgggcacgcactacttccctgctgggcacaggccgctcctctcccaaacgcaaccatcacaaacaactccccaagctcaggccactcaaagcaacaggacctgctgccgcgttgctcgctgaccccccctgcacaaccacaccagcctgcgacaccgcgaaaccgcgaccccacacccaccccacctaccaccaacctcgatcctttgtcctctcttttttaccctttccttctgcctcctagtcttcccccaacccccacacaacccatcacaccacacccccacacatttactcgcttttcccgacactctccccactaccacacccactcccaccacacccacaaccccacacgccaaacccactttcaccaa

SEQ ID NO: 672730 - DNA, 522 bp, Homo sapiens
  misc_feature (214)..(214): n is a, c, g, or t
  misc_feature (219)..(219): n is a, c, g, or t
  misc_feature (221)..(221): n is a, c, g, or t
  misc_feature (230)..(230): n is a, c, g, or t
  misc_feature (249)..(249): n is a, c, g, or t
  misc_feature (391)..(391): n is a, c, g, or t
  misc_feature (400)..(400): n is a, c, g, or t
  misc_feature (462)..(462): n is a, c, g, or t
  misc_feature (479)..(479): n is a, c, g, or t
ggttcgcatcgcacgcggatttcaggtcggaaagtgttgggcaaggagccagacgctgtctctcggggctcggggaacagaccctgggctaccgcccaggtgagaacgtgaaggggatgaagagctcccgcggcgaggattattggatccggttgctgactgcgcgcagtaaacacttcttaaagatggagcgcttaacgggagggtgtgcgtntgtgntnccgggttgntaccttgcacacacccagntatgcccgcatgaaaaacctttactccccgccgccggccaccgctgcccgggccacacaccttaaactcatgtctctgaggtgaggagacaggttgacttttccggtgtgcctgtctgatccgacggcttgggctcattgtncactgtgtnttggaagtgtctgattgtagggtggcatgtttggggttgttccttttaggccgcagaacttntgtctaacttctaacgncagacctgctttaaaaacaacacttttttttgggggggggtgc

SEQ ID NO: 672731 - DNA, 858 bp, Homo sapiens
  misc_feature (73)..(73): n is a, c, g, or t
  misc_feature (79)..(79): n is a, c, g, or t
  misc_feature (84)..(84): n is a, c, g, or t
  misc_feature (98)..(98): n is a, c, g, or t
  misc_feature (112)..(112): n is a, c, g, or t
  misc_feature (115)..(115): n is a, c, g, or t
  misc_feature (126)..(127): n is a, c, g, or t
  misc_feature (164)..(164): n is a, c, g, or t
  misc_feature (166)..(166): n is a, c, g, or t
  misc_feature (197)..(197): n is a, c, g, or t
  misc_feature (222)..(222): n is a, c, g, or t
  misc_feature (235)..(235): n is a, c, g, or t
  misc_feature (250)..(250): n is a, c, g, or t
  misc_feature (265)..(265): n is a, c, g, or t
  misc_feature (294)..(294): n is a, c, g, or t
  misc_feature (309)..(309): n is a, c, g, or t
  misc_feature (311)..(311): n is a, c, g, or t
  misc_feature (315)..(315): n is a, c, g, or t
  misc_feature (323)..(323): n is a, c, g, or t
  misc_feature (338)..(338): n is a, c, g, or t
  misc_feature (367)..(367): n is a, c, g, or t
  misc_feature (369)..(369): n is a, c, g, or t
  misc_feature (381)..(381): n is a, c, g, or t
ggcaggtcgccccggcaacagccggctccctcgcgtccccactccccctctgtctctccaaggaaaactaggnccctgngcggncaagcccaggatcncgcaagctgcgcgnccnaagagtttcanngcccatttggactttcacaatcagagatggcagcggnanaggcatcaacatcgaagagctaccaggcgcntggtattctcatccggtatatgcangatagtggcaacntgatcatcaagcaanggcttggatgctagnagccatcacgatgcctacaggaaggccgnggaatcctgttcaantnttcnatggtagntaccttctgcgcttnttccccaaagctcttacgataatgaggcngngtatcctcagtncttctatgaccatcatgtggccgtggcaggacgtaccgcctgcgaggatcgtgtcacattttcacgaagatcctgggtcagcagtccacggttacagcagtaggatcctaggcatgccacgaaaagaagaccaggctgtgtgtccaaagaggaagagatggcagactgggtcagatgcagaggtagaatgtgacctgagcaatgactggaaatcagctgaagagctccgcgaggtacttgcagagacgagaggcataggagacgaacgagggggaaacaagaagatggaagacgagcgcccggacaggtatggaacgctgacacgacctgtgactgagacaccagcggcgggaaaagcccactgaaagcctggtgacggggccgcgaatgaggtggccaggaagggcgcgcaacccaccgagccgggcacgactggaaagctgggccacacaggtggcggccctgaagagcagacgg

SEQ ID NO: 672732 - DNA, 155 bp, Homo sapiens
cgtaccatggcgcgcaatgcacgtcggatcattcgcgagccggagtgcgtttgccggctatatcccgtactcgacgcatgtgaccgaccacgtcatcaagacgcgagaaggcgactacctgcaaatctggaagatcgccggcattgcgttcgagg

SEQ ID NO: 672733 - DNA, 182 bp, Homo sapiens
atgcactgcccacccaacattctcgcaggctttgtgtcacaggcagcagggtggtgtgcagccagcgctgtgtgcaagctcccagcactctcgtggtcctcacatgtggccccattgcatttttcatttccaatcactgtatgcatggcacagcgtcgcgccatggaggcatcctctcagca

SEQ ID NO: 672734 - DNA, 505 bp, Homo sapiens
gaacggccggcctgcgactacctatcacatagcatagctgacagctgcattctcacccgtgcagaatagagtctaaacgtagtgcttaacagctcaagctaaagtagagataaacagatatgtgaaaaataaacttagccaaatactcatgtagaggataaaaaaaagcgatagtcccagataagtcaatagtgacactaaagatactaaacaattttaaatataacctatttaagttaaacatcacattattcagccacccaagcaaatcatacggcaactgtccactcatattgctatcatataaacggtaactattgaatctaccatagcccacatttaaaggccggacaggaaaaaacttcaacagccaggaacttatccccgaaagttcccaattatagtacatccttacaccttaggaccagtaaccgtatacaaaaatttggacttttcgggggataatttctaggacggtaccggaggctcgaaatatccgaaatca

SEQ ID NO: 672735 - DNA, 414 bp, Homo sapiens
tgattacactgtatgaagctgttcttgctgaagctctgtttgttctacttggtgagtgtgatagaaaagtctggttataactgtgctggtactgattttgctgtataaagtttctggttcatttacaggaggaactgcggcattcatattgaacaccgtttgcatggatttggattggagctgcatttacatttgattccacttggtaaggccaaaatcagttgccacggcccgccaaagctttcttccgggcggcacagcttctccgggcggcacaggttctccgggcggtcacagattctcgggcggcacaggttctcgagcagtctccaaacatattttacattcgaaggtcgcggccgcccgccaaatcgtgccacagattctccgggcgccacagcttctcgggcgcgt

SEQ ID NO: 672736 - DNA, 296 bp, Homo sapiens
tacatagtaaactgaaaccttaactgcatgagtacacagactaacctactcttgcgccgaacactgagttttcactaattaatggtggcccactgttcaaaccatgttcaaataaggcaaaagcgagctgtaaccaaaccatggtttttgtcaccccactaagttttccataggtcccccgccctttttcgtcaattcatcttccatcatgtggctgtttctttgagcccacttggattcgggaggctgcctgattcgtgaatcattctttgcccaattaaacccccttaaattta

SEQ ID NO: 672737 - DNA, 105 bp, Homo sapiens
atagttaccccgatactccttacactattcctcatcacccaactgaagagctgattgaaacacgaagcgtagcacgctcacgctcctcacagagccatgagagct

SEQ ID NO: 672738 - DNA, 476 bp, Homo sapiens
  misc_feature (1)..(1): n is a, c, g, or t
ntgacgatcccttattagtagaaatattgaaaaagcagataaaatatacacattgggtacagtgtacacggcttggatgatggttgcaccagaatcttagaaatcaccactaaaggacgtattcatgtaaccaaatactacccattccccaaaacctattgaagtaaaaaatgacataaaaaaggaaaaaaagaaaacagaaaccacccaaaagaaagaaagaaagaacgaatgaacaaaagaaagaaagaacgaatgaacaaaggaaagaaagaaagagaaagaaagaaagaattatttgtggtattctggaaataaaagtagtgagggatttttacgaataaggtaccagaaggatagacctaaggtctctaggaccttttctacctggacagatgcttacacatttcattatataatatttaaatatcatgttcgttaatatcactatgggtctcgttgaaaaaaatgttaaa

SEQ ID NO: 672739 - DNA, 157 bp, Homo sapiens
cacaacagtcaggcattttgtctttctcttgttcacggtgaggaggacagtagtactgaacggatcgcttcgtcaaacactgtcttgaggcctcgctgtgtgagcgccgagtactccaggtattttacagcatcaatctccttagccatggctatac

SEQ ID NO: 672740 - DNA, 985 bp, Homo sapiens
gaggagcggatgacgtcgtctgggacaaggcggtggctactggcaaaatggatgagagagcggagtttgtcgctgtcaccagcaccaatgcagccaagatctttaacctgtacccaatgaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccaggcaagatcgtctttgaagacggaaacatcaacgtcaacaagggcatgggccgcttcattccgcggaaggcgttccctggagcacctgtaccagctgcgtcaaaatcaggaataaggtttggggattgcaaggggtttccacgggcatgtatgacggtcctgtgtacagaggtaccaggggtacacccaagatataggcaacctcaccgttccttcaggcaaatcttcgcacttctaaacaacagtgcccacccatgagaaagctccagcagtccaagcttcagtcttatcaggtggccatgatagatgacaactaatcgcaggcgcacggtcacgatcgtggcgccccctggtggcgtccaacatcaccaggctcggttgaacgtggatgctgcggaggagctagcctgaaggattctgggacatcatgtccatcccttttcctgtcagtgttttgtggaaccccacaggtttagatggtgctgatggaggaaggggaagtcgaagatgcactttaccctttctgtgtagaagaaagcgcaatacgtgtgtgtgtgctgtgaaatccttgacccaagggggttcatgtgaatccctggagagtgttttattccccttctgtacccaggttaatgtcttgttgcctcaatataacccgggcacagtcagagggcggctgacccgatcatggagagcgtaaaacggggagga

SEQ ID NO: 672741 - DNA, 109 bp, Homo sapiens
tctccttctcgggctctggagaatgcacccgggactactttatcatctgccctataatcgacgatggcagtgctgcgccaagagggcccgaggaaacgtcttcatgtac

SEQ ID NO: 672742 - DNA, 1358 bp, Homo sapiens
ttctgttttttttgttgtgtctcttttcttgtcttccctccgtctcgtattttctttgtctcttctttgtgtccccttccttctctctttgtcattgcacccgctctggctctgtcggtgttgtgtgtcctcctctgtcgtttctggttctctggactctgcttctcttcgtctcttcgctggtgtccctttgcaattgtgtctgcttcgtgtcttgttccctactttatgttctatcccctttaggtgtgtcccctgttggtttattctggctgcttgttaccgtcctggtttccttttttttggtcatctgcttgtgtcctccgccacgttgctttcgtgtgtcggttttcgttgtgtttctttctcctgtctctcttgtcccttcggtgccagcttctttcccccctcttgtgcttgcgtatgatctttatactgtcgtttaattcctgtggacgccgccttggtcctgtggtttcttgtgcttttctttgtgctgtcttctcgctccgttggtcttgtggcttcctgtagttgttttacgagttgcgctttctctggcttttgtgcgtgccgcggcttgccgctttcgtcccgggctgcatgtaaatgtatcattggcagtgcgtctctggtcagggattggcctcaaggctcatcattctgtcatgaagatatccgggattgtctccgatggctctggctcgcttgttgtggccatatcaatgcctgattatatgtcctgcatgcatggtctcaatggaccgagtatccctcgatgtggtgattcttcgggttgttctctattatgtatagtggaacttcgagaggattttcaacagtggtccgaagagaagtgattcggtttgagaatagagagatccaaggacttctagaaccacgtgtatcatagtaccttgtatacactcctttactcactagcagcagtctggcaaagtactgggaagccttccttcctgaggtcaaagtccatctcctaatggactcataggaccctcagagcccacctgtgtgacgctgcctttttatacatctgtcttcctccaccttgatggatcccagtagtgatgcatcctgcttaggctggacttaacacccttgcctccctgtccccacgacctacctgtcacccagttactctaaccgtctatggtcattgtacgcgttccatatatatctgttcttacctgagagagaatagtttcctgcgttaagcaaaagacctacatataggtggtggaattatgggatggggtggagtattgatataaatatataaatacaaatgtatatttttcaggatgtggtttagatacgcgccaaggtcgttttctgtt

SEQ ID NO: 672743 - DNA, 310 bp, Homo sapiens
gtgtcttcgtcaaattacagaagccaaatgcctgccattccgagacttgttgacagagcatttgaaattaaattcctgattcaagcctaagcccttacaaagatgccggggggaaagcacacagactttctagggccacctgggaagaagcacgcccatgatcttgccccttgcccttaaaattggagtaatgatgaagatgctaggtgcacatgctgaaagaagttcaacccccgggcacacaaaattgcagaacatcgcagaaagtatgagcccaaacgctaagagcgcgagatcacgaaggatagac

SEQ ID NO: 672744 - DNA, 119 bp, Homo sapiens
tatggttaatcagtgacacgcgcaggtatcgcagtgtcctggattccgagaccccgctgctgagttgcctggctaagcgcgcggctgtaggcgggcgcgtgcactgcggggctctcgat

SEQ ID NO: 672745 - DNA, 310 bp, Homo sapiens
tgctagtcaggagagagtatgaaccatgatcacactactgcactccagcctgggcaacagagtgagaccccgttcaaaaaaataaaaataaacaagtaaatgcacagtatgttagatggtatgagtgtacggagaaaatttaagcagagacagggacagtgagtgcaagacgtgttggggggcaggttgcaatttttaatagagtgtccagaaaatgacttcctgagaagatgtcattcaagcaaagacttgaggaagccaagggagttggccatttgactgtctgacggaggcctgagtgtggtggctc

SEQ ID NO: 672746 - DNA, 127 bp, Homo sapiens
ttgatctcagcaggcatcccgttttgcagcatcaatatcaacagcactcacacaggtccaggcaaacattttcttccctgtgcatccagcgggtcaccgcagctcgcacattctgtcacatccatgg

SEQ ID NO: 672747 - DNA, 291 bp, Homo sapiens
  misc_feature (26)..(26): n is a, c, g, or t
  misc_feature (41)..(41): n is a, c, g, or t
  misc_feature (60)..(60): n is a, c, g, or t
  misc_feature (203)..(203): n is a, c, g, or t
aacgtggttagcggcgatagtgtggnggaggaatgggtttngttttgtatgttcgggacncccctcattttatttttacaaaagttagatatggggagtagtgtgattgaggtggagtagattaggcgtaggtagaagtagaggttaaggagggtgatggtggctatgatggtggggatgatgagattgaggtggagtagatnaggcgtaggtagaagtagaggttaaggagggtgatgtctatacaacaaaataggaggactactctgaaagtgggtccgagctgaagtg

SEQ ID NO: 672748 - DNA, 413 bp, Homo sapiens
ccatgcgtgctctattgacagtactagtatgatgctgatcataaagatgaaaaaacaaacacagacaagttaagtgtacagatgaactgttggcacaatcagcggggcagcgccaagagtcaaacctcagcagctagggtggaaacactcagtggactgatataacccctgggcaagttacttgacctttctgtgcctcagttcccttacccgtaaagtagggcatgatattaataactacctcgtaaagttcctgtgagacctaacagagatatgtaccatgtttgaaatagtgcctcgcatgtggtaggtcctctgtgtatcacagaagtaaagctggccttcatcttctacagataatttgaaaaatgcaccagatagtcagcagcagggtaccggggttcgaattcgta

SEQ ID NO: 672749 - DNA, 346 bp, Homo sapiens
gacaatgagtatactatgttgttatatatttttcattatatttcattttagaaatattttatggggctgggcatggtggctcacgcctatagtcccggcactttgggaggccaagatgggcggatcacttcaggtcaggagtttgagaccagcctggccaacatggtgaaaccccgtctctactaaaaatacaaaaattagctgggcatggtggcacatgcctgtaatcccacctactcaggaagctgaggcaggagaatcacttgaacctgggaggcggaggttgcagtgagctgagattgtgccaccacactccagcctgggtgacagagtgagacttcatctc

SEQ ID NO: 672750 - DNA, 300 bp, Homo sapiens
  misc_feature (212)..(212): n is a, c, g, or t
ttattctgttgacaagtactacagggcttgagatgcccagagcactcagagtcgaatgcgaccaagcatagcattcataataattgtaagaggtgagacctgaggagtagtgtgattgaggtggagtagattaggcgtaggtagaagtagaggttaaggagggtgatggtggctatgatggtggggatgatgagattgaggtggagtagatnaggcgtaggtagaagtagaggttaaggagggtgatgtctatacaacaaaataggaggactactctgaaagtgggtccgagctgaagtg

SEQ ID NO: 672751 - DNA, 261 bp, Homo sapiens
  misc_feature (26)..(26): n is a, c, g, or t
  misc_feature (41)..(41): n is a, c, g, or t
  misc_feature (60)..(60): n is a, c, g, or t
aacgtggttagcggcgatagtgtggnggaggaatgggtttngttttgtatgttcgggacncccctcattttatttttacaaaagttagatatggggagtagtgtgattgaggtggagtagattaggcgtaggtagaagtagaggttaaggagggtgatggtggctatgatggtggagaggacattaagtgaaacagttgacagacatcaccagtgacttctgcataacctgcatgatctgttctacactgaagtggtacca

SEQ ID NO: 672752 - DNA, 743 bp, Homo sapiens
tttgtccatgtgcgtgctggcttgaaagatggatttgttcaagatgaaagtccaatgtttcctgtggggaaaaatgtagtgtacacttgcaatgaaggattctctcttattggaaacccagtggccacatgtggagaagatctacggtggctagttagggaaatgcatcgccagaaaattgcctgtgttctacctgttctagtggatggcatacatagtcaccccctacatcctttctacacagttggtgagaaggtgactgtttcctgttcaggtggcatgtccttagaaggtccttcagcatttctctgtggctccagccttaagtggagtcctgagatgaagaatgcccgctgtgtacaaaaagaaaatccgttaacacaggcagtgcctaaatgtcagcgctcggagaaactgctgaattcaagatgtgtttgtaaaatggcctacgaatgtggaccttccttggatgtatgtgctcaagatgagagaagcaataggattctgcctctgacagcttgccagattcatgttctgccactgtcaaggtagaaatttcacccttactggtagggacagctgggctatacctggctaagctgaaacacttgggcgtgctggccactgggggaaaatttatgctttaagcacaatgtgttagcgtgaacttcgaggccaagccctttgatccaagcctaaatttttttccccttggctttgtctaaaccaccatatgagccctg

SEQ ID NO: 672753 - DNA, 252 bp, Homo sapiens
  misc_feature (26)..(26): n is a, c, g, or t
  misc_feature (41)..(41): n is a, c, g, or t
  misc_feature (60)..(60): n is a, c, g, or t
aacgtggttagcggcgatagtgtggnggaggaatgggtttngttttgtatgttcgggacncccctcattttatttttacaaaagttagatatggggagtagtgtgattgaggtggagtagattaggcgtaggtagaagtagaggttaaggagggtgatggtggctatgatggtggtggttggtagtattactgttggtggtgatggtgagtggttgtgtagtattactgttggtggtgatggtggtggtagg

SEQ ID NO: 672754 - DNA, 321 bp, Homo sapiens
  misc_feature (1)..(1): n is a, c, g, or t
  misc_feature (76)..(76): n is a, c, g, or t
  misc_feature (84)..(84): n is a, c, g, or t
  misc_feature (106)..(106): n is a, c, g, or t
  misc_feature (138)..(140): n is a, c, g, or t
  misc_feature (146)..(146): n is a, c, g, or t
  misc_feature (159)..(159): n is a, c, g, or t
  misc_feature (175)..(175): n is a, c, g, or t
  misc_feature (187)..(187): n is a, c, g, or t
  misc_feature (294)..(294): n is a, c, g, or t
natttattaaagatacattaataattcttgtaattgatgcaggttttcttttttctacagactactattattttantcttggcnctctggaaaatgaaaaatccangagtttttctcttttgcttttagcccagaaannnaaggtnggtaagtggtaantagcgtacgtcctgtnaaagccagtggnctcatgaggaccgacatttgacttaagctgaaataatggaatatggctaatgtaaagttcagttagtcccagctggctttctttgacgattcttttcttcgtgagcnacaagaacgggcatgcccggccctctc

SEQ ID NO: 672755 - DNA, 969 bp, Homo sapiens
  misc_feature (887)..(887): n is a, c, g, or t
ccacgccctcagcttctgcgtaaagacccatgaccgctctgtaactacatggtggaccccatctggcagagtgccatggcgtatctggtatggatgtcatcgtcacagtggggctgtaggagtctacacctcagttcatgaatctaactcgccgtgtgcgcctcctggacagtagcacgaaactggggctttcttgtataaaaaagactttaatattctggtaatgagctgtggtcctgtaaaagcttgtctgggacgtctggcctctcgtgaagtaaaccagcgcagcaaggacgaacaagtagaggtggctttgctgcctcctgggagcccgagaactgtgcggctaaccgcttatagggtcctgccgccaggcccagtccagggcctgaggagctgtgcacagagagggcctcaggtctgatctgacaccgttgctctccccagtcatgttgtatctcttgttctaaaagacaaatttatggtaccataagctgccaaagatcccctcctgcctcagaccccttagccagggcgttgggggctgagcagcagaccgagatccagagtggggtaatagcctcaggtcggccgtggtcccatttctcaaagcccgctctgccccattgttctcctttcccttatactttttgttaccttgtctcataggtgcctagagatctccctgtgtcaacctttgaggtcccagctccttccccctattttgcgtgactcgtcacgcatggttaccatagtagatctgcttcattggcatggttaacttactgattgttgcgctctgttggtccagacccagtgtttcagctgtgggcccactgaggaccgggcagagaacttccaggcgaggccctgggcttcacgccggnggacggcgacaccttgctccccgcagtgtttccgtctgcgtgtctcccctcccctctctccggcctaccagagcccgaacag

SEQ ID NO: 672756 - DNA, 1474 bp, Homo sapiens
gggtagaagcagagtctttagacccgacagtcaagccagtggcatgtgggtggggcacgagcccagcaggcagcacaggtcagttcacctctgcaaaacgcaggccagtgcacaaggcggttcttgcaacaactggtcaggtccaagcaagttaccaccgtgctgcacagcagtccaccagcaggtggcagaaccagcaggcatgccagcagtgccatccagactagtcagcagagctggcatccaggcacagatctactgcacacaagcccctggagccaaggcagggctcccaagttcgtcccgtcaaagggcatgtgttgcacaagtctacatatgtgaacccgggtgccaggattagtgtccagagcaagcaatcccaagcacgtcgcgttcatttggaaacgcgcaaactagccagctttccttacatacaggcaaacaagcaaagttgcacaaagaaacacaagacaacccaaggcatagaggagtacccaagaggcaacttccaagccaagtggcaagcaaaaaggggtctgaaagtgaggcagcagaaaaggccgtaggtggtcatccacgtaaaggttccgaagcgcacaagaggccagaccacattgcaaaagcactttggcgtgcgtgaggtccagggaaacacagccaaggactcccatgggacagcgggactaaggcaccgatgggggcacgggacaccaaggagggccggccatcatggcaaccatcagagcaccacgacgaggccaactcaagaggccgcgcgccaacgcagggggacaacgacaaatgaacgccatgggacacgcgacacacgacaggtccgacacacgcgattggcgcaaaacagcaacgccgacgaccaacgtgggctgacccaaagccgacatatccacggcacccaatggcgagcccacgcagtcggtaccacagggcaaacggacacacaccacgccaaccacagggcaaacggcaccagcgacaacaccacaacatcagaccaaacgctagccggacacttggtgccaacacaacggcaccagggcgggcggcaggcgacaaaacggagaccagccacagccctgaccaacacagagaggccacaatcacaacggaaccaccccgaccggcggggaaccctggcaccactcaacatcagcacaccgcaacacaagacgacgcgccaaacgatagaaaccaggatcgaaccgaggaggcaaccaacgacaccatacaacaagtagaacaccgacaagcacagcactgacacagagcacgcccacacagagaacacggcccaaggtagcgagcacacaacaccccccaagacagccacggacaatctcacaagcaggccgtgggacacagaacgcgtaacaccaacacagaaagactcacagacacagcgccggccccagcccgctgaacgcatgaagcccacgcgccacagagcctaggggga

SEQ ID NO: 672757 - DNA, 979 bp, Homo sapiens
tgttggtgttgtaggttctcttttgtcgccccatgctccttgtccctttttgttcattcgttcgtgttttccttttcgttgtgtctgttttggctccgtttttgttccgttgtttttctgggttgccccgtcttgtctggcactgccagatttgttattattgtcgtggttgtgtctcggatgtttacctcttctgtcttaaggtagctttaggtccctttcagctatgtttcatatgacgagagtatgagcaaggtcgcaattattaagtacacgttaggagttaagtttctacttagtacagatcagtgtagacatctacttgttttctacccgcgcgatatgattgaaaatattggtctaccagtcgatgttatttatgcacctttttgtgacagaatattttagcctggttgttgtatcgacagaacaatcgtgatggaactcatttagctcattcacgtatggctcataataagttcatcacatggatgtattctttcaatatgaccactctagtagtgaatttcaaacgtctttgatagggtctagagtaatcttgttcattagtcttggctactttcctctagttctgacatagtacaggcaagaaatatggctatctctcaagtaaggattacttcctgagacgcggtctggagtttagacaaatctaatgcacattagggacatttccttaattaagactctccaaaccaggtgtggtagctcatgcctgtaatcccagcactttcgggaggcagaggtgggtggatcacctgaggttaggagttcgtgactagccgtggccaacatggtgaaaccccgtctctactcggatacaataataataatacttttattcgctcggcattggtggcatcgagcctgtaatcccagctactggggaggctgaggcaggagaatctcttgaacccaggaggtgtacgttcgcaggagccgagatcatgctattaca

SEQ ID NO: 672758 - DNA, 212 bp, Homo sapiens
tatcattgaggattaaatttcaacacaagggctgggcgcagtggtcacgcctgtaatcccagcactttgggaggccgaggcaggcggatcatgaggtcagaagatcaagaccatcctggctaacacggtgaaaccccgtctgtactaaaaacaaaaacttgaacagctatctagtaaatggataaagggtgcctgtggaattcaggggcaag

SEQ ID NO: 672759 - DNA, 108 bp, Homo sapiens
ctattgagcagtgcacacggacggggtttcagcatgttggctaggccggtctctcctgacctcagggtgatcagcccacctcggcctcacaatagtgctgggattaca

SEQ ID NO: 672760 - DNA, 666 bp, Homo sapiens
agaactccaaatcccgtaacctacaagcactacccatatctccccaacgacctccaatcccccccactatacacctaaataacccccccccaatattacattaacaataatcaagacgcgcagcctcactaatcaaactccgtaccgctcatccgtccctaaacctccgactcaatcttaaattaacattactcctctacgggctccaaaatcgagaccaccggatataagaaactctaatacacctgcagaacgaaaatccgtaaacaaaaacctatagaacgaaaacacccccaaaacacgccgaccggacatacccaatcgaacgagaaaacaaaacaccacatcaacaacagacccacaaacacagacgcacacccacatccaacaaataaaacaacacccccgacaaagcccaacacaccccaagcaacactcgacaacaaaaacagaacaacctatctcaacgtttcccctctaacgtttccccgtaatcccatttcccccccccttcacccctaccctcatttccctcaacatcccctgtcttaaaccatttccgacgagtcatttatacattcaacctaccctcctatatctctctcctccttcttactggaaaccgcgaacgttgccgaactttacgtcgctgggaacagcgaacct

SEQ ID NO: 672761 - DNA, 562 bp, Homo sapiens
ggcctgggtctgcgggagccccatctagcggggttccaatggcggcggctggcatcatgtcgatggccctgctccgtggagctcatcttgtcccctttcgcccctcacgccccccatgctctgacagccagatccagctgcctcgcccagggcctcctgctgggacaccaccacccactggccatgacacttccatgtgagcaccccctgccatgcaactgtgccaccatgctccttcctcctcttcttgctgactggggattgttgtctgtggccttcctgctgctcccactccctggacgaactctgtgcatgccatgctgcctcaatgtcctgcactgtctccctgggacaaaatgttggttggcctgcctactgtcttgtggcctcctcaccatggtgttcctccggacctgagctccgtgctcaacccccagcacaaccccaccctccctgggcagtgtcttgagtgcaagcactgtgatgctcatacctatacttgcctcctaccctcttctcttacctgcatactcaccaatcctccctgacaaaaaaccccatg

SEQ ID NO: 672762 - DNA, 412 bp, Homo sapiens
taccgagtatctatcccagacatagatggtatggctgtggctgttaggaactaggcagcacagaggtgagcagtgggcaagtgagtgaagcttcatcttatttacagccaccccacattgctcacattactgcctgagctgtgcctcctgtcagatcaatggcagcaataaattctcataggagcgtcaactctattatgaactgtgcatgcgaggggatctaggttgcgtggtccttatgagagtctaatgcctgatgattcgtcactgtctcccagcaccctcagacagggccaactagttgcaggaaaacaagctcagggctcccactgattctacatcatagtgagttgtataattatttcattatatattacaatgtagtaacaatagagataaagtacacaataaa

SEQ ID NO: 672763 - DNA, 262 bp, Homo sapiens
ctagttatttactacatttggggattaataagtgatttatatgcatatttttctgtaaatctacagttttttgtacaagatattctacaagttatgaagctaagggaagaaaatgccaaagatacctctagttatgttgaacacagccagcacagtttcgacaggtcaaggaagagctgtttcagtaaagaggaagtgaaaacacgtatctaggaaaatgtttctcaacaataaaatttacaactgtttctctcttgctaaa

SEQ ID NO: 672764 - DNA, 116 bp, Homo sapiens
atccgctttgactagccgacagtcagcccctcagttagcaccactgctacactcagcctcatgaaccacttcagaccagccaggtgtcttcccgggccctgtcgggctagtcgggg

SEQ ID NO: 672765 - DNA, 541 bp, Homo sapiens
gacatcccgtccgagttccagaagacggtcacccggctgtacaagctgtggatgttctacgcgctcgtgatggtggtcaacattctcggcgggctggtcatactgatccactcgggcgagttccgcacgttcgggttgagcatcttctatgccgtgctgtttactcctgcatccttcctgtgctggtatcgcccagcgtacaaggccttcaagacggactcgagcttcaacttcatgatgttcttcttcatcttctccttccaagcgctcgtgaccaccatacagacgatcgggttccccggttcgggcacgtgcggcgtcatcatggccatcagccagttcagctcgggctggggcgtcgtcgttggcctgttcctgatgtgcatagcacttgcctacggtacctgcgctgcgggcaacatattcatgctgaccaagatacaccaaatctaccgctcgggcgataagatcacgatgggcaaggcacgcgaagaattccagagccagtttatgagcaactcgatcgtgcgggacgcggccg

SEQ ID NO: 672766 - DNA, 257 bp, Homo sapiens
gtatttatcgccacacctcacttagatcagtgaagtgagccaaatactatcagatgggaggacgcctatcatgaagcggactcactcagatggcgagagctgaggcggcactggagctgaagaagaagggcagcacgtggtgctgggtgcatcgagaacagggtgagagcaagggcattcacctccgagctcaggagagggcttgtcgcgaggagaagggccctgcttgcgaggaataggtgtgggggataccatca

SEQ ID NO: 672767 - DNA, 407 bp, Homo sapiens
  misc_feature (53)..(53): n is a, c, g, or t
acagttctgttaagtctgtaaccacggctttacaaggcatggcttctacttcnccaattcctggggccaagtgggcccctgttgcgggttgttttgagcacaggttaagcactgtttacaaatggctcaagtgatggcagagagccgtggcacatagaaatggcattttagtaacgtttctagtgccattttttccatgagttccttgatgaatttgctttacaaacatatgagcttaaatctttgaaatggctaatctcccatcgaagaatttccaccaccctccttgaatatatttttcagcctcctgggcaaaccagggtctttcatttggtgtataacttgggttttcttggagaggaggttctgggaggagagccatagctaaggcttcctctgatttaaaa

SEQ ID NO: 672768 - DNA, 372 bp, Homo sapiens
cccctaaaaattttgggttttggctgggactggaaagatcccaagtttgggggaaatatgggcctttcccaaataaaaaaagagggttttcaacttttgggaaaggggggggtccgtttgggccaggcaaaatcccttaaactgggcccttttttaggttgggtcccaaaaaaaattcccggttttcccggtaaaggtgccttttttttaaaggcttttataccttgccagccccccggtaaaatccgccaaaaggttttgtttattggggcccccaaagggtccctgggaagtgggggtttttgaaccaaaaataaactggcccttttgccacttttttttataaaaaaggatcccccgggtggggtttga

SEQ ID NO: 672769 - DNA, 812 bp, Homo sapiens
ctgtgaaccttctgggagtggctgcagagtaagtgccgactctgtgactccgacggaggcacgaggcctgtggagtaggtccctctgttccgacagtatcttccccatataccaagagcacaggtggaaaatggccggcaccacatggacatgagtggcaagcgctgtgccgggaagttggatgggcagacgcctgcgagcaaatgttttctgaatggcctggggctggcacttcatctttcctttcaggcaacgcacctcaacatttgccatgctggctgtgctgcgacagagttctgtggtaccacgaagagtgctctccatgctctaatttccgtggctacaacactaccccttgagctgtggtcccacaggatatgtagagaacatccacatgcaggctacatcttacgagaaaatgagattacaacaatcttgcccgcgtcagcatatagactggacacaaaatgccttaatacttggcacagcatcgcaaaggggcgcttgtcagtgctggtgatgagcgccctgcactcttacggccgtcggatctatttccataccagttccgctaccacgccaaacgcattcgagacacaggacaaacaggggcgtaccagggcgacaatagcaacgggtcaccggagacagggcgcgacacaccgtggaggttcccagtactacggcctacacacgtttcacagcaacaatatgggatattcacctggggtgttcatataggacacggacaccgccctaatgcgtcaaggaacaaggcagaaacagcaggatgacaaattgaggaacgtcca

SEQ ID NO: 672770 - DNA, 291 bp, Homo sapiens
gcgtaaactgtgcacaggcttgtgttgagagctgtccctgtcatggggtggcatatgttgaagacatcctccctgttatgtagacaacacagtcccttcgcgctgggggcatatatatgtcagaactttagtcacatttcctaataggctttctatgggtgtgtttgagcggtgtagaccactgaggagtcaagcttgtcttcattgtgtgtattttgtattctattcctgcactcctatgcccctacacttgccccgtcacgtgatgtccacgccatgctatgcatccca

SEQ ID NO: 672771 - DNA, 407 bp, Homo sapiens
acgcaggtggcatcatgcctgtaatcccaccactttgggaggccgaggtgggcagatcacgaggtcaggagtttgagaccagcctgaccaacatggtgaaaccctgtttccactaaaaatacaaaaattagccaggtgtggtggcatgcgcttgtaatcccagctactcaggaggctgagccaggagaatcgcttgaacctggggggcggaggttgcagtgagccgagatggtgaaactgcactccagcctgggaaacaaagtgagactccatctcaaaaaaataaaaaaatttaaaaaataaaataatgattctgaaattagacagtggtagtggatgcacaaccttgtgaatatactaaaactcactgaattgtacactttcaatttcatggtagtgaattatat

SEQ ID NO: 672772 - DNA, 167 bp, Homo sapiens
cgctactactacgggaaatctgagtctggaaccatctgcccaggatttggggtcagagatggtgggcctttctgatcctggtcttgccatggttatgatggtggcatccctgcctgtcttctatcatgtgcctcagcctgtttttttttccttggccaggctgcaag

SEQ ID NO: 672773 - DNA, 207 bp, Homo sapiens
aactcttataagggtcagagcagtccacagttaactgtggtctgccagagagcagtattacgctggagaaaggcgagagaaagcacggggcacggtggcctgtgaaaagcctcaccgagttcccctggtgagcgctccacagacggacggtcttgtcggttgagcccgtgggcaagtagtttgaactagggtgggatttgacacggg

SEQ ID NO: 672774 - DNA, 475 bp, Homo sapiens
tggttagtagagtcccaaatctgcttttagaagtcatatggtgatcatcagtttagattcactgtaggaagggcagcacctgttaaagtctgtccgggagcacaacgggcaagcgtatcaacttgcacgtctgttcaccacagttgcttctgtagttttcatacccctgatgattactcaatctctccttagcaacatgtcttctaatggaccagctctcaccagtggccttgtcgtctacaggacatcaacttgtgctcccctcaagggcatgggatcttacatacatagactagatccagccaaagactcatagcggctactccctacctgctgctccaaatagacatgaacacatcagcatgataactttcctcctaaactaacttccagacactccccgaactctctgctccgcacgcgcgcgctgactcctaccaacctctgccatcgcacgatcccagacacagctcct

SEQ ID NO: 672775 - DNA, 157 bp, Homo sapiens
  misc_feature (72)..(72): n is a, c, g, or t
  misc_feature (89)..(89): n is a, c, g, or t
  misc_feature (101)..(101): n is a, c, g, or t
gggcgggcatttgggcaggccggcaggcgggtgcgcggagggctggtaccccgcagcaggtgggcggggtgncggttggcggcggcggncttgggccgggnggcttgccggctttgcgctttcggggccgtgccgcccggcgggccgtgccggggcc

SEQ ID NO: 672776 - DNA, 424 bp, Homo sapiens
  misc_feature (424)..(424): n is a, c, g, or t
actagtctctggaataatttagggctgagaagagacaaaaatcaggagactgtaagactcatataatgaaacaatgtgttgagtatagaatcatatttcctaaatgacagactggatgatcaggctgctcttgggaagttgcacagagaacctgagggactcaaaagtcagtgcgttacctaaaactgaagcccggagctaagtatagaaaacccaggaagtgcaggcaaaacagtgaggaagtcatgggaacaacgcagaaacaggacacctggcgataccagcatggaggttctgtaaagcaagcattgtggcttccacacccatggtggtcacagagcaggtgcctaacaggtgcttgttgaatgaactacttctgcctccacctttgtcacccagagcttctactctgttgttttctccn

SEQ ID NO: 672777 - DNA, 274 bp, Homo sapiens
gccaaatttggacaaacttttttttttttcaattttggaaacttcctggaaagccgttttccctaaggatcccctagtctctatatatgtgggtaggagtcatggaaatgacccataaaggacgcccaaagtttgatgggacgtgttaaaaactgttttgggcttttatggatgtcaaacttggcaaaacatgtgtaaggttctaaaatatgaaatgatggtaaaaaaattttacctttgaattccctttggataaaggtattttttgatgtga

SEQ ID NO: 672778 - DNA, 541 bp, Homo sapiens
gacataatacctgaggggttgctcaattgtctgggggagtagaaataccgccagtacctaactgtgcctccaggttactgcacagatttcctgttgtgcgccagcagctctggtgctgtgcttcccgtgaggacccagtaccccttcctgccatacccaccaaggtttcccccacagggccaggctgcctctagcgtccactactcgagaccttgcccagagggttgtgctggtgttgcgggaagtcctggcatttcttccgggacggccgggtgctgctgggctcgagggccctgagggagcggcacctaggcctgatgggctaccagctcctgccgctacccttcgaggaactggagtcccagagagtcctgccccagctcaagagctacctgaggcagaagctccagccctgggcctgcgctgggggcctgaagggggctgaggggttgatgtggggatcaggaatgcgccgatgggggaaggatgatttgcactttggttccctgtgttttgatttctcattaaagttcctttcctt

SEQ ID NO: 672779 - DNA, 395 bp, Homo sapiens
  misc_feature (25)..(25): n is a, c, g, or t
  misc_feature (64)..(64): n is a, c, g, or t
  misc_feature (277)..(277): n is a, c, g, or t
  misc_feature (298)..(298): n is a, c, g, or t
  misc_feature (315)..(315): n is a, c, g, or t
  misc_feature (339)..(339): n is a, c, g, or t
attttatcataactatattacccgncaatgcttcaccagttacagtaatttttttggagacagngtttcgctcttgtcgcctaggctggagtgcaatggtgtgatcttggctcactgcaacctccaactcctggtttcaagcgattctcctgcctcagcctcctgagtagctgggattacaggcatgtgccaccatgcccagctaattttgtatttttaggagagatggggtttcatcatgttggtcaggctggtcttgaactcctgacctcaggtnttctgcccgcgttgggccttnccaaagtgttggggatntacagggcgtgacgataccacgcncgggctaaattttggtaatttttttagggagagattgggggtttttaaccatggtt

SEQ ID NO: 672780 - DNA, 377 bp, Homo sapiens
  misc_feature (108)..(110): n is a, c, g, or t
gtctgtctgctctggtaaaggtgatatacagaggagacatgctactgcatgaagcagaaatcagtgaggcttggtctataaagttacaattacaacatgcttgcttannngagccactctttttgaaaacagtaactgtttcttattactgttatgaggaataaaagagatgacatatatcaaggattctgaaaactagtttgccaaatgggtgattgttctaacacataaaatcctttcaccttaaattagctggacattcaagttagagctttctcttctctccatttctaagctcacattggatcatggtatcttatccagtgagttgtaacgttgctaccagtctattccgatcattgacacagatctaccaa

SEQ ID NO: 672781 - DNA, 165 bp, Homo sapiens
taaagctgattggcttactgggcgaaatattatgctttgttgttatggatcatctggcggatggggattattgctagagatgaggatggatagtaatagggcaaggacgcctcctagtttgttacgggacggatcggacaattgtcgtaggcgacataggaccat

SEQ ID NO: 672782 - DNA, 124 bp, Homo sapiens
  misc_feature (52)..(52): n is a, c, g, or t
gcccgcttgcacctcggcgatccccgacttccttctttatggcgtcgctccngttcttttgggccgaagcttgccgccttcggaattcgtttcttagcgccttggggagttatcaagttgataa

SEQ ID NO: 672783 - DNA, 828 bp, Homo sapiens
  misc_feature (12)..(12): n is a, c, g, or t
  misc_feature (22)..(22): n is a, c, g, or t
  misc_feature (32)..(32): n is a, c, g, or t
ggttttaaaaanaaaagaaagnaaggtaaggnaaagaagaaaagagttgaagatatgaaatccaccacacaggttacctttcactcaagaggttgtggcatcctattcattgtcaactactggactttttcctccccgtcgtggaaaattggcgcaacattgccacatggagcatcccttcttcactcttgacccttccttcatcaatggtggagcatactcctgaagctggagaacagaaatataaagctctgtgttttacaatgaaaggaccattctcctcaaaatcctaagccctaaaataaatcttagcttttggatataaaagataccatgaagctttagctactttcatcatggtccccccgatccatactccagtatatctcgtgtacatgctatcattatccccaacatctcaaattatattattcccacacctttgtgaccgccgcccctccccacacacccccaccgccccacaaccccgtacccactccccacttcgatcctcactaatcaacttatctactctatatacgaccatctgaccgttccgactccaccctgtatcccatttccgtcctaatgacaagccccaccccccacgacatcactgtacccacctcctcgcgtctcaccccctcccccgaccatgaccgatcccccacgctctcagccgctatgtcgccccggcgccagtcaccgacgccgacccacaaatgcaccatccacaccacacaacaacaatcaatagccccccgcaccatacaacgccttgcattcgcgtacatctttcccgcttcactccaatttatatctcactct

SEQ ID NO: 672784 - DNA, 310 bp, Homo sapiens
ctgtgctggtcccgcggtcgtatggccctttgcgccgtggccacgaactgaccgtgatgtgaagaacatatactggaggctagagcaagagggctgaaagaggctgctggaacagccccggggcagggttttaaaaggcctacaacagagacagggagagcagggagagcaaggaagaggaggtgaggtgtgtaacacgagtggagggacatgaaggtcactcggaggggcaaggaaaaccttgggtttctaaggtccctaaccaaaatgacttgaagaaggtgggggcaaagaccacagccctccttga

SEQ ID NO: 672785 - DNA, 396 bp, Homo sapiens
taatgtactagcaaggtttggtcttgaaaggattcataatcactccaaatgaaatgctcctcccttggcccccaatgtgaagggaaggtagaaacctgaggctaaatttctggcacaaggagaaactgttcggagcacgtatccagtccataaaagggatggagagagggggtgaatatccacccttgagaagaaccttcatgggccatttcccaaggatcaactccgattggatatttggcacaaacatcagccgtgtctattgggccacacacgtgattaaacccgtggagcaccgccggggccaccggaccctatccaaaatttgaaagcgccgcctttgggtaatttggaggaactctttttgtaaaggaaaaaaaaattctcttcgcctgg

SEQ ID NO: 672786 - DNA, 876 bp, Homo sapiens
  misc_feature (727)..(727): n is a, c, g, or t
gcacgaggtttttttctattccttttttaccccctcaacctattcctgcgttatgggaatcatgttccgacagacacactggtacaaccacagaaaaggggagaagttctgatcccgtcagcgaagggcgagggggtgcgaagggaaggaaaagagacctcacaggccccggcccacgaaccaactccagcaattcagtagttaagttcggccccgctgggggttccggagcgcggcgccccgcctccgccggctctccattggcctacgcgaatgcctgcgctagcgctctatttgctcctgcggatgcccatcatgtcaagcccccccaccacccgagcccgcagctccaaactgcgccacagagtttacggaggaaagggcctggaggcagcaagctgccgtaatttgggtatgacgaaggcgtcaggcgcagcgccctggactgcagccggccaaggagcatggcgcagcccaccccaaacctggcgtttggtgaccctgggctccgaatccgctcgctctgggccagcagtactccccccgacggcctctgccaccctcggtccttgcctttgctgttcatggtggttgcgggtccggtttgtctcggcgtcgcggacggttatttttttcgtcctcttcctgttcggagctacttccgtgtcacatgatggtccgtccgcctacgtcacccgacgcccgagtggcgtgccgccggaaactncgcccctgctccggcctccagtcggccgcgggagggtccgtcggtcccgcccactcgccttggccccaccccctgctcgtttctgtcctccacctccctagcggtgtccctcagctggagaaaaaccaaatgcaggtattgtctggaaa

SEQ ID NO: 672787 - DNA, 752 bp, Homo sapiens
  misc_feature (49)..(49): n is a, c, g, or t
  misc_feature (120)..(120): n is a, c, g, or t
  misc_feature (144)..(144): n is a, c, g, or t
  misc_feature (148)..(148): n is a, c, g, or t
  misc_feature (159)..(159): n is a, c, g, or t
  misc_feature (173)..(173): n is a, c, g, or t
  misc_feature (193)..(193): n is a, c, g, or t
  misc_feature (197)..(197): n is a, c, g, or t
  misc_feature (260)..(260): n is a, c, g, or t
  misc_feature (295)..(295): n is a, c, g, or t
  misc_feature (311)..(311): n is a, c, g, or t
  misc_feature (314)..(315): n is a, c, g, or t
  misc_feature (319)..(319): n is a, c, g, or t
  misc_feature (404)..(404): n is a, c, g, or t
  misc_feature (424)..(424): n is a, c, g, or t
  misc_feature (430)..(430): n is a, c, g, or t
  misc_feature (464)..(464): n is a, c, g, or t
tatgacgtgcaggttggaaatcagaagtctgtgagagcgcgggagtgcntggcggctctgggtccctagacctggcccgaccccctctgcttctacctcccggctctgctgctcctctcnctcttgggttgagctccctttggngccnccggcgcgganccctgtggtcctcnggccggtgtcccttgtgtcngccnggcgccctcttttcctgtgtccccgcctgccctcgggctctgctcccctctggtgcccctccnccgctgcccctgccctccgtttcccctcctgctcnggccactgcccccttntcnngccncaaaaaaaaaaaaaaaaaaaaaataccaccagactagttagagttccccactcaccaagcaagacatgcagtttcatgcctctgngccttcgctcatgctgtttnttccgnctggaatgccttcccctgctcctcctgccttgtntgcctggcaagttcatttctcacgatcccctcaaagggcccctcctccaggaaggcaacccctgtgcccctccccttccgggtacccttggccctttggcaatgcttttcttggggcccttatccccctggattttacttgtttacatgtttgtctccccttttagactgtgaatccttaagggcatgggctggattttatgcatctctggatttttgggcctagcccggggcctagcccccagtaggggctcaataaatgttgaatgaatgaatggtttaatccaga

SEQ ID NO: 672788 - DNA, 216 bp, Homo sapiens
attgcactccagccggggtgacagagcaagactccatctcaaaacaaacaaacaaacaaaaaaagaaatgaggtgagtccagctggggaaatgtggaatgtcagatgcctttggcctattcagagggagatggccgaagcacagaggagagttcagggcagggttaaattatttgtagcgctcacatgtcccagattcggccagggggagttcccc

SEQ ID NO: 672789 - DNA, 840 bp, Homo sapiens
tacttgaaggcaccttttttaccagaaaatatttggaggaatctgtgtccacaaacggggaccacggggaccccccttcctgcgaagttgctgctcaaaggggattgggggttgaaattccttcaactccgcccgaatcttcatacccgagacgggcaaagggctcttgcagggccgattgtgtggcccccaggttccaggggactacatgggaccccatatttccatccgtgtggcccggactatttgagactgctgttaggcgcggaagaatacccacacgctctcccgttggccacccttgtgggcgccaaacatctcctgtgagagacagccaaacattaagcgcacggacaatagtgagtagaagcgattcacaatcactcgagatctatgccatttaaaccctttcatatccccacaccgcaagtttctcacaaccgggtgacacagaagctgagctatcccctttactcccaacaacaagagaactcgagggtgaacattgtggcgaccaaaacaagcggttggttccactgagacagacgaggatctcgccacaccacgatactattcgcgccacaacaacacaccccaaaaaatatagccatcattcacgctcattcactttctaacaacgacccacaccccgattgaaagaaggtcaccaccgaaaggagccttactaattagcacccccgttgtaatcatcattacaccccctatactaattaataaccatatctccccgcccaattatttacacaacgagggttcgcccccaaacatattcgttactcacaaacagtactccagaatcatttccacaaaaaataattc

SEQ ID NO: 672790 - DNA, 113 bp, Homo sapiens
gccatttcagcccttcctaaaatcgcaagtaaaagtgaagcaatgaggacctttttgggcttgtgccctttgatgaattacggggtgccagcagcaaaggtctacggcgcgtt

SEQ ID NO: 672791 - DNA, 716 bp, Homo sapiens
agcgggggggctggcgtagttctcctgagggaagaggagtggagtaggggggacgcggcggcggcgttgacaatgagttttcttggaggcttttttggtccaatttgtgagatcgatatcgttcttcaatgatggggaaacctaggaaaatggcagaaatgaaacactgtatatgatggcaaagtagaaaaacactatctcttctatgacggagaatccgtttcaggcaaaggtaaacctagcctttaagcaacctggacagagcgctagaacaccaaggaatttagaattgacacttctgtaggtcaaattgaacttttcaatgaccaagagtaatactcatgaatttgtaaacctagtgaaagaactagccttacctggagaactgactcaagagcagacagttatgattctcggaatcttatgcaaagttgacaaagccatcatgcaatcttacatcggtgccaatgtccgcttgcacgtattttcttacaatgacaatagtgcaggacagactgacagatttggtcaaagagtatgatcttattgttcaacagcttgccacctatcctgcatgtcaaacaaactctatttaagatggaagtgggcattgcaacgaattgtcttacatatagaactcgaaatctaactacattcaagtatcatctcacagcatgcgcacgcgccaccactccaccttcttctcaccaacacca

SEQ ID NO: 672792 - DNA, 321 bp, Homo sapiens
ccccctttgggggttttgggttccaccaggggcaagtggacgccccttttttccggttttcccttgggggttttttggcccccaaaaaatttgggccctttttgttgggcaaagtgggggctttttttcccctgggttgcccaacccctgggcccatggggccccgtttggtttgggtttttttggggggggggtgggggcccccccttcccatgcccgggtttttccctgccccccctgggccccgggttttggtttggggggtctttccccccggggggggtttggggccggccttttaaaaatttggggcctccccca

SEQ ID NO: 672793 - DNA, 1192 bp, Homo sapiens
  misc_feature (290)..(290): n is a, c, g, or t
  misc_feature (336)..(336): n is a, c, g, or t
  misc_feature (1192)..(1192): n is a, c, g, or t
tataaaaacttcctctttaatcaggggtttataacatgaacagattctctggaattaaaagggaaagttctccagtacacggaaacataaatccgcaagttcaccacactttacaacaccgggcgaggaaaaacacaaaaacagcaagtttacagtgactcccgtggtaacagccagtggctctcaaacctcagagtgctctccctcacattcgtggccaaggtggtgttctcgtggatatacaagagccaccatctcggtggcttctctgtggggctccacacttcagntatatagggcgtgtgtgggctcacacagaagccacctcatctcgtnggctgtgggacatagatgggtgggagtggggtggacctcattaacctcgagagaagaggcaaaagaggcgagtttatcaccgagcccgactatttctcaaacacgagtgtgtgttttgtgcaaacatcttcttttttataaatctatttccaagagtgtggagaaaacacagagacagaggtgcaaccatataatttagagtgggtttactcgagagaagagagagtgttttgaggaaaagtattagagggcacacagtctgtggttgtttacagaggcttgtgaaaggcctgtgaaaaagagtatgagctgtgtgcgcaagagctatatcaaaatatatctatgtggggaggtattctgtgtgggagattaagagtgcggcgcggcctgtgaaaacagacgcaaaagaaatgtgtggagggatttcagggagagttcacaggtggggacttccactatatagagaggaggggcaaccccgtactcccgccgtggagattctctgttgtcgttgaaaaaaccgcccgaagagaaaatgtcccgctgcgcaaagtatcagagaataatctcgaagaggaaccaatccccaaaagcaataggtgggggggagttataaacaaggagggaggaagccccaacgacggttgtggggacaataaagtcgcttcaccagtgggggggcggccaacgacaatcgtgacaccgatgtggtccgcagaaaataaactactacaaaaaacaactcacctacttacgggcctccgggtgccggcatacatttgtagctccccaagaaaattattcggactaaacaactatgtgaggctatgagggaggccgaaaacaatgtggaccn

SEQ ID NO: 672794 - DNA, 102 bp, Homo sapiens
aggctggagcagagcacaggagcattatcctctgcctggagggttgggagagccttctagggaggaggtaatagcctaagcccctgtactatagagggatat

SEQ ID NO: 672795 - DNA, 226 bp, Homo sapiens
gagcttagtgtgctgacggtgggacgaatcacttcacgccaggaggttgaccgctgcagtgagcatgatcagcgccactgtactccagcctggtgagcagagtgaaaccctactccaaaagaaacaaaacctagagtttgatcacataagtattgctaataataatttcaataacaataatagtagtagcagcaagtggcaagtgcttacacttaggtagcctact

SEQ ID NO: 672796 - DNA, 678 bp, Homo sapiens
ccccgtggatatgaggtcttctgggcctgcgctcttactatgagacccgcaagatgtaagtcctcaagtgttgcctggcaaggtaccaagaaggatccccaggatgggcagctcagtatccgagaggcgatggaagcggatttgaaggctgcaagctgaggctgcagctgaagccacaggctagggccgagattagagctcgaatgggcattgggctcggctcggagaatgctcgcgggcccatgcaactgggacgaagctgatatcggaccctgggcccaagcccggatcccggcgggagccagaagctataagcccaagccccagagagtggccagtgcccagcactggtgcccagtacccagtagcccataccacgtggccacgtgccacgtgccagcaccacgtggtggcttcacgtgctggtgccacgcctgagccgccactctcacactttgggctcttcgctggccttggtggagactggtgccacgcaccacgtggcacgctctggtgcctgtggtttctcctaccagtgagattttagatattgttaatcctgccagtctttctcttcaagccacgggtgcatcctcaggaacctactcgacacagcactttaggcagcccctatccatccattgaagttgacactctgcattaaatctagtttgccca

SEQ ID NO: 672797 - DNA, 727 bp, Homo sapiens
ggagagagagagagagagaactagtctcgagttttccattgtaatctttttattattatgtattattatactttaagttttagggtacatgtgcacaacgtgcaggttgttacatatgtatacatgtgccatgttggtgtgctgcacccgttgaacatcagtcatttaggcgtcaggtatatcggtcctaatgctatccctccccccctccccgtcagatgcacattcgttaagccatcattgccagacgcttctgtctcaaaaaaaaaaagacaagagaaaagcatacaagaccaagttattaaaactttgggtagggcacaggggctcacaccctgtaactccaaaaacttggggaggctgaggcagggaggaacgctggagtcgggtctctacctccagggctcaagtgacccccacccatcctgggtgtcccaagagcacggggattatagggtgtgagccaccctgctcagccaaagagtctagtggtgacgtctggacgtgtatcagggtcttcagccctaatttcagagaacctatggggtggctgggatctactgtgtacagtgtaccacatcctacagttttattatacctagtgatcaagcttcgggcaacggcgacactccagtttccagtagcatcattggcagtcattatgacttgggtcaaacttttaccagtgcattcttctgatcacctagactcgctacaactctgactt

SEQ ID NO: 672798 - DNA, 450 bp, Homo sapiens
  misc_feature (21)..(21): n is a, c, g, or t
gcagaatgtttctctagctcntaggttctatagcatggtgtccagcagcagccagtggcccagcagctccctggcatcctctcaggtgactgactttgtagcaagtttcaaggtgcgatgacattctgtggacaacagctttccccagcaccccagatggcagattcccagcaagtcccatcagcaaggcactttagtgacgtctccaccaaacactaagccagggctgagccctccccatcaaggtctgcatcccagccctggggtggctctgcttcctccctgggttctctagcatccgtctctagcacaggcccagggtagcagctgctccctgtatctgccattcctgcattctttggagttttctttactcttaccatcaattctgttactccaatcccctgttaataagtctttacagtaaactttaactttctctgttcaaaa

SEQ ID NO: 672799 - DNA, 250 bp, Homo sapiens
agcatgaggctctagaataagcagaaacaatttagcaaaagaacatgagaggggcatatcatcagtgtacctgattccaaagcttattatagtagctatagtaatcagaagcaatatatcatcagctgcgggacactacacacgatcactgagatcagtagcagaaaatgcaaaaacagatgaacagatatgtccaagtgattctggagagaggtgcaaaaaaaattcaatggagaaaaaataggctttt

SEQ ID NO: 672800 - DNA, 160 bp, Homo sapiens
atggcagggctggcagcttgggagctccccctgcttatcaagtcaggctgccagtttcttgtctccgtgaaccctactctctcctttattgctgtcctcgagatttattatcaagtgcttttcgtctgggggacatgcagtcgtctgaggcaccagggta

SEQ ID NO: 672801 - DNA, 712 bp, Homo sapiens
  misc_feature (33)..(33): n is a, c, g, or t
  misc_feature (75)..(76): n is a, c, g, or t
  misc_feature (83)..(83): n is a, c, g, or t
  misc_feature (111)..(111): n is a, c, g, or t
  misc_feature (113)..(113): n is a, c, g, or t
  misc_feature (128)..(128): n is a, c, g, or t
  misc_feature (133)..(134): n is a, c, g, or t
  misc_feature (151)..(151): n is a, c, g, or t
  misc_feature (153)..(153): n is a, c, g, or t
  misc_feature (163)..(163): n is a, c, g, or t
  misc_feature (212)..(212): n is a, c, g, or t
  misc_feature (214)..(214): n is a, c, g, or t
  misc_feature (222)..(222): n is a, c, g, or t
  misc_feature (224)..(224): n is a, c, g, or t
  misc_feature (228)..(228): n is a, c, g, or t
  misc_feature (257)..(257): n is a, c, g, or t
  misc_feature (265)..(265): n is a, c, g, or t
  misc_feature (271)..(271): n is a, c, g, or t
  misc_feature (278)..(278): n is a, c, g, or t
  misc_feature (281)..(281): n is a, c, g, or t
  misc_feature (333)..(333): n is a, c, g, or t
  misc_feature (349)..(350): n is a, c, g, or t
  misc_feature (358)..(358): n is a, c, g, or t
  misc_feature (363)..(363): n is a, c, g, or t
  misc_feature (366)..(366): n is a, c, g, or t
  misc_feature (382)..(382): n is a, c, g, or t
  misc_feature (384)..(384): n is a, c, g, or t
  misc_feature (387)..(387): n is a, c, g, or t
  misc_feature (389)..(389): n is a, c, g, or t
  misc_feature (402)..(402): n is a, c, g, or t
  misc_feature (453)..(454): n is a, c, g, or t
  misc_feature (478)..(478): n is a, c, g, or t
  misc_feature (482)..(482): n is a, c, g, or t
  misc_feature (490)..(490): n is a, c, g, or t
  misc_feature (524)..(524): n is a, c, g, or t
  misc_feature (528)..(528): n is a, c, g, or t
  misc_feature (530)..(530): n is a, c, g, or t
  misc_feature (552)..(552): n is a, c, g, or t
  misc_feature (564)..(564): n is a, c, g, or t
  misc_feature (568)..(568): n is a, c, g, or t
  misc_feature (578)..(578): n is a, c, g, or t
  misc_feature (580)..(580): n is a, c, g, or t
  misc_feature (582)..(582): n is a, c, g, or t
  misc_feature (584)..(584): n is a, c, g, or t
  misc_feature (612)..(612): n is a, c, g, or t
  misc_feature (674)..(674): n is a, c, g, or t
gaggcgtttccagtgctgtttttgcagctgtancaaagatgttcccccccagtattttcagcacctggatcaaannggcaaangtgtggatgcttatgaccgccctgagcnanaccctgggctcttangaaanncttggccactgtagatnanagcaaaaaanaaaaaaatccccagccctcctgcctttatcttcatgattgacgtctccnanatgccatnangacnggtcttgttaggctcctctgtgaggagcncaaaacanagtaanaaattcnacnaagggagggtggggcagaaaagtcagcaatccgcgttggctttgtcaccaanaaaaaagagctccacnncaaaaaanagaanaanacattggcccagccananaananggttgtgtctgangtggctgacatgtttgtgccactgctggatggcttcctggtcaacgtcaannagtctcgggcagtaatcaccagcntatngagatcanattccagaaaagattgcagacacaagggaaacanaaananaaaaagaaccagaaaaccaggnaggaaaggaggnacanaaggctgctnantntncagggaagctctttctattccatacatncctgcccattgcagaggccccagggaaactgaagaacagagatgacaggaagctgactaacncagacaaggagaagactctgttccagcctcagacaggt

SEQ ID NO: 672802 - DNA, 307 bp, Homo sapiens
ctgactctagagcaaccccgcgactcacaatttacgacagacttggtatatagattatatgaagctatccagaatgcagcccagagcgaggtgcgggtaatgacacagacatgttgaaaaagttactgttgctatcactggcaacagacactcataaaacatgtaatacacaatcttacttactcacaatcaactatagaatcttcatctagattagatctatctatccagaatgcatcccagagagaggttctggtaaggacacataattcattaaaaagttcgagaggtgggttccagaataaga

SEQ ID NO: 672803 - DNA, 844 bp, Homo sapiens
agccgccggtcgccgccgccgtcgcccgccatggtacgtccgcctgtacccctcggcgcccgcggtgggcgcgctggcccgggtgccgagccgtgtcggcctggcgcacctggactattaccacggctggcaagtttgatggtgacagtgcctacgatggggatgagtgacggaaacccagagctcctgtcaagccagtccagacctacaatcggccagagcgagaacatacgagagactatgagagtccccccgataacgagctcgccaagctcccggagccatccctcctgcacctgggggaccacgaaaggccagctaagcactcgtctgtgccacgggctcagcccacaagggtctggtacccttggccttatttccttatcaggcctatggacctcccagccatcatgagtgtccaagcatgctagcacaggacagccaactgacagtcgggacagactgcccacagatccagggagatggtccactcaggaagtggtcatgcctatgactcggagccgtgcccgggcccctgcatgggtctgcccgagcaagtgctaggaccaacccacatagagatgcccatcagccaagatccagctgcatctcgcagaatgggcaatccaagagacaggaactcgcccacaagatcccacatacatcggccggagcacgcaaagtcaggcgaacaccccctctcccagtccagcattccaactccaagcgacaagaggagtcggacaagtgccattgaacacagaatactcgggcagaaccaagacgacccttcaagccgcgaccccaagaacaagaagggcccaggagacccgaagaacacacg

SEQ ID NO: 672804 - DNA, 373 bp, Homo sapiens
  misc_feature (25)..(25): n is a, c, g, or t
  misc_feature (136)..(137): n is a, c, g, or t
  misc_feature (189)..(189): n is a, c, g, or t
  misc_feature (231)..(231): n is a, c, g, or t
  misc_feature (260)..(261): n is a, c, g, or t
  misc_feature (308)..(308): n is a, c, g, or t
  misc_feature (350)..(350): n is a, c, g, or t
  misc_feature (370)..(370): n is a, c, g, or t
agatccatcgcagacagagctctancggactagacgctgggcttctgactcttcctcatcacctctcccaggagatggagactcttcagagtcctgtggattgatagggaccagacttagaagcagttggatcaanngcagattctggtggatataattgccaagcagtttcttaaaaagtcccagggncaggggagagttggatactgtgagcatcatgggagagggaanaggcggattctgaaccacagctcggtgtnngggggcagtctatgggctctgagggcttcagagaaaaaagaaactangaggcaaataggacaggttgggtgggctttctaattgagacnagaggaggctcttggtcgtngca

SEQ ID NO: 672805 - DNA, 163 bp, Homo sapiens
cgtgaaatagccgaggggacaagtaatctggtggtactctccaggacccacaaatgataataggctaatttcccgcttagtcaaaacctctacgcatattttagcaaactcattcatagcagttaaataactttcagtatatacgagcttgtattacaaatta

SEQ ID NO: 672806 - DNA, 387 bp, Homo sapiens
  misc_feature (173)..(173): n is a, c, g, or t
gaaccgaggtggtacccctagttttagaagtttcaatagcatgcagatttgagaggatgacttcaattttgaagaatgttccactgtgggtaaaaggctatccaacagcaacacatgctacagataaatctttcggaaaggaagagtcagttgatgttgcagccttccttgtngtctcatttaaagaaatctctagagccacactaaccttcagcaaccaccacaccgatcattcagcagccatcaacagtgaggcaagactgtcttccagcaacaaagactcactgaagacttagattatcgttagcatcttttagcaataaaatatttttaaattaaagtatgtacattgtcagatataatgctattgaaacttctaaaactagg

SEQ ID NO: 672807 - DNA, 318 bp, Homo sapiens
aagggcaaactttggccagtcttccgggggccggaaaagttggatttttcagcttccaatactgaagcaaaaaaaattatagttccccaaagtagggcctttaagggtgttgagccttttcaagaccccacaaattatttttgtgatcacagtagtttaacaagggttaaatgttcccgcggttgcgctgctttatttaatgccctggggaacaaaaaataagggtactgttggggggtgattataaaaacttcaggcttttagctctccccaaagtttgaggttaaaaaaatgttaaaaaatgtgggttaaagttta

SEQ ID NO: 672808 - DNA, 373 bp, Homo sapiens
gtgttatcagtattattgaacttgactaaactattgatcagatcacaaagaggtagtacaggtactttgtccagatcctagaactaataaaagctttgggaatgtacatcacaaacgtagtggttcagtgactgatatggtttggctctgtgtccccacccaaatctcatctcgatttgtaatccccacgtgtcaagggagggacctgtaatccccatgtatcgagggagggaggggattggaccatggagtcagtttcccccatgctgttctcgtgatagtgagttctcatgagatctgatggttttataagtgtttggtagcccctccttcattcttctctttcgttccactttctgacccccacccagcc

SEQ ID NO: 672809 - DNA, 795 bp, Homo sapiens
gggggccttgtttgacctgatgggagggcgaggagcgagtttgtgcgcgcgctgcgcgttgactggaaactaatcgggactgcctaacctgatcggcgattctgtcagagtttactttcgctggtggaatggctggacaaagaggtagtcaaaatgcagatcttcgttgaaaacccttacgcggcaagatcatcacccttgaggtggagcccagtgacgaccatcgaaaatgtgaaggccaagatccaggataaggcaaggcattccccccgaccagctagaggctcatctttgcaggccacagccagcttggcacagatggccgtactcttatctgcactacaaacgatccgagaaggagtcgacccttgcacctggtcctgcgtctgagtaggtgggtatgcagaatcttcgatgaagtagcccttgagccggaaaggagcatcagccgtggactgtggacgcccatgtgacaccatcgagaaattgtgaagggccaagaatcgagggataacagcacagggcatctcctccctgatcagcagagggctcatcttttgcaggccaagcaggctggacacatggccgcacctctttattgactaaatgattcccagaacgacgtcgaccctggacccttggtccttgtgtccttgaacagggtggtattgccagaatcttccgttgaatgacccttgactacgtccgacgaccatcgcagtccagaatcgttggatgcctattgacctcatcgccgctttgctgagtgcagagatccatgattcccaccggctc

SEQ ID NO: 672810 - DNA, 703 bp, Homo sapiens
tggggcttgtggaagctgtgagtggggcttgctgtggtatgggtagggcttggcatactgtggcgtggagcttgtgggtagtctgcactgggcctatgatattgagggttagggcctgtactgatcaagggtatagattatgggcttgtgggtggagcctgtagtatgtgagtgagggggcttggatcactgtgggtagtggtaatggcgctataggtaaaggcctgtattggtgtgacgttggggcctgtgcagttctgaaagggccagattctgtggacttatcgaactgacgtctatcgtcggtgcagatgcgggctacgggtcttgtatatgtggggacacgagcctgtgtagtcacctgacggggtagagctttgtggctactagtcggccagcgtccagggccaggagcgaacaggcactgggcgtgctctccatgtggtgggagtctgggtgtgtcggtgggctatgtccctcaggctagagcgttcctgggcgcatcgggtctccacctgaatcctcagtctctgccgctctacacctatcctcgctgattgtgcgctcatagtcctgactgtgcggtgcatgcccgtttgccagcgactgcggcacggaccgttcctcatcctgtggccagtagctgggggtctcacgcctgcggaaggtgacttggattgggaaggggtcgggttggtggccg

SEQ ID NO: 672811 - DNA, 520 bp, Homo sapiens
cccctacataatgtgtgccatgggcatggatgtgtggtatgcacgatagttactgtgtgcattagacatatccttcccctgggctaggcttattgtcttagggccatgtatggaaacagtgaccttggtccagaggcgtgaaaggcgggatcaacctagtagggaccgcagtgcacggctcaggggctcacaggccgagaaaaaaaagtggagaaaacgccccctcccctctctgtggggacctgggcatggcggggttctgtggattggttttgtatgtggttttctctcccgtgtcctgttggtactccagttagaatgtagggatcaggcaggtctagcttgatgtgaacttgtctattgcaaaagtggccaacagtggaacaggtatgtattagggcaatcgattccttgagttgacccatcttggatgaagaaattccacttcccagccagctgtctgtccatttgttcacctgcccatccatccttttatcccatcacagctacagaatttctc

SEQ ID NO: 672812 - DNA, 116 bp, Homo sapiens
cgtgcgacgctagaggccatcgcgctctgctctagcctgctggagtacacccgatcctcaaggctctccccactagaggcctgtgcgcgcagttcatcacggaagctgagcgcaca

SEQ ID NO: 672813 - DNA, 103 bp, Homo sapiens
caacacttcatcgggcagtccagcacagcctaatagagtgaacaccctgtctccactaaaaatacaaaaaccagggatgcctggtgcacatgcctgtaatctc

SEQ ID NO: 672814 - DNA, 323 bp, Homo sapiens
ctgaagacattcacgaggttctgaagactgctctcatacacgatggtctatctcgtggaattcgcgaagctgccaaagccttagactagcgccaagcccatctttgattgcttgcatccaactgtgatgagcctatgtatgtcaagttggtggaggccctttgtgctgaacaccaaatcaacctaattaaggctgatgacaacaagaaactaggagaatgggtaggcctttgtaaaattgacagagaggggaaactccgtaaagtggtcggttgcagttgtgtagtagttaaggactatggcaaggagtctcaggccaaggat

SEQ ID NO: 672815 - DNA, 334 bp, Homo sapiens
cgtcctaacgaaaatccgatgatgtcaccatccattagttcctcaagggctttctcaagagacacgtcatagtcctgaattctctctgttaactacggcttaacttccatcatagaggctacggctagtctcttgaataaaatcctgctcagacacacataaataggagcaagtcacgtaatcttcccggatatcggtgtgtagatatgaccacagacaattcaagcaacgaagataatagggatcatacatcttcagcaaatacataacatcatagatctaaatacaaacttgggtaaggacgatccactagccagccagctcgggaatcaaa

SEQ ID NO: 672816 - DNA, 143 bp, Homo sapiens
cacccttcaaagacatcgcggtcttgcacttggcgcgcgctctcagacatcatcacatcatcacatagacacacacacagcccatctccagcccctgccactgtccagttctcagtcactatgcgggacactcctcaattcct

SEQ ID NO: 672817 - DNA, 707 bp, Homo sapiens
tttccggcccccaaatgccggttaaaaaacgccaccatttgttttgaaaataaatccaaaaagccgtatagtggtgaatttttctaaaaggaatccaaggaggttgaataaggcctgcttctccatggggttgcaaatgttgggctgtgaagggaaatgacagcctccctttcgtgtgatttttttaccgatggcacacacttcagggttgggcctgtttcctggaccctgctgtggcatcttcttttgtcactctggattcaagtgtgacgacttctcctttatagggtgcacgctccacaggggtaggtgtgcaagtccgctctccctactttattcgtttgtaaatatattcaccaaatggttttcgaggaataaacttcccatctcctgccgtgacactgaacactccgtcttcatataccactttgcctcttgaaatagtcacaaggggcacaccgtggcaaaccatgccttcgaaaatgttgaagttaacagcctgatgatgagtttttgctgagatagtccttgtgccgttcgggtgtcatactgcaaggtcggcgtcggacccaccagctgtttttccttttcttggatagagattaaaaattttggctgcatttgtgctggtaactgcaacaaatctgttttcatccattttaccgctatgcacgcctttttaccatttgcgctggattcgaactcct

SEQ ID NO: 672818 - DNA, 247 bp, Homo sapiens
cggccatacaatttatggcatctggcctgttcttcctctgactgcctctccccctgtgtgctttgctcatcccacactggcctcctcgctgtcctgtgaacatgcccaaccctgcaacttcctcaaagactttgtgcctctcttccgtctgcctggaatattcctcctcctagatatcagcacaactccttccctcttcatttccttcaggtctccactcacatgtctctgcggacacgaatgttca

SEQ ID NO: 672819 - DNA, 1060 bp, Homo sapiens
  misc_feature (66)..(66): n is a, c, g, or t
  misc_feature (282)..(282): n is a, c, g, or t
gctacgaagcacagatctgaagactagcatgtacacatgccagttccccaggagatggctctccanttcccagtgctctagctgcacggatccgaggcctagcatgttgtgagctgaggatgtgcagaatgctggatagcctggctgccattgtgagcgcagatgagataccacgaggacggttcttcgttacatacgcgcggtgactttgcctaccgtaagtttgcttgcaagcaactagttggctccgacgtacatgcacgtgtatgtgccctagtctgncgaacccttgtgagcgtactacgcgcgccatcgacatgtgccagtccgctgtgcgcacttgactggcaagtggcgtgcgctagtcgactctgttgctcgcgctcgttgccaccgtctaagtcacgcctagcgtggggtagatccagtggcctgtggcgagcaaccggcagacgtgtgggcaagggcgaactgaagtcttgccacatcagttccatgatagactaacatttcacgcagcggagcgcctctcaacgttactcacggcacagtgctcggtagatgggaagatcagcctatttacactaaggactcatcctactagcgagacccccagtcttgcctatcacacgaacactcttaccgaggttgaacggtggaacgcaagaacattcgcgtgccactcggatgccgcgcgcatctagaccttgagggacacgttttcatagcgactaggggacgtgcgttcactccttggacccttgggtccaagacacaattcttcagaccctgggttgtgggatggacacatgttccaatcattccttggaacctgcatatcaaagggtcgcatgcggatccttggccccttgggtcccatccagtggtaccatgtcggagcagaatagggtggcacatgggctcgaccgtgggcagtattgggtccacttgcttgggggaacgaatccctggcgtgcatcatttgatcccagtgtgccttggtggccccaaaagccttgcttcttggactggaggtgcaatcgcttggagggccagacct

SEQ ID NO: 672820 - DNA, 377 bp, Homo sapiens
  misc_feature (348)..(348): n is a, c, g, or t
  misc_feature (354)..(354): n is a, c, g, or t
gcaatacaagcttgccagtttttgccccaacagataatccaatgaaggctgtgaaccaaaattttggctaaagcagtctccatggcagtttgatttttaaaggccaaacctcccacgacttcaaagcagggtgtcacatgttaaccaggccccctgcttagagctgcagcacaaaagcctgggatacatgcaactctattccactttccaattcaacagtaaacttcagattccaaacaatgttgggggccaaacagcattgcaactgcgggagaggaaaattctaagggaggggttaggaccttcaggaacctcttgccaagaggcttcctctttgggagttggctnggggtnccgcaccaaccaaggaaggccat

SEQ ID NO: 672821 - DNA, 121 bp, Homo sapiens
aagatcctttcaggagagagaactggtgcctggaagctgctggactccagacccatccagccaggggacgcaggcattgttgaactcctctatactcctgggcactggttgacagtactga

SEQ ID NO: 672822 - DNA, 486 bp, Homo sapiens
  misc_feature (100)..(100): n is a, c, g, or t
  misc_feature (103)..(104): n is a, c, g, or t
  misc_feature (136)..(140): n is a, c, g, or t
  misc_feature (329)..(329): n is a, c, g, or t
tcttcgacgagttgtccgagttactctggtcactgtaatactggttctccattaaaatgtagatgctttgtctaattccacttcaagatcacttaattgngcnnttgtaactatcaactatcaaattctagtttcnnnnnctcactgtacctatatcatatctgttctcaactttgtttgattctccactcattttcaatcagagttgaagccttctttgcctttcttctttgtcttatttctgccttcatctcccacttctcacccaactctgccactgttcaggagcagttgactaaacttttatccttcctgtaacttaatctttntatccttctgtttttagttcttacagtggtaatcacatcagtttggcaatctaagatgtctctatcaagggtcagcccttttctatttggagctgaatcttttctttctgtagaaatctacatgtatttacaagacatgtatttttatctgcaggat

SEQ ID NO: 672823 - DNA, 131 bp, Homo sapiens
cgtctctaggatgacgaagtatgaagcttcagcttcagtatcagtccttccaagggatattcagagtagatttccttggcggatggacgtggtttgatcatctttgctgtccaagggactttcaagagtct

SEQ ID NO: 672824 - DNA, 591 bp, Homo sapiens
  misc_feature (159)..(159): n is a, c, g, or t
gcttgagcgtgggcttcatcggcgctggccagcctggcttttgccctggccatgggcttcgcatgcagcaggcgtcttgtgctgcccacaggataatggctagctccccagacatggacctggccacagtttctgctctcaggacgatgggggtgaagntggactaccccgacaactagggatgacggtgcagcacagtgatgtgctcattctctgcgcttgtgaacgcctacgacatcattccctcttctatcctggtagtgagcactaggcgccgacattgaggacagagcacattgtggtgtcctgcgcggccggcgtcaccatcagctccattgagaagctgtcgagcgtttcggccagcccccagggtcatccgctgcatgacccatcactccagtcgtggtgcgggagggggccgccgtgtatgccacaggcacgcacgcccagtgtggacgtgacggtgaggctcatggatgcagctgctgagcagctgtgtgtgcttctgccctggaggtgcgagaggacctgattgtatgccgtcacggggctcagtggcagcggtcccggctacgcattcacagccctggg

SEQ ID NO: 672825 - DNA, 702 bp, Homo sapiens
  misc_feature (447)..(447): n is a, c, g, or t
  misc_feature (695)..(695): n is a, c, g, or t
agccacgagaccctatttccaaggaacataagaaataccgtatgcacaaataaagtatttgccagtgaaattgagacccgattcaaacaccctacagccgtgaggacacgctgcagaactttaacctcgcgctgtttcgcatgtacttgccgctaatccttccgcataaggagtaccctcgcaataactttagaaggatagccaacagtaatagcgtcggcaccacacaaggctccttataagaggctaataaaggcaaacatcggagtattacaacagctcaaagagagattgggagatggcataaacccatctggcctgctgataacgtgtagcttccgaaagtgacggacaggaccgctcgaagtggacgcactactccccaaatacccgctgatatactactgctagaacgacaaggagcaggtctatacatacctgcgcaanactctggtcgctgagtacaggaggaacacccctactaggtgtccaagcggtaaccatgtgacacagcgcgatgcgttccatcggcccttaagggacacctgtcaacctgcttctcctcccagaatggccccgctatgtacctatacacaagaggaaggatgtttatattacacgatggacatataacccgcgtaagcgtgcgttagacaatgagacttggcttgctatatgcaggcttggatttaccnccgggcc

SEQ ID NO: 672826 - DNA, 921 bp, Homo sapiens
tcgtatatcagaataactgttgctgtcgttatgtagtacacttacccggccttacgggatggtctccccccaccggtaaaaacacggggcgcccatatatccctggaggtttttatccggcgcccgggatatattctcggcccaaacaaaaacggttcaaaacttccccagggaaacggcaacctctttcctgaaatgtcagcaaaaatatggtttccagccacaagacccaaattcagttcagaccaggtagcggtacaagacagtccccatactcctggccgataaatcacagggtttttctccccggtgatttactactaggccaatattacaacgccgcggcccatcccaaacatgttcaaaaagtaggggtgaagatggaaaaaaaagcacaaccaaaagggttgttaatttcgggagtaagcccccccccaaccgtgattgtataccctggccgcccaaagcacgtgtaaaaaatagattgcagcaagcactccagtgtggacgcagaaattaggcgcactctactcctccaaaagcatccgtgtcaaagcatcgtgagttgaaccgcaccgaaagggtccaaggaggcgttcactctagcgtattgaaagaactctgctgacagctgcattaaggttgatctaagaattggcattctccgtttcattcaagagaacaaataggtatccaagaaagaccaagataacaacccgaccgcgggcgaaccatgtgtctgatcaactcccacagatgatgacttcaaaaggcggttgggccccctgctgataaccctttgaggagagtttggtggaattactgagaaacactcctggttatgtcaccaggaccccttctggatcgtgcatgaatgccccccccttggatcatttagaccccccccccccaacatataca

SEQ ID NO: 672827 - DNA, 329 bp, Homo sapiens
tatgggtttggcactatggtggtgcataggcaagacaattttgtgataaggcacagatcctgaactaacctgtaagacttgtctggtttttggacaggtaaaatgggggaatgtaaggagagtttataggctttagaaggccatgctatagcaggcgagtgataacaggctttaatccttttaaagtgtgctgtgggatccttttaaagtgtgctgtgggatgggatattggcattgagtggggtaagggtgattaggttttgatgggatggtaggggtgcatgatcggttgccaaggagggaatagaggtgtcctcactacatgccat

SEQ ID NO: 672828 - DNA, 817 bp, Homo sapiens
tacgagaaagagcagcagacagtgaccaaactgcatcaattgtggagaatcaaaagaactcttctgtacccctggcagagcattgcagattaaagaagcattgagaaagaagtggaatcataaaagccagctgagagaaaaggaagaagaaagccaaaacaaaatggaagaagtctccaaacttcagtcggaggttcagaatactaaacaagcattaaaaaaattagagactagagaggtagtgactgtctaaatataaagcaacaaaaagtgattggagacacagatttctagcttaaatgaaacaatgggccaatctggaatcagaccagtcatgaggcaagctcatgtgaggaagctttgcatgccacacaagaaaggaaatatctgccaccagatgcagcaaggaattactgcattccagcaattgcagcaagaccacttaaggcatccagaaaggaccgactgtgataagtccttaacaacaatcaacagcagttacaaaagaagaatacaagaatctgctaaacaaatagaagcaaagataataacgataactgaactgttaatgatgtggcaaagattaaacagggcactcaagtggctttcccaactcacctacacaaagtgggaaccccatcaagaggcagagcgagttgatggacactctgcagcaccaagtgaaatctctggagcaacaagtggcgatgctgacagacagcacaagacgtactgcatttatcggaccccttcttagtgtgacggtccctggtgagtgtcaggaggctgtcaatccaaaatgcggggttgtgcaatg

SEQ ID NO: 672829 - DNA, 719 bp, Homo sapiens
  misc_feature (626)..(626): n is a, c, g, or t
gttttccacatcaggtgcattgcactgttagatgggtcatcataaaggtcatcaatctagtggcattcattcaatttgcacatcctaactgtttcagcactatctgatttagcatgaaaatctgccagggcagtcccttgatattcaggttcagctttccatgtatgggcttcaatcttataagaatttgttatttatttttcacctttactcaagatagcttggaacttataccaatttgtgatggcaacaggatagtagcaagttcatccacttgagtctgtttttaataggggctccactagaagtgagaaaccctctttgtttccataacatgccaaaattgtggactgcaaaggcatgtatatatacatagcatgtctgctatgtatatagcattttctgatttccctttagctatatgataagctcaagtgagagcaaaagttctgcagtttgagctgactgaaactgggaagagtccgctttttattaactcattttgggttttaatgacatattttgccaaagaataatttcaaatgggggccgggcgctgtggctcacgccgggcgtggtggcgggcacctgtggtcccagctacttgggaggctgaggcaggagantggcgtgaacccgggagcggacttgcagtgagccgggatcgcgccactgcactccagcctgggcaacagagcgagactctgtctcaaaaaaaa

SEQ ID NO: 672830 - DNA, 730 bp, Homo sapiens
  misc_feature (583)..(583): n is a, c, g, or t
gttttccacatcaggtgcattgcactgttagatgggtcatcataaaggtcatcaatctagtggcattcattcaatttgcacatcctaactgtttcagcactatctgatttagcatgaaaatctgccagggcagtcccttgatattcaggttcagctttccatgtatgggcttcaatcttataagaatttgttatttatttttcacctttactcaagatagcttggaacttataccaatttgtgatggcaacaggatagtagcaagttcatccacttgagtctgtttttaataggggctccactagaagtgagaaaccctctttgtttccataacatgccaaaattgtggactgcaaaggcatgtatatatacatagcatgtctgctatgtatatagcattttctgatttccctttagctatatgataagctcaagtgagagcaaaagttctgcagtttgagctgactgaaactgggaagagtccgctttttattaactcattttgggttttaatgacatattttgccaaagaataatttcaaatgggggccgggcgctgtggctcacgcccagcttatttttngtatttagtagagatggggtttcaccgtgttcgtcagggctggtctcgatctcctgacctcaggtgatccacccgcctcggcctcccaaagtgctgggtcaactatgttcttgagtaagaactcctgatgcctgattgtaatgttta

SEQ ID NO: 672831 - DNA, 106 bp, Homo sapiens
ggcattctagagaatgagttatttgaaaagggttttgaagtataaagcgttggggaattgggggtaaataagaccatattgcccatttgctaacgaggagtcgtat

SEQ ID NO: 672832 - DNA, 962 bp, Homo sapiens
  misc_feature (529)..(529): n is a, c, g, or t
  misc_feature (600)..(601): n is a, c, g, or t
  misc_feature (610)..(610): n is a, c, g, or t
  misc_feature (613)..(613): n is a, c, g, or t
  misc_feature (617)..(617): n is a, c, g, or t
  misc_feature (624)..(624): n is a, c, g, or t
  misc_feature (629)..(629): n is a, c, g, or t
  misc_feature (707)..(707): n is a, c, g, or t
  misc_feature (713)..(713): n is a, c, g, or t
  misc_feature (732)..(732): n is a, c, g, or t
  misc_feature (738)..(738): n is a, c, g, or t
  misc_feature (757)..(757): n is a, c, g, or t
  misc_feature (770)..(770): n is a, c, g, or t
  misc_feature (783)..(783): n is a, c, g, or t
  misc_feature (801)..(801): n is a, c, g, or t
  misc_feature (818)..(818): n is a, c, g, or t
  misc_feature (841)..(841): n is a, c, g, or t
  misc_feature (953)..(953): n is a, c, g, or t
gggagggcacgtcgccccgccccggtccgcccgccagctgcggcggcgcgtcgggaagtgcttggggcggcgagcatggcggcagcggctgcaggcctgggcggcggcggcgccggcccgggacccgaggccggggacttcctggcccgctaccggctggtatcgaacaagctgaagaagcggttcctgcggaagccgaacgtggcggaggccggcgagcagttcggacagctgggccgggagctgcgcgcccaggagtgtctgccctacgcggcctggtgccagctggcggtggcgcgctgccagcaggcgctcttccacgggcccggggaggcgctggccctcaccgaggccgcccgcctcttcctgcggcaggagcgcgaacgctgcgccagcgcctggtctgccccgccgcctacggggagccgctgcaggccgccgccagcgccctgggcgccgcggtgcgtctgcacctcgagctgggccagccggccgccgccgccgccctctgcctcgagctggccgccgncctgcgcgacctgggccagccggccgccgccgccggtcacttccagcgcgccgcccagctccagctgcccnnagctgcccnctnggcngcgctgnaggcntttgggcgagggccgcctccttgccaagctgctgggcgcgcgaactacaccgcgcgccctgggcggtcttcaccgcgnatgcangcgcctgggcgcggggagnacgggnagccaccccggtgcaagtnactgccgcccgcncccgcccgccggnaccccaagcccgggcccnggggcaacgccgccccnacccggccgcgctgcttcctccnaactccggctcggcggcgccctctcccgccgccctgggcgccttctcggacgtgctggtccgctgcaaggtgtcccgcgtgctgctgctgctcctcctgaaacaaccggccngcaaagctg

SEQ ID NO: 672833 - DNA, 97 bp, Homo sapiens
gccagcgccgagatcctggcggcctaccagctcctcagtgcacccccactagcaccccaccccgcatctatcgcccaataaaggcatctttgccggg

SEQ ID NO: 672834 - DNA, 125 bp, Homo sapiens
acacaaagtacctgtgtacctgaccatgtcaacatgagttgagctcatcaagataattagaaggcgcttacagctcagtgctaatccggccttctccctgttcggtgaccggacacagcactgga

SEQ ID NO: 672835 - DNA, 860 bp, Homo sapiens
  misc_feature (675)..(675): n is a, c, g, or t
tgacatagagagggcgagccgactgtagatctcttctttcgtaggtaccagaccttcatcatctctgagcaaaaccggattatttctgaccattctatacagattcaaaccgtcgatccgtcccgccggatcagggttaatccaacgctgtaaccacggcacgtagtacctgaacccatagtaataaagccccgtcgcatcccgctccttgcccgaataacgcaacgtgcgataactctcttcgctcgaatcacccttctgcgtgaaggccgtcgtaccaaacggatgatacgtctcgcgagtgatgatcctcgcttcactgtccagttccagcgaacaagagcccagatgatcgctaagggtgtaacggtattgatcattcgccagttgctgcggcgccgcgccttcccaatgcaacacctgcaccgtggtgcggccggcctggacggtgacgacgtgcagtttctcgccatccccatcgcgcgtttccagccctggtagatatcgggtctcactgaccaaggtgcgggcgttggtttgcgtcgtgcgcaccttgcgctggcgcatgccgtcggcaccgtagacgtagcgctcggtgtcattgaggcgcaacgtgcgctccaccatatgcacatggctcagttggttacgtgcatcccaactcagtgttcggcncggtccacatcacaggttgccgttggcatcgaaggcttcggcaatctcagcttcggtcggtggcctcccgcccacctcgggcaggcagcgattactgtgcttgccgccgtctacacacgcccatgttgctgtggccgtggtggatcagctcgagcaatgccgccagctcgtagcatagtttgaca

SEQ ID NO: 672836 - DNA, 103 bp, Homo sapiens
agacactcctccttgtgttatttgcactcctcttctccatgctggcacttgaactcccacctgccactcctcttctccatgctggcacttgaactcccaccag

SEQ ID NO: 672837 - DNA, 604 bp, Homo sapiens
  misc_feature (524)..(524): n is a, c, g, or t
tcgcgtagtctggaggctgcgaagtccaaggtcaaggagtcagcaaacttggtgtctggtgagggctaactttcggattcatagagctctgttttctccctgtgtgctcacatggcagaaggggcaggcagctctccggggtccctcttataagggcactaatcccactcatgcaggctccaccctcatgacctaatcacctcccaaaggccctgctgcctgaaaccatcacatttagggttaggatttcagcctatgaattttgagggggaaaccagcattcagtccaggtccataacaatggtcaaatcccatctaaaattattataacacaaagaataaggggcagagtaatgtccctacaaacaggaaactactccaggaaggcacgcccagaacatagaaactggaccctaataatgcatcaatctgagaggaaggccaggtaggtcaggagttggtcatagctcacctgggtttagggtgtgggacttcattatactgttctagtctgccttttgctngtttacttttcaagtatttgcctgaaatcttaaatattaacaaggtatgaaacagggatcaatgaaacacatcatggtat

SEQ ID NO: 672838 - DNA, 853 bp, Homo sapiens
  misc_feature (664)..(664): n is a, c, g, or t
gagagacctgtctgctgatgtaccgtggattgctctcagtctgggactccgggatgcttcggcatatcccggccttgagctcgtctcctttttgaattgagaagaagaagaatgtagaagcaccatcttcactcatcattggccttagcaagtgtgcgtataggtttgaggctaacgacgagatacgtgttgagtccgtgggatgcgatcgttggcttatgtccaaagacatcggcgagcgtggcgttcctggctggaggactgagctacacgtcagtctagccggcctgggtgccttaaccagctgtatccaggatccaaggaacgtccggggttctcctagaccgctacatctgtaacttgggtaggtgttatgggaatgagatcttactactatggaaaattcatgcctgtaggtttaattgcaggtgccagttgctgatgggcgcaaagttggagtcgtatgtgatgacatctgattagcagaagtcatgtccagcttggactcatgaaggattaaaaatttgatctttccactattttcaaatcgttcacgagaaataaggtgcagcattttgtgccattctgaccaatttaccctaaacgacaaaacacacacccgcaatttttgggccggagtggttgcaacaactagggtggctancattgataacgctacaacaaggtggtagcttggtaccattgagtattgacaccctcatacaccaccgccttgggaacgtcgaggcatcccccggaccataggcaaccccgggtcactgtggtgtccctttgaaccgaacccaatccgtcagcagaaggatcaaccgcaacaaacactctgcctggccag

SEQ ID NO: 672839 - DNA, 171 bp, Homo sapiens
ataaccaatatatactctgctaaatataactagttgagaaagtccaccaaggggttggctgaacgatgactgagctggacgggtgtggtggctcatgcctctacaggcctatttttgaactctctattctattcctattatgtctatcattatgccaatgccacagggggg

SEQ ID NO: 672840 - DNA, 342 bp, Homo sapiens
actcttaatagtacctggctgaaaatatttgagaaagagaaaaaggaagagattggatcaaactctggacttcatggtttcttaaattcactctgcaagtttttgggttttttgttttttgagaccaagtctcacgctgtcaccacaggctggagtgcagtggcgtgatcttggctcactgcgaccgctgcctcctgggttcaagcaattctcctgcctcagcctactgagtagctgggactacaggcacatgctgccatgcctgactaatgttttgtattttagtagagacggggtttcgctgtgttgcccaggctggtcttgaactccggggatcctcta

SEQ ID NO: 672841 - DNA, 823 bp, Homo sapiens
ggccaacctcctactcctcattgtacccatttctaattcgcaatggcattcctaatgcttaccgaagcgaaaaattctaggctatatacaactacgcaaaggccccgaacgtgtgtaggcccctagcgggctagctatcaagcccttcgcgtgacagccatgaaaagctcttcaccaaggtagcccctaacatacccggcatatctatccatcaccctctacattcaccgaccccgtaccttagctctcaccatcgctcttctactatgaaaccccacctaccccataaacctatgctcgctctggtactaatctcaactctatggtctcctactttattcttacaccaaccgtctacctctgaaaccagtatgccacttcgaagtctctcgtggagtcaatgggtggaatcgatgctagtgctcgaaatcttacagcgccatgcatctggcagcgacatggcgaatgcgagatagcaccagaaagttgcgtgcaattatggagaggtctccacttagaccaaatcagtcttgtatctactgcaaagcaattacttagatccagatggattccctctattaacgctcgttcaccggcgttatatcacaaacctacatgaaccccagtcatgaattactccctgcccataatgacccctaggaccattaatactcgataaatactacaaaaataagcaagagaaccaaaccgaaacccctatcggaacttgcacgaagggggagtccggaacatagcttcttcaaggcctccaacagtcgaaattacgcggcaagggcgcatttcgaccttaattctgcaatag

SEQ ID NO: 672842 - DNA, 729 bp, Homo sapiens
gatgatgaacgagtttctgcagcagtaccggaacgcagcgaatggaacgagatgcggcagtaggcttcgacaaggggctcccaacttcaagcaggtttctatgacgatcgtccaggtggagaaagggattgttgtagacatgacttgagtaaagaacagaaaagcattgtcatcatggttcatatttatgaggatggcattccatggaccgaagccatagaatgtggttgcatgatctgccttgcctgcagagtacccaagctgtcaagttctgcaaaggtagaagagctcagttattgtgcgccagctagtcagtatcaccaggaatgctccttcctgcgccttgctagatactatgaaggggggtgaattggatcgtgcaatggctgatcgtggttgactgaccagctgggggatagatttgctttggcagtaggaccttgacagcttttgctaccaggaatttggattactcccagaaacggaagtctaggtgctgacatctgtgcgtaactctgccacgtgtcacagggaggctagcgagctggaaatagattgaactagatagtctagttgcatagattgctcagtcgtcagggttggacatagcacgtcatggtcatgaagttccttgtcttctggcttatcagctgtacttggtagaacccttctattatgccgttctcatcctgaacattccttagattcaatcagagacatgccagcaaa

SEQ ID NO: 672843 - DNA, 879 bp, Homo sapiens
  misc_feature (3)..(3): n is a, c, g, or t
tgnccaaagaaaaaagcaacgaaggaggaagaagaaaagacactctgttgtgtatctctcttgggccctgcttccagatctccgttaggcgacaacttttaattctctcaacacggcgttgatatccccggcctcaggctatgtaatcttacccgatccgtggtgtttggcccccttgccaaggcacatatatttcctttgtaagaacacagcaatcatccgttcgggcaaatagttccgcacattgccgcattattttgttgggtccgacccaggtgcccccatctatgtcctggctccaggggatctaatcttcccccctcccccttccgccaaatgaaaattttttccttattgcagtcgctaatatacaacctatctcccgcaaaattgctctcttcttttcaaccccagccatctcaacttatcgtcctgcaaccggtcatttcatatttcccccaatgggcaaaacaatttataacaggcctctattcaatttttttctcgaagaacaaaacaaccccgttgcaagtatcctatgtattctccaaccgcccccacttgtgtcaaattgaaagtacccccgcgatactatttttgcccccacaggacctcccggcctatttttcggaaaataacaacggcacccctcttcttctttccaacaaagaagagagggggcggacattttccccaatgcccctcatctattggaacagaatctatacaatctttcttttttcaaactaaaaaccgccgtcgttccacaatacaatctccccaaagagggcgttcccaaaatgcccccactcttatatccgggtaaaaaacggtaaaaagggcccccttgaaaaaacgggaaacccgccccacaaaaca

SEQ ID NO: 672844 - DNA, 353 bp, Homo sapiens
  misc_feature (281)..(281): n is a, c, g, or t
  misc_feature (295)..(295): n is a, c, g, or t
gggcatggcaacctgctctcctgggtggggctcggggaggagacctctctctgcggcctcctccctctgatagtgggacttttaaaacttgatcaaaaaaataataataaattaaaaaagaaaagaaaagacagcaaacaagcacaaaagagcaggcggggaaaaccctaggtaggaatcaatgaagcctttcaaccttcttccctgcaaaagtctgcatttctcttgtctttgggaacccgctgaatggctgggaaactgtttttaataaacaagagttnaaacgctgagtctncatagccaacagtcacgccttaaactctaaactttacatgaaaactctcccaggtcct

SEQ ID NO: 672845 - DNA, 122 bp, Homo sapiens
acacaatcagtacacacgaatgagcatgtaccttctcctattttcgacttccattatctaagcaccttgtactggtagaagggagtagctgaaaaaaatccatgcaattgtagtttgtccat

SEQ ID NO: 672846 - DNA, 192 bp, Homo sapiens
gcccagttccaaagatacaagactgactacatggaattctgaacgtgatatgttagtaaagccatttatttcttagctttaggaaaaactgtcctccagaaagttttcttgcttacttttcgcctcctgatactacattttaaaagactatatatgggccgggcgcgatggctcatgcctgtaatcccagct

SEQ ID NO: 672847 - DNA, 487 bp, Homo sapiens
aactacgcagctataccaagatacgagaacaccctgggagatgatcattcgtaagtaacctatccatatatatataatctatgtttaaaaaggtctattcacgctgtcctcctggtgaaatggtagaaaaatacgttcagcacttaaaagattccgtgaattagtagtagttgttgttgtgcaaagaataaaagaaatcatgaacaccgcttattcagccacacagtgctttgctgtcatttgacattaactcagaagggaattcagaagcctgcaaggacaggatgctgatatccgtgttgagggtggtcagcggcgtcctggacgcctggttctgcccgggtctctggtgatagcaggctgacaatagtgggatgcgagtccaggacgatctgcaggtccaagatgtagtcgatagacgtgcatgcaggatttccatcttgctcaccttcttgttctgggggatgctgagcaccagctccttgag

SEQ ID NO: 672848 - DNA, 972 bp, Homo sapiens
  misc_feature (548)..(548): n is a, c, g, or t
tatgacttgcaggccagatatctagtactgcaacggccagaaactgggtatggtagctgctgcccgcgtgactagcagcgtggacgtggatttggaataaaaagtgaaagctttaaggggtttccctacaaaacattttcctttaaaatactttggaaagggcgtataagcagttgactttcacccttggagagcatcaccacgtggtggtgcaaggttccaggtgattggtgtgaccctccccgagcccctccgggctctcttatagagtaatcggggggtgcggtggcgacttccctctcaaatcttcttgggccgcgctccatttccttattcctcgtggaaccccagtggagaagcgggaacaacctttaacggggagtgaaataaatttctcacacactgaggtggtacactctaaatccccatttattaagccagtgtttcgagggaaaatttcaaagagcacacattttgggctcctgcggaaacagtggcgtgcgcggggaaagacctataagtgggctgtctaaacagtgtctaagggnataatttggggtcaaacatataaacgcttgtggacacatgtgcgggtacacattgtggcagccccgtgtgttttgcgggctcacgaattgtgggggtctccacaacgttttctatacacctgtgggggtaagaggggtgtatacccatatataattctccatatgtatttataaattgtgtggaaaaacaactttaaccattataaggcaaaatatatacttttaaagttttcccccagtggagattattattccaaactatttttcgtggccccaatataagaaggggggactaatcatgagaattaccgcgggtaaaaatcatcggtgggaaaaagaaaccactttctttgtaattaacagggtctgtgggaaacctttccggggggagaatatagagggaccaggaatatacctatggggg

SEQ ID NO: 672849 - DNA, 103 bp, Homo sapiens
cgtctgatggtctaatgggatggaatctccctagggacctggggaaactcagataccgagatggtcatttggattgggccattgacgggtaacgtggcaattt

SEQ ID NO: 672850 - DNA, 144 bp, Homo sapiens
ttcatcttctgaatccatgttaatatgccacacctttacggtctaatcgtccacctcgaccgagttctgtggatatagttttccctgattggtgggaatgtcatagtttatgactaaagaaacctgctgcatatcaatgcctct

SEQ ID NO: 672851 - DNA, 289 bp, Homo sapiens
ccccttccccgggtatgaattttttcgttgaggccgtttaacttcatttagttgaagggattgattcagttcagggttggaacttctttttgaacctcaccctaataacctgtctaaacatcagggttaaaccttcttgctaacacagcagtattgcttgttaagactgcctcacagtccatggaaatgcttgcccagagaggccaaactgccttaactccttaacctgagctcattaaaaaaaattcaaaggactgattccttgccacagttctacccggggaggggg

SEQ ID NO: 672852 - DNA, 219 bp, Homo sapiens
ctcaccaaaaggccaattaagtaacttcctctctttcctcttcccactcatcctaaccctagtcctaaatcaataagctattcccccgtagaatctcaattacaatatatacaccaactaacaatgttcaaccagttactactactaatcaatgcccataatcatacaaatcccccgtagcacttaggatcctcccgatatcaaccctaaccagatgct

SEQ ID NO: 672853 - DNA, 303 bp, Homo sapiens
tgcagtattgtgtatttcatcatggggaagatcatcagaccaggagttaacggccttggttctttagatgtgggggagggaacatgcagcggtacactggtcaggtgcctgacttctgaagccagatggacacacgcggcttgtggaaatagtggtggcacggcagctcagttgccacctcccccttcacatattcgctacagcagatggggcagcacatctcctgaccaactgcgccatgatcttcagtgaccaggatctcgggaagagcgtcaatgctctccttgggagtcgccctttcgt

SEQ ID NO: 672854 - DNA, 178 bp, Homo sapiens
  misc_feature (28)..(28): n is a, c, g, or t
  misc_feature (30)..(30): n is a, c, g, or t
  misc_feature (38)..(38): n is a, c, g, or t
  misc_feature (41)..(42): n is a, c, g, or t
  misc_feature (50)..(52): n is a, c, g, or t
  misc_feature (54)..(54): n is a, c, g, or t
  misc_feature (56)..(57): n is a, c, g, or t
  misc_feature (95)..(96): n is a, c, g, or t
  misc_feature (178)..(178): n is a, c, g, or t
gcattatctggctatattaaaacctggntntctatttnccnnctatcagnnntnannaccaattatgttttttcaatgctctataagaatgaaannggaaattatatttcttttttctgtaaaagagttgcaactactttattatatttagaaatccaataaacttcttattacattn

SEQ ID NO: 672855 - DNA, 183 bp, Homo sapiens
taacatgtctggtgtgctttccgtgtttttaattgatatcccggtaatgccatgttagccaggctggtcttgaaatcctgacctcaggtgatctgcctgcctcggcctccgaaagttctgggattacaggtgtgagccactgtttctgtttaactcctctttttccttttggcccttatcgag

SEQ ID NO: 672856 - DNA, 305 bp, Homo sapiens
cgacgggtccttacgtggttcacaacgggactctgacacagctgtgttttgactagctattcctctcttggtcctgaacacaaacctttgatctgcagaggacattcttcttggggtgggtggtcgggtctatctgtctcagacacatcaaactacagaccacgaaaactgggaagcagaggattagaataaacacctttccctccggatccggagccctgatagactcgccctcttcaacaaacagggctctgtccaaggcactgggggccactcatggagactagggcattctcaggccccca

SEQ ID NO: 672857 - DNA, 764 bp, Homo sapiens
tcattaatgctagggaaaaaccagcagggatcatgtcaggttcagagcatgcacaggccccgccctaagggaggggggatgtgttgggggaggggctggttccaggtccatcccacagcgtggtccagtgggatctccttagtggcgaggcgtggctgtggtggcttttctctctccgtggggttctcttcctcctccagaataggggtcgtgcaggagtcttcgtgcttagcatgtgtgggtggccagaggacgtgggtggagtggggtggcgtggaagcagcgcacagtgcttccacgaggggaccgtggtcgtgtctccaggagactatcagtgatatgtggtctcaggagtggaaaaaacctcagtgggtctcaagaatcgtgatactctccgtgattcgggtcggccatcttcttacgaggggcacattctataagtgatttcacatccttccgcgatccggcctcgtgacacttttagcagggtgggtacacagacagtcgacacgggtcaaagcagacgctgtggggcccagcgggacaatggatgggagcaaccagcccagttcaagccatcgccagaaacatggtccagctgtgacctcgtgggtctccaacagggatgcggtaacacgaatggatggggggctcaacagccgggggaactccacaactcatcgaggtgatgacgccttgtgggcgggggtccggcaaggggccgagaggacccaaagggtcggagaccaatggcggcagaaacg

SEQ ID NO: 672858 - DNA, 322 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatgggggcccctttggcccaagggtttttaaaatcgggaaagttttttggggggggccaaaatggggcccatttgggaaaatcccccttagggggggggtttaaaaaaaaagggggcgggttttaaaaaagggggggggggaaaaacccggggggtccccaattaaaagcctttggaaaaaaaccccttttgccaaggggggggggggccccccccc

SEQ ID NO: 672859 - DNA, 1170 bp, Homo sapiens
tccatgccctgctgcacctgctgctcatgctgcccacctgcctgggcttccctgcgcctggacccatgtacctctgtgctcccctgtgggcctggaccgaggcctgcaagcagcgccgcggggtgtggggctggacccaggagatgaaatgacaacgtcaaccctccagaaagccatttgatcttggtgacgaaaggccacatgagtgaggacaaaagccaaagaactaacgagtgaggctgctgcgtgctgtaaccaggccattgcgggtgagaagctacattcactcccaacgacataatccaagatactgcagggaccgcaacagacgacaccaaagtggccaaagggaagaagcaaattccgaagcccaaaaggttgccgttagaccagattaacccatttaagaaaacccgttgtgaccccggaatgaacacgccctttggacatcgtgagattttattttaaaacggacaatggcacattatgaacagcaaagaaccaactgagtgcaaaaatgacaactgagccccaaagggtacaaaaaaaaggcacggaaaaaccccaaaagcaaagtttggacacgcggggccaacaccgcgagggccacggaatgaacccaaaacggttggaccccaacagtacgaagcacacggtaggggaaactaagggtccaccgggatgaaagaaaagaaaaaaaagcggaaaataaagcgtggtaacaaaggaaaagcaaggtgagttgggaatatgagtgggattggcacctgggattcgaggtagggacacattgggggaaaggaacaggggcacacgaaatatacgaaatttaaacaagaggttggaagaaacaaccgggaaacaggaatggagaccccagagggagaacgaagacaaaaaagcacggagggaccccaaaaagtaggaaacggggcccgccataacaaaaaaaaagaaaaaaggccgtaagaaacaaataaagaagagcccaaaaaaatactaaagtaaattttaaccacgaatgcaaaacgattgagacttaaccaaaaccaaggtaggaccaatcaatgacggtaccaaacccacaccaccatagtgatacgacggaacggcgagacaaaacatccagtgtgctatggaataaccggggaacacaccccggcatatttg

SEQ ID NO: 672860 - DNA, 928 bp, Homo sapiens
  misc_feature (928)..(928): n is a, c, g, or t
gtctcgcgggtcaggctgctcccggctggaggtagtctggcgggacgggttgtgagttgcttggctgctctttacttatcgattctaggccaagattgccgcagagaactagacggtgggatgagatttcaggtctggcatgacgtataaaagattcagtttcgtgtgaccctatgtatgggctgtggtggatattgcagtttatggggcattctgtgtgcgaaagaattagtgttgtgaagagtaatcacaatgattcagtctgtgggcgtgtgtactatggaccgaggggtcaaagatgtatagactgttgagaaagttgcgatatgtgaaatttctggcgattaatgagtacgccaatgtctggctgacaatgtcatactctgtaatactgaaggtgaactggtatagatatggctgacttggtccgagagcttatgggttcgttaactatctatttggaattaatgatggagggtgttgggactcgaaatggtacgtataatgttaatgctaaggtggtactggtacagaagcctaggaggttgtctttggtaagtgagcttttaataatcttgaggagaggtagagagtgcgacctcgtccccaaggagaaagcctgcatgcatgtttgtgcactggagcacgaactgcgtctgtctcagaaactggcatgtgatgtgtgtgttagtgtaccttgtagttgtggctctgtgcaccttagggttgtaagtctacctgacatgtggcagtaaccagcttccgccattcgtccacctttttaagaacctcatgggcaccttgtgcggccttggttttgcgccccactgtggggggacgcacctcaatggtttgggttccccccttgttgttgtcgggcacaataggggcaataataggcaaaacatgtccaaatggggcgagtggn

SEQ ID NO: 672861 - DNA, 437 bp, Homo sapiens
  misc_feature (44)..(44): n is a, c, g, or t
  misc_feature (63)..(63): n is a, c, g, or t
  misc_feature (78)..(78): n is a, c, g, or t
  misc_feature (119)..(119): n is a, c, g, or t
  misc_feature (142)..(142): n is a, c, g, or t
  misc_feature (178)..(178): n is a, c, g, or t
  misc_feature (200)..(200): n is a, c, g, or t
  misc_feature (212)..(212): n is a, c, g, or t
  misc_feature (230)..(230): n is a, c, g, or t
  misc_feature (238)..(238): n is a, c, g, or t
  misc_feature (276)..(276): n is a, c, g, or t
  misc_feature (293)..(293): n is a, c, g, or t
  misc_feature (299)..(299): n is a, c, g, or t
  misc_feature (314)..(314): n is a, c, g, or t
gaagaaatccaaactattttttcttttaaaaagccccgtaatgnaacccctaatgaaatcccngccatttgcttcccnttgaagtgggaaaatatcccaaaggagcagcttccatttcnttgaggtgaaaggccctatgaanattgttcccctttgctgcctttgggagttatatggntatttgggaaccttaaaaaccnctgggttttaangccatcccgcataaaaanataatttnttctatgtgaaaaaataagacagggctttcccctaggnaccccccagacccatcntccttnactttttaagattgngttttattaaaaaaaaaaaacccttaaatgggggcagctatttttttatgttgaaaagactgaaagttttaaacatgaaaaaaatccatatttaaccttttttgttccccctgaaaaaaaaaa

SEQ ID NO: 672862 - DNA, 282 bp, Homo sapiens
atccgcagcaagtctaaaggtcacatcgagttcacagagtgcagaaaacaagatcaccctagtagggccctacagaggatgtctatctggcccaggaacagatataatgcatggtctaagatttgattaaccggactgactatatgtagatcaacatcgacctacagttccacaggcacctcattgggaagagcggtgccaacataaactgatatcaagaccattaccaggtgtccgtgcgcatccctcctgagcgtgatgagacctaaaacggggtaccga

SEQ ID NO: 672863 - DNA, 254 bp, Homo sapiens
cgttttagacgaaactccacgatgaggacatccgaggtgctgcactgctcagactgcaggcacagcttgtcccatgtcgagtgtgcatgttgccaagtctgatcttacggttgccctgcgtgacgtatgtatgtgatatgaaagtgtggctgtcaagaacctgcaggaggcaaaagactgttacaaatccaagtttgctgaattctctgaggttgccaaacggaacaatgatgccctgggccaggaccatcagg

SEQ ID NO: 672864 - DNA, 128 bp, Homo sapiens
cagcctgtgcaacagagtgatactctatctcaaaaaaaaagaaagaaagaaagaaaagaaaaaggagcttacaatcatggtggaaggcgaagaggatgagcaggcatatcacatggccaaaaagggag

SEQ ID NO: 672865 - DNA, 289 bp, Homo sapiens
tttttgccccccggggggccccccccccccttccccccaggttttttttttaggcgggggttcccctttcccccgattccccccctatgtttttgggggggggggctttttttttttcctcttgggggggcccccctttttggggccccccccccgttgtcctttttcagggggggggggccccccccctgaaggggggggggttttttttttcccttccagttaagcctcaagtatataatgccctccccaatgagtgcaatgtcaaaagaatgttagaaccatatta

SEQ ID NO: 672866 - DNA, 460 bp, Homo sapiens
gactgtcatccatctacctgctattttattattggctgattacaaaagcaaatcaagagtatatgaactctagtttgcctgcaagtaaactatttactgcattgagggtcgtagctttttccctattatccgattatccatggatcaaatagtgtatctcagtggtaattctagagggccattaaaaccctgatggtgctggaagagatggcagtgctgcatgtcagaaataggtaaactgtaattaagaagttacagatgattcgattacgctcttgtgtatttggtcctgttataatgtgagcagattaaaatcatgtagtgcttaaagctatgtcattatgcaaacatttatggcaacttctgcaaattaatttgaactgtaaaagttccctaatgagacgatgtcctccataactgagaaggacactgcagccattgctgcttaattcctgcattt

SEQ ID NO: 672867 - DNA, 935 bp, Homo sapiens
tgcgccccggtgagccgcgggtgcagcgtgagcgtgtgtcgaacacggttgccgaataggtgatgtgtgcagcaccctgtgtagcactggtgccgcgccccgtgagatgcccaggcgaaccaccggggtggcaccgccggccccgcggtgggggccgcacgagccgcgcgcctttgggccgcccctaagcgcttgttttgtatcgcgcgttcattgcacgccggtattgtggtaagcccccctccgcgcctaaaaaggtggtggaacgcccctcctcatacggcagggggcaagcagcccagcacgtaccgtcatgtggtagccccacccgcgcaatccgtgctcgcagttgcagccgtgggaacgagaaagatggtgtgtaaaaagtacatggtccgcaaaaacctggcttcaaccacttcggcgccccataaggtagtgttccgccgcaccacagcgggcgtcttattatatcagtcgcgccttattcttccaagctgccccccgccgaaaatatagtctagcgcctaagaggggttctccttctttaaaaaaacaggggccccccgcgtgctaatagaggagaatgcatacttctgtggggggaggcgccagtgtatcctattttccctccccacacgacaaatccatttagtggagagtctcttattactattaaaaagcgctcgccacaaaatgatcataatcagggttataatatgtttatacaaaacaccaacatgtagaactctcgtggaggtctgggaggttatataagggcgcagacaacatcattggagtctcggtaaaggtgggaccacgcaataagacctccatggttttttactgatacattggttcctctaggtaatgtagtttttgccccctccccacggccccgcagataacaaaatatgggttccgcccacatgaca

SEQ ID NO: 672868 - DNA, 529 bp, Homo sapiens
  misc_feature (529)..(529): n is a, c, g, or t
ggcaagatggcgcttgccgagtgattctcctcgaagtacctcctgccggctgcggagacaccggggcggggtgtctgccgcaactacctcccttcctcctctccgccaggggagtacctcatccgggactcatatcaccacggcagggagagtatgtgctcgagcatgttgccgggtggcgcatagtcagggcctttggagcgttcgatgagtcaagcgaacggatgtgataggtgacagggtcacggcggaggatgggtagcgacatgagacagatccaaggtgagcacttgatacatgaaagtctagagatagacggctgttaagacgcatcgatgagcacacaggctctctacgggatgacagaactacgtacactagctagcgagacatgatactgacgatagaggtcgtagaatgtatatcacatgtatagactaaggaaagaaatgaggagagacaaccaatacaattagcataaacatatggacacaccccgtggatggaacaaatccggtgaagcacgctn

SEQ ID NO: 672869 - DNA, 357 bp, Homo sapiens
  misc_feature (357)..(357): n is a, c, g, or t
agggagagtgtcactcatcatactgctcaccgatggcgaccccactgtgggggagactaaccccacaagcatccacaataacgtgcgggaagctgtaagtggccgcgacaggctcttctgtctgggcttcggtttcgacgtcagctatgccttcctggagaagactggcactggacaatggcgggctggcccggcgcatccatgagagactcagactctgtcctgtagctccaggacttctacacaagaagtggccaacccactggtgacagcagtgaccttcgagtacccaagcaatggcgtggaggagggcactcagaacaactttcggcttctctttagggctctcggggggcn

SEQ ID NO: 672870 - DNA, 148 bp, Homo sapiens
gccatgagcaagatatagttcaatacaacacatacatgaggcatactagtcaacaacaacagcagacacatcagtatcagcagcgtcgccagcaggaggcatatgcagcgccagaccgaggagtacccccgctccctgaggaggacct

SEQ ID NO: 672871 - DNA, 559 bp, Homo sapiens
ccgtaccgcgtaccgcattaggtgtgtgtctagtctgtctggaagggtttgtgaacagagaaagcattgttagtataagtgaagaccatctgaaccctggaaagccatctgtctccagaagcaagggggcttctccttttggtggtggtgttctgcctctttcctgtggtatttttctcttctgtgctgcttgctaaaagaaattcacatcatgttaaagacattggttctcggcggggtgcagtggctcacgcctgtaatcccagcactttgggaggccaatgcaggtggatcacctgaggtcagaagttcaagaccagcctgaccaacatggagaaaccccatttctgctaaaaatacaaaattagtctggcgtggtgactcatgcctgtaatcccagctactagggaggctgaggcagaagaattgcttgaacccagaaggcggaggttgtggtgagccgagattgcgccattgcactccggcctgggcaacaagaatgaaactctgtctcaaaaaaaaaaagatcagctgggcgtggtggcacatgcctgtggtc

SEQ ID NO: 672872 - DNA, 176 bp, Homo sapiens
  misc_feature (131)..(131): n is a, c, g, or t
gtctgctgctaaagccatctgtgacccagtaaggaccatctggtttggtaccccgaaggaagtatttagtgtacctagggtgttatctctgataggctaactccttaggtgttcctgatagtactgctctnctcttaccctcgttgttatacaagataagaactcggagttagttg

SEQ ID NO: 672873 - DNA, 1675 bp, Homo sapiens
  misc_feature (1573)..(1573): n is a, c, g, or t
  misc_feature (1579)..(1579): n is a, c, g, or t
  misc_feature (1675)..(1675): n is a, c, g, or t
ggctgacttagctccgtgagacctgggcgtgcgcgtcgctgatggcatcggctggattgccaggctgatatggttgcagctgggacatccacccgtactctccttacgatcaatgctcacacgtattcggagtgacttctccggaccagatggtaccattagtgccgacgtgaggacgacagtgtgtagggtccaacgcatcatgtgaaggccaggaatcacggagatgatccacgttgggcggcgaagagctgtgcgctgtaatcatgtgagggacaggaacatgcagtgatgtgacgccgagggtccatgtccgcaaagagggcagctggctttcattgaccacagcgctctttgcagtgcaggtcgcctggcctcccgtgagtcgccggaggcgcccagtagtcgcgcggatcttgtgctgggttcagcccaaggagcaggagattcgtgccccttgcagaagtctagcgggagctcttttctgccctcggccgctaacttggggagtcggcaccgcgccttgctttgcccctgctggccttgcgttgcaccatctgggggaccgctattgtcgcaagagttttaacctagtgggtggcacgcctttaacacgcagacagcttgggtacgtctgggcgtcgccccggtaggaaattgaacccctacacgtccgtggatctcgagcgcttttacaagggttaactcttagcccaaaccttaacgagacccagtccttgctctacgagagtggcataaacaactctctgggactagggcacgtaggaagggtcgagtaggtggcgaagggcgttgcacttcaacaagcacttttgcccatcaccagagaaggagtagcgccgacggcaccaagggcagcgaggaagccttaagagccttggtctagaagatccattttgtcctacgacttcaacttttatttccacgcgcgttgaattgcccttggtgaaggggggcttggcgtacaattacacagatgcccagtgctagtgtgccagcacttaaagtagggggcccgcaaagttcctcatcaaagaggacccgtgcagaaaggttgcctcttcacttggttcatcggttgaagggactccctttcttgacattgcggttcgggcatttcctcggggaaggccgtcgtccgggcagggttggttgtggcaggcgtggtcctcggttgttggcgagaaggtttagggttggggcccccgacttttgttgtcgccggttatgggctttgggcccaagtgtcttgattgcaattcggaggctcggcgttaccagcccactggttggtcccctttggcacctgtgtggactctttgttaggcagagagggcgaatttaagcagcgcattttccttcctatcttgatgcgaatggtcacccattgcgcaagttgggactgtgtctttggcgttgtagatccgagccaaatgtgctgaagcgccgcgatttgtttggggctctagttaggttatggttgggccacaccaagcatccggtgggcccccgcattttgtatcagatgtaaaccagccagtgattatgagancgtatntgaatatccgattgagagagcatgtgtctgtcatcacagaactgagaccacaagaagacgctctcgatggcgattatggcggagcacttgtatgan

SEQ ID NO: 672874 - DNA, 399 bp, Homo sapiens
atgtctcagtatctcacatgcattggaattcctgactatctcatccctaagttccctaccacttttttcacccttgtcagtattattttttgagacaagagtctcactctgtcacccaggctacagtgcagtggtgcaatctcagctcaccacaacctctgcctcctggtttcaagcgattctcacgcctcagcctccagagtatctgggactacaggtgtgcacctccacacacagctaatttttggatttctgttttttttttttagtagagatgcggttttgccatgttggccaggctggtctcgaactcctggcctcaagtgatctgcctgcctcagcctctaaaattgctgggatcataggcgtgagccactgcacctggccacagtatcttct

SEQ ID NO: 672875 - DNA, 199 bp, Homo sapiens
tacacgcgcaagtcagcacatgacgactcggacaacgactacaacagcgagcatgttggcgttgctggcgatgtataggtatgttgcgcagcggcgagatgatcatgtcggtgattacgtcatagaacagcttcacgtcgaccattccgccccagctcggcaaagaaaccgttgtagcctagttcgcgcgagcgcatca

SEQ ID NO: 672876 - DNA, 334 bp, Homo sapiens
ttgtaactttctggttaatctattctaaaattgagagtttatttaaattttggctgggcatggtggctcacgctggtaatcccagcactttgggaggccgaggtggtcgaatcacctgaggtcaggagttcgagaccagcctgaccaatatggtggaaccctgtctctactaaaaatacaaaaaatcagccaggcatggtggcttgcgcctgtagtcccagctactcgggaggctgtgacacaagaattgcttgaacccaggaggcggaggttgtagtgagccgagatcacgtcactgtactccagcctgggtgacagagcaaaactccgtctc

SEQ ID NO: 672877 - DNA, 411 bp, Homo sapiens
agaaatactgcattaaggtaaacttgagtactatttatggcacatatgcgtacaccaatggttatttctcacagatttcatgcgcatttgtgtattgtttactgtgattaggctctatgaatacaaccattatgctggtcacaattacgaatgctaatatttggtgaagctatgcagataatattttaaaatagtaaaagttagagtgctagtcttctgttgttgatgaatttttggagttttaaacaaattatggctgggcccagtggatcgcaccttttaattccccggccactttgggaggctgagatgtgagaattgcttgagcccaggagtttgagaccggcctgggcaaaacggtgagaacccaaattcacgcaattttttttttaataatttggcagaaatggt

SEQ ID NO: 672878 - DNA, 347 bp, Homo sapiens
tcctacccccaccctcccagggcacccctccccttgttttttttaccataagctacagtctggccgggtttggtggctcacacctgtaattccagcactttgggaaaccgaggcgggaggatcacttgagaccaggagttcaagaccagcctggcccacatggtgaaaccctgtctttactaggaatacaaaaattagccgggcatggtggtgtgcagctgtagtcccagctactggggagtttgaggcagaacaatcgcttgaaccggggaggcggaggttgcagtgagctgagatcgcgcccctgcactccagcctgagcgacagagtgagactctgtctcaaga

SEQ ID NO: 672879 - DNA, 208 bp, Homo sapiens
ttcgtctactagtccacaaccctgtcctagactcttcaagacactgctcgttacaattttactgggtctctatttaccctcctacaagcctcagagtacttcgagtctcccttcacattccgagagtctgacagctcaacattttttgtagcctcaggcttccacggacttacgtctttatggctccctttcctcactattacgcttt

SEQ ID NO: 672880 - DNA, 859 bp, Homo sapiens
ggctgagcgtgtgggctcatgcttgtaatcccagcacttgggcaggccgagaggaggtggatcacgaggtcaggagatcgatgaccatcctggctaccagttgaaaccccatctctactacaaagaaattagccgggcgtggtgctgggcacctgtctagtcccagctactcgggaggctgaggctggagaatggtgtcgacctgggaggtcatgagctagggtgagccagtgatcagccagtgcactccagcctgtggcaaagagcaggactctgtctcagcatacctaatagggtccattatgaactgagtattcctagaaattcaagttgtctaaggctgtaatagcttacgggtagttagtctacgatacgagtactttcttccctgataagtagtatcatcggagcccttaggtatagggagatgaggacgaagtttaactacgtgtactgtgggccgggcgtgtctggatcatgcctgtaatccgcagcactttgggaggccgaggggggcggatcacgaggtcgggagatcaagaagtatcctggtaacaaggtgagcccgccgtctgtactaatgattacttgcaataaacattagcaagagcggtggtgagcgaggcgcttgtagatcccagcatacctcgggagggctcagggacggacaatgtctgacccaagggaggcggaccttgcagtgacctgaatttgcacatggactcccagctgggcgaagagaagatccgttcacagaaaaaaggtttgcgggttcacagaccatcggcttcaaacttttaaagggcccgggtgggaaattcgcgacacactctttagagccacacgagaccctgctgca

SEQ ID NO: 672881 - DNA, 897 bp, Homo sapiens
taaatggaaaggggtcccttttgggttttcaaaaaaaatttccctggcctttttggaaaatctaccctaatttttcttgctacccaaaaatatccacggggggagagagggtccttttgtagaaacaaaatgtgtttccagttatgtaacccaagtgtttatctttggattggcaaaacgcagttggtgttctctgtataatgtatctggcaacaaatggtggtggtatattcctttcgtggccaaatcttatttggatctttgtgtttcacacacgcatctggtattggtggggatggagctgtgttacgaaccaatattatattattattaagggtgtttctctgtggttttaccccttttcagggactgtgatcgtgtggtatctctctcctgtttgtgtggtaaatttttcccccccgggtgtgtggggtgaataaacgtgtgtttgggccccagcatttccagcttactgtggtgtgtggcgccccaagatgtgttggcgttaaatatgtgcctcaatattttagaggcctatatattctgtggggtcccctttggcggaagtgcttcatacgcattttacacgctccctaagagggtggtttttctatttataaaacaaacagtggggtgggcgccccgtgttaagaggatttattattgagccaatcatactgagtataagacaattttggcgcgcacgttttttactcacccatataattttcgggttaacaacacaacaacagattcttttggcgttaacgtcccaatatttacactcccgggtgaaaaaacattttggcgaaatacgagacgccagtgcttccagggagaagtaaattacccgcggggagttgtttaccccctttgggtacgacacacaaaaaaggg

SEQ ID NO: 672882 - DNA, 553 bp, Homo sapiens
  misc_feature (523)..(523): n is a, c, g, or t
  misc_feature (533)..(533): n is a, c, g, or t
gggtcgatctaaggaccccttgggggctccattccagggggtataggctggaaaaatatcttagacttcagaacagaataccaatcaaatatggaaaattccttggtcaaaacacaaagatgttggttttaagggggagtttttttaaagttttctttttttaaaaaaaaaaagagaaagttaaggacaaagggcaaactcacacggccggaggcagggccgggtttctcttcctggaaggcctttaacagatgtcagctttcacgggcctccatgcacaacctcccattaccacccaatctggctgccacagcaaagtgcaggcacccggggcccccgggaggatgcgggcaggggctacagggcatccaggatgtggtcgatctgggtgaccagctccgggcgctttccggaagatgagttctcattctcaaggtacgtgtctttctggagctggccagccaccaggcgctcagcctccaccggcgatttcagcaccagttccttgacctgtgcatccagnttctgcattncggtcactctgtcgcaagat

SEQ ID NO: 672883 - DNA, 277 bp, Homo sapiens
ccgggggggcccgggcccccaaaaggggggggattttttttttaaaaatttaaatgggccccccccctcgggggggggttttttccccctcggaattttttttaaaggggggggggggggttttttttttgggggggggggttttttacccccttttttttttttttttgggggggggccccccccggttttttttggttggggggaaaaaaagccgggggggcccccccccggggttttttaaaaaaaaaaaaagccccttttggggggtggggga

SEQ ID NO: 672884 - DNA, 231 bp, Homo sapiens
gctcgaaggggcggaacctcctctggaaatgaacacttggggttgattcctcgtgccagatcattattcctaaatattcaggctgggagtcctcatgcaagatgcatcagtttctaaacttctctcctatagaagcccctagtgaaccagctgcatttgccgcccacccctccgagcagtcacggtagtgactcaggagggcagcactgagtcccaatcgctacgcctgca

SEQ ID NO: 672885 - DNA, 387 bp, Homo sapiens
  misc_feature (248)..(248): n is a, c, g, or t
  misc_feature (262)..(262): n is a, c, g, or t
  misc_feature (293)..(293): n is a, c, g, or t
  misc_feature (296)..(296): n is a, c, g, or t
  misc_feature (319)..(319): n is a, c, g, or t
  misc_feature (348)..(348): n is a, c, g, or t
  misc_feature (352)..(352): n is a, c, g, or t
  misc_feature (367)..(367): n is a, c, g, or t
tttgtatttttagtagagacgggggtttctccatgttggtcaggctggtctcgaactcccaacctcaggtgatccacctgctttggcctcccagagtgctggaattacaggcgtgagcctctgcgcccggtgtgcacctttgttcttaactgtagaatggggaaaccagtgatctcaagttgggttctccaggatgtggactctgaaatgggctgtgtacagaagatttattcagagtgacaccagtnaaaagtaaagggcngaagcagatggagatgtgggtctgacagtcnccnccaccagtgaaaagtaaagggcngaagcagatggagatgtgggtctgacagncgcngccaccagtgaaaanaaagggcggccgttgggtac

SEQ ID NO: 672886 - DNA, 178 bp, Homo sapiens
  misc_feature (62)..(62): n is a, c, g, or t
  misc_feature (83)..(84): n is a, c, g, or t
  misc_feature (91)..(91): n is a, c, g, or t
  misc_feature (98)..(98): n is a, c, g, or t
gcccctctaggggcaccgacattaactcggaggaagaatcggtttaaattaaacttaagacncttatccaaattaagttgggnngggccgnccccccncgccgggctcgtgttttttataagtcccctggaataatctgacgagcgcagcgagtagttagcgaggaagcggcgcatac

SEQ ID NO: 672887 - DNA, 195 bp, Homo sapiens
  misc_feature (56)..(56): n is a, c, g, or t
  misc_feature (70)..(70): n is a, c, g, or t
  misc_feature (101)..(101): n is a, c, g, or t
  misc_feature (104)..(104): n is a, c, g, or t
  misc_feature (127)..(127): n is a, c, g, or t
  misc_feature (156)..(156): n is a, c, g, or t
  misc_feature (160)..(160): n is a, c, g, or t
  misc_feature (175)..(175): n is a, c, g, or t
taaaagtaagggcagaagcagattgagatgtgtgtctgatatagttgccagcagtnaaaagtaaagggcngaagcagatggagatgtgggtctgacagtcnccnccaccagtgaaaagtaaagggcngaagcagatggagatgtgggtctgacagncgcngccaccagtgaaaanaaagggcggccgttgggtac

SEQ ID NO: 672888 - DNA, 822 bp, Homo sapiens
agcgaaagcctaagtttggggcccccatcgtgttagtaattggcctgccttgtgttcccccctgcgtgctgaggccagtttttgcttgcttggggcccccgagggcgaccctggtgaattgcgttcttccctcccaggcagtgttgaggacccaccctgtgtatgtcgccaccaagacggggggcccccactgggtcggctcccacgccacgggcacaaagagaaatttgtgggcttttgtgcccacccgagcaactactaatgcgggttgcttgggcgccgcaaaaaaagtagcggcctacattgtatgccgggcccacccccctgacaaggggactacgtgcgtatattgctccaccaggtctacaagggtgacaagcctttctggtccgtcgctacagccccttctcaagcgaagcattcttttggggacttgtcggggcgtcgagggcgggccacaccacggtgtcgtctccagtgaaaagatgttgagaaggccccttgttattaatttgtttaaatgttgttcgcccctagatgttgaacccacaaaagaccacttgttttgtttggccgcgtgccaaacacaacaacctaggttccttgacctactctattgccactaggcatttcgcggcagaaggcggccagaagtaccaaacaagttatctacgtaatccccctgcaacagttagcagaatctcgtagtcggttgtgtaagaagatcctcggcgggtaaatcatcggctccgcggtcctcccacacacgtccggggaaatggggcccccctgatgcaaaaagcggcaacaaaaaacaaaaca

SEQ ID NO: 672889 - DNA, 487 bp, Homo sapiens
tgagacggggtctcgctctgtcgcctaggctggagtgcagtgttgtgatcttggctcactgcaacctccacctcccaggttcaagcaattcccatgcctcagccacccgagtagctgaggaccatcgttgcaacgatggtcctcagctttcccaagcagctgggactacaggcatgcgccaccacatccagctagtttttgtatttttgtagagacggggtttcgctatgttggccaggctggtctcaaactcctgacctcgtgatccacccaccttggcctcccaaagtgctgggattactggcgtgagccaccactcctagccttaatgcatattcttaaatatacaaaggtagatttgttatgaaaattgctttggggctctaataacctaccttttaagaatgagaaactgctgggcttaagggagtacagtatgaatcaagatttgaccattcaaatgtggttgtgatttctgaatatatca

SEQ ID NO: 672890 - DNA, 226 bp, Homo sapiens
tcggtctgaactactcagctccctaaggccccacctcttcatattgtcaccttgtggaattgaggatggcaaacatgaattttgggacacataacaatactctgaccacaggactctgtcagaccacaggggaataaaacggggaatcaagtccaaatggaatcttcgaaaccatgctaatacatggaattttattaacctgcgcctgaatgagccggtgagtcca

SEQ ID NO: 672891 - DNA, 350 bp, Homo sapiens
aggggtgggagacgtgtgagggtgaactttcccctgcgagattctggtgaaagggtttaatatgcttcgagtcagtaaagctgcgcacgtgcacagtcaaggagagaggtttgggaagaaaggaggcttcagttaatgtgagaacattggaagtgaactattcagccgcgaacagggcccttttttcatcttccactggatggcctgccctttagccataatgcctataaggagcgtttgaagactagttttacctcaagggcctgattaagctacagtttaaggggagaagcagggaatcctgaattaatggttgaataagggttggggcctaatatttaaccttctag

SEQ ID NO: 672892 - DNA, 948 bp, Homo sapiens
  misc_feature (4)..(5): n is a, c, g, or t
  misc_feature (628)..(628): n is a, c, g, or t
  misc_feature (841)..(841): n is a, c, g, or t
tttnncgaggcggagaggccgcctcatcttctctctattcccgcttgtgcgcgccgggcgctgtggcctcgcgggcgattagtgggagacaagcgactagtgtgatagcatcctgcttcccggtcaaagacaactgggcacagaactctgcattaccacccgttaaaagaaaagttttttgttgggggggtgcccaccaagcggcccgcaaccgccagaattgagaagcccggccagagcttgtacgcgagatgccgcccgttccagacaggaaatagaaccagccgtacagacaaactcccggcacgagacagacaacaagaccacgtaggttcggctacatggcgtcaaagggcgccaaaacggcagcgcctgtctctagctctaatcgcgattcaatgcgcgcctttaaaaaccacgaggtgacgggccatgcgcaaggtcagagggtatggaccgcgccaataaaccacgcgaacaagtatccgatttcggcctaaattcggccaaaaatacgcgctaaaacctaataagagcaggaagaatgtgtgcctggcgaacaagtaacaccggcacagtacaagcgtcccgtccagtacagagaggggacgcgcccgctccacttganataactttcggaacaaatttaaaggcattcccagacgagcttggcaacgaaactacacagccacccccaagcctctagcggccacttcggttcagaggttagcactaaagcacctcttgtcacactctccaaggcgcacccctccgcacagacgccgcgcataaccctatgaactcgtacagtcaacgccacgcggaggcagcacaaaagagntgcaaacatactttgatcgccgcgaaataaagcggaagacgcatacaccgcaccactcatacttatctacagacaccacgtgaagcaacacaatagtgaaaccacag

SEQ ID NO: 672893 - DNA, 556 bp, Homo sapiens
  misc_feature (9)..(9): n is a, c, g, or t
  misc_feature (40)..(40): n is a, c, g, or t
cccaagaancaagaatagtatgcatgtttgggttcagaanaagatggtttgacttagaagtttaccattagaaataaaattattcctttacaaaaaaagaaatacttaaaagaatatgttggttttcaaaacagatatagtgatttttgcttagttgcttatacatcttgaaaccaaaactggagttcagctatttattgtgttcattttagcataagcattacaaagtccttctctagttaatcaggttcacactttgcaactaagaaaatagaagtgggccaggcacggtggctcacgcctgtaatcctagcactttgggaggccgaggcaggcggatcatgaggtcggaagatcgagaccatcctggctaacacctcatctctactaaaaatacaaaaaattagccgggcatggtggcaggcgcctatagtcccagctactcaggaggccgaggcaggagaattgcttgaacctgggaggcagaggttgcagtgagccgagatcgtgccactgcgctccagcctgggtggcagagagagactctgtctcaaac

SEQ ID NO: 672894 - DNA, 180 bp, Homo sapiens
tggcttctcccaccatcactgtggcgatgcctggtgtccctgcctttctccaaggcatgactgacttcttgcaggcaacacagacagcccctccaccaccgactcctccaccccaaaatgacccagagaagtgtataagcaggaaagggacacgggtgacgcctcctccctctccccctt

SEQ ID NO: 672895 - DNA, 1395 bp, Homo sapiens
cggacgcgtgggttttttttcgaggtcggagtttcgctgttgttgcccaggctggagtgcagtggctcaatctccactcactgcaacctccgcctcctgggttcaggctattcccctgcctcagcctcccgagtagctgggattacaggcatgtgccaccatgcaaggttggttttgttttgtttttttttttttataactttggcgacggagttttcgctcgtgtcgcccaggcgtggagtgtaggtggcgagactctggggtcacgtggagtgctcagcctccgtgggattcacaccacttcttctgcctcagcctccgtgagaatagcgtgggacctacagcgtgccgtgcatacccaccgtcgtggctacatttgggtgtgtgtgctgtgtgtgtgtgctgctgtgtagtggtgatgtggtcggcttacttattttatttttttccaaacaagaaagagcggggttttcacccgcggctaaccccagagagggccacacacgactccccgcggaccacgccggcagaacaccaccccctacaagaggcgccacaccacaaaaggagcgcggccatcactcgggcgcgagaaccaacgcgcggcccccgagcaagagggcggcgactcacacacgaaacgcggctggggcgccaacctacacaagcaacagcgagcaagaagacacagcaccagcaaagaactaaacagagagggaaacaaccccacaaacgcacaaaccaccccgccgcacacacccactcccacggacgtcgggccacgccccgttgaggcgatagagacacaccggcgtgactactaagacaagtgggcgacccccgaaacactagtggagaccaccaaccactcgcacgcccctcttttctatctcgcttgtggccggaaacagaagacgacgcaacatccgacgcaacgagactaacacaacaccccgcccacccccctaccccccccccccccgcccccgcgcagcccaccaacgcctactccatcataaactatccgaccctcacctaccccacccctcatcccccctcaccaactcacacaataataacacacaacacaaactccaccaccccacccccgtcacaccaccatcacatatcacgacgacaagtaaggacacgcagatcacgacatcgacgccaagcacgctccacccatcatcggctaccaccccacggagggaggccctatcagtgcttggcgcggtccgaccagcggcggacgccagccgaacgctcccagcacgccgcagcgcgcgagggggagggggctcagcgcctcttgccgtccgagccgcgccgcccgtcgcgcccgccgcgctgcagctgcgccgcgcgccaaccccccgccgcacccccccgccc

SEQ ID NO: 672896 - DNA, 680 bp, Homo sapiens
agaactgctgtcagtgtgctggtagccctctattcatccctcctcagagacccagcttccagaactgctatcactgtgctggtagccctctgtattcatccctcttcagagctcagcttctggttgtattctccatgagtttaataatgacatgaaaaaatgtggaagccgagagagtaaaatactctgccctgtaaaaacatggaagacatgcaaacagaaaaaaaataattgtattgttttagataatacttaagacaactgtgaaacaacaaaaacacaactattcctttgtgaccgatgaagataaaaagaaattctggtaaagacgggtatgcagttttttaaaatgggttaagaaattgttgcagaagaatttctaacatctgaaaatggttttatgtttaagaaggatggtctgaattgtgtactaatagcaaggtataagtttggtgtagagcctatccagtagcgtccactgtaccacttttaagtaagactcagtccacagaagctggaagattgccttcgctttaaatatcctttaccttctgcatttgacactcctcctgttactacatagattccggtccccagaagcaattttacactggtactagagcttaccagccccatttagtaatttttaatggctagatgaggtttaacaagaatatgaa

SEQ ID NO: 672897 - DNA, 197 bp, Homo sapiens
cttgagtatgactagcttacagctatagctttgatagaatagatagcactttacggactccacttatgattccctttaagcgcatgtggaagcccccatcgctgggtcaatagtacttgccgcagtactcttaaaactaggcggctatggtataatacgcctcacactcattctcaaccccctttggccttatcgag

SEQ ID NO: 672898 - DNA, 501 bp, Homo sapiens
gctcggtaccccacaccacctgagtcagcaacccaaccacctcattagcaaaccaaccacttttatctgcaacccaaccactttcatcagcaacaaaaacacaactattcctttgtgaccgatgaagataaaaagaaattctggtaaagacgggtatgcagttttttaaaatgggttaagaaattgttgcagaagaatttctaacatctgaaaatggttttatgtttaagaaggatggtctgaattgtgtactaatagcaaggtataagtttggtgtagagcctatccagtagcgtccactgtaccacttttaagtaagactcagtccacagaagctggaagattgccttcgctttaaatatcctttaccttctgcatttgacactcctcctgttactacatagattccggtccccagaagcaattttacactggtactagagcttaccagccccatttagtaatttttaatggctagatgaggtttaacaagaatatgaa

SEQ ID NO: 672899 - DNA, 320 bp, Homo sapiens
tttgttccgtggtggcacacaaatcttggcttgctgtaccatcattggcaaacctcatcatatcacagttgggtgtgtttgtatgtgtgtgagcactagtgtgtgtgtgtacatattcgtgtgtatgcacactttgtgtacctgctgtacatgtgattgtagatgtacctgttgtgcgtaaacctttgtaaaatgaaatttgctttccacttaatgcgctcctttgcagctctgcaatatttatcttaaggtctttactccttggctccaatgtctcccctacgtgttctccccattttcatgctatcttactagtccgt

SEQ ID NO: 672900 - DNA, 424 bp, Homo sapiens
ggactgtcggggccgtgctcgggcggcgcgggtctgcgctggggccatggctccgccgcgccgttcgtcctggagcttcccgactgcaccctggactcacttcgccctagtgcggccgagcccccggggacgcagagcccccgacacccccgctggcggaggctgctggggagccacacgggagcagcaaaatacctcagctgtgaggtgccaggttgatcccggaacgggcggtgcttgagaggggccttgggtacaggaggatggaggtgggttgcacacaaagagacatgatgacaacccaaggtttgcgcaaagcggaccatttcacagtgcggtagccaagcatgcgacccagggcttgctcgtcgaaaattgcccggtcgggaacaggagagagggggcacaggaaggattccctgtg

SEQ ID NO: 672901 - DNA, 117 bp, Homo sapiens
atgaggtcccggcggagaactggatatagctttctaggcctgctcagccaaggcgcggttgtgtcgaagtccgtccatcgaaaagagtacgctgccctcattgaggcgtatctgcct

SEQ ID NO: 672902 - DNA, 769 bp, Homo sapiens
tggaaatggagtctcgctctgttgcccaggtggagtgcaggggtgcgatctcagctcatgatcctctgcctcccgggttcaagcaattctctgcctcagcctcccaagtagtggggattacaggcacctgccaccatgccgggctaatttttggtattttaagtagagacaggggtttcactatgtgggctaggctggtcttgaactcctgacctcgtgatccacccgcctgggcctcccaaagtgctgggatcacaggcatgagccaccgacctggccttccctgttcctctctagaatccaattagggatgttggtactactcatatggattaaaacagttaacaaacttttttcttttcaaaggtgagatcaggaactcgggtttaaggataatctggaaacagggtcctggggagtcaataacatgggtcccattctgtaaagcacattcggttaggaatcacttatctcaaatggtaactcgggggctactatattgagatggtgaaaaaataccaatcgtgtggtttaactaaggtgagtgccaaaatattgggtttagtgtatataaacaggtctttaaaaaccttggagaacttttgtaactctatggtgaggggagatcctgcaattttacagataaatttttcgaaaaacaaaacaaaggggggcataaatcctgggacaagtatcatacagttttgaaagggccaaagggatgataaacagcggggtaaagtggggaaacagatgattgagaaccttg

SEQ ID NO: 672903 - DNA, 342 bp, Homo sapiens
ggaggccccaggaaaggaatagcaccattgacattcacacccagatcgaaaacatgatcatcaccaaggccaagaacgggcacctggactatgatcgccccacggctgaattctcggtgcataaggcgcccactggaccctcccaacgcccaatgctttgcattttctcctcctccccttcccagttaccaaagactcgaaattcacagaacagggacccagggacaccccgaagcccacctgaaatctcacaaatactgaacatccctctcttgagggagcagaaaagggccaagagctaccccaaggaatgaggcaggccgagccacagaaataggaaag

SEQ ID NO: 672904 - DNA, 175 bp, Homo sapiens
aattgttactcgaccataggaccaagaattatggttttgtgtagagtataaaaacgtgtgtattgctgtgtaatattactagcaaattctagtagatttggttccatgggtctataaaagtgggtggacgttaatgctattgcagcttctaaaactagggggtaccgggcgtcga

SEQ ID NO: 672905 - DNA, 118 bp, Homo sapiens
gccttccggcccgtgttctatccgccgcctccaccttccactccggcgccggctttcgcgcgcgacggctcgccgcgcttccactcgctcgcgcggcccttcgggcgcccgagcccgc

SEQ ID NO: 672906 - DNA, 774 bp, Homo sapiens
  misc_feature (595)..(595): n is a, c, g, or t
  misc_feature (680)..(680): n is a, c, g, or t
  misc_feature (721)..(721): n is a, c, g, or t
  misc_feature (724)..(724): n is a, c, g, or t
  misc_feature (733)..(733): n is a, c, g, or t
  misc_feature (736)..(736): n is a, c, g, or t
  misc_feature (744)..(744): n is a, c, g, or t
  misc_feature (747)..(747): n is a, c, g, or t
gagcggaacgggcccggcgcgggagggagcgaagcagcgcgggcagcgagcgagatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgtnagctttaatcaatcatgccctgccttgtcctcatcactccccagccccaccccttagtgcccaaagtggggagggacaagggatnctgggaagcttgagctccccaaagcatgtgatccaagccgnttngtcttcccnaantccattantangaacacatcaaataactgactttcccc

SEQ ID NO: 672907 - DNA, 382 bp, Homo sapiens
acctgccaagaagattccttctaactgaaggtgcagttgaattcagtgggttcagaaccaagatgccaacatcggtgtggactacaggacaaggggcattgttgcttgttgggtaaaaatgaagcagaagccccaaagttcacattaactcaggcatttcatttatttctacaggacaaggggcattgttgcttgttgggtaaaaatgaagcagaagccccaaagttcacattaactcaggcatttcatttattttttccttttcttcttggctggttctttgttctgtcccccatgctctgatgcagtgccctagaaggggaaagaattaatgctctaacgtgataaacctgctccaaggcagtggaaataaaaagaagga

SEQ ID NO: 672908 - DNA, 135 bp, Homo sapiens
ggtcaaacaccttcaggtagcgcaccttgaggccagaatgcgccaatggcacctcaaagttcatggaactggggggtcgatcccatttcttcttttcgttagtatgccgaagctcaatctctgcgctgatctgcg

SEQ ID NO: 672909 - DNA, 381 bp, Homo sapiens
gacattcaggccggaccatggctaagcatgagcaaatgtaacagaaacctcccacactgtcgttgaaaccgacacaacctggctcaggccccgcctcagcggaatgcaaaagggtcgtgacgccagtgtacaaatggcccgctgctgtctggaaatcgtctacaaaagcggcctcgcgcccttcttgaacaacccttaaaaaccgtagccctataggtaagacgcgacatttaattataagatcgcgccttcccctatttcgtcgccccgtgcggctttcgccgcaggtctcgcccgttgtcacaagaaacaaggctttgagtatctgcggtctgttgcaaaaaggtagttaatgatgagcgcaaggcactttctctccct

SEQ ID NO: 672910 - DNA, 715 bp, Homo sapiens
cccctcccccaccaccatagtctagtacgaggctggctgtagaatcggccgagggtccttccgcaggaagctaaggctgcgttggggtgagtgccctcacttcatcctggcgactagcacctgctgtcctggcagcgccagccctacactcgcccgcgccatggcctctgtctccgagctcgcctgcatctactcgtgccctcattctgcacgactgatgaggtgacatgtcactggaggataagatcaatgccctcattaaagcagcctggtgtaaatgtttgagccttttttggcctggcttgttttgcaaatggccctggccaacgtcaacattgggatgcctcatctgcaatgtaggggcctggtggacctgctaccagcagctggtgctgcaccagcagtgatggtcctgccccctccactgctgctgctccagctgaggacgaagaaagtggaagcaaagaaatgaagaatcctgaggagtctgactgatgacatgggctatcgggtcatttcttgagcctaaaagcctcctttcttataacatgttcaatacaaagctggacacttttaagcacaccacacacacaaacaccacgagggcactcaacgagctgaggcgttgcgggaccacaatgcacgtgccacctgaaacggtggcccagtggcccatatccgtgtgttccctgtggacccagcttcctggccccag

SEQ ID NO: 672911 - DNA, 459 bp, Homo sapiens
gctggtccgcttttttttttttctatcgctttttttttttgtaccaattcaagtgttttctctttctccccatagaagtgtgtctatatatatgccgtgttaacctctctttttatctgatgaggaaaaacatatgatctgaggggctaagtgctgtagcctagtgccaggacttctggcccaattcagggttctccccaagcccatgtatcatccccttttctcacaatcggtacttcgacctctgaccctcaccaccacccaaagtacttgtaattctagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaaacggcatca

SEQ ID NO: 672912 - DNA, 716 bp, Homo sapiens
gtaggttaacacataatgaatgatgaagcactgctcgtcgaaaacatgccgcttgaacaaccatcgtgcgagcatacgtcatcgctgctactactagtgacataccaataaagagtgaagcaggcggatacttgtcatagcacttagcaggagaacagactcggtcactgatatatttcactatacactctggtagatctgtctcggatacctggacaccctgtattttatgtttaggatgtttggccacatatagctactgttgcgtttcaaatagacgcctagcatgttatattacataccatgcaggtcacgagaatgacaggcgcggctgtgtgcaaagtctcttacctgcacactcagaactctcagaggccaacaaacgtttaatcctgtggtcaccagttgaagaccatcctaccctacaccgtgtcactatatgtgcgaacagaatacatgctcctacctatgtgcagagttcaacgagccgacgttgtaccagtgcattctccatactgtcttacagagtatgaccctgtctcaagatatgaagatagacagactgtgtgtcatcacgtgcactgtcccaatggattatagctagacacaggggggatttatgcgcttatttgaagagatataactatctatagccactatatcgctgtgtacccaccaagcgtgcgagcgcgatgtgaacattgtaccttggctcc

SEQ ID NO: 672913 - DNA, 1003 bp, Homo sapiens
gccgggcgctggtggcgcgtgcctgtaatcccagcaatttgggaggccgaggcgggtggatcacaggatcaggaggtggagaccatcctggctaacacggtgaaatcccgtctttactaaaaatacgaaaggttggccgggtgtggtggcacgtgcctatattcccatcccagctacccgggaggctgaggcaggaggatcgcttgaacctgggaggcggaggttgcagtgacctgagatcgcaccactgcactccagcctgggcggcagagcgagactccgtctcaaaaattaaattaaaataaaaaaacataaataaaataaaataaaaataaacatagtggcaaaagtagaactctaaatttggaatgcagtaccaatacactatgagaaatagtctagcaatggtggagcgtggtcttaataagacataaacgtcttcaaaaaattctatcaataagctcccaagttaaggcagtcaaaggcaatgacttacaggtcggatgtgatgctcaagactccattaggtaagggactatactggggggctggtcggtcaggggcctctggaggatctcctgatgttggccagactactgggacctcatcttacccatttagcaatccataaagcacaaatctaatcttgggcaagggggccatgacaattaggccaaggggccagaaccccaaggaaccgggggataggcaacaagagccacatccccaaaaacagtaagacacaacggcgcgacggtgccaaggcacaacagagaacggcacacaaagaacagataaacgtaaacaatacagaagcaccaacaaaaccacacgacgcaacaaaccaacagcaagaccgagcgcaacgccagcaaaaaaaagacgtaaagagggccagaggtaaacacacacacagcagagacgcacccaaacaacacaacgagccaaaacaagaaacatacaaaagaaccagagacaagaaaaaaaaaaaacagaagccacc

SEQ ID NO: 672914 - DNA, 365 bp, Homo sapiens
atagagacatgttataacagtagtaaccatgttgtatgatagatcgtgctgaaattattacctatgtagactagagattttgtatccttggatggacatcctcccagcttgggttattagtccagtctcacattgctctaaagaactacctgagactgggtaatttatgaagaagacaggtttaattgacccacagttctgcagactgtacaggaggcatgccaggggagccctcaggaaacagcagatcatgtggaaaggcgaagggggagcaagcatatcaacacatagcaagcaggggagagacagagaacaagggggaggtgctacacactttcaaacaatcagatctcataagaactgta

SEQ ID NO: 672915 - DNA, 973 bp, Homo sapiens
ccaacgtccaaagtatctcagtcaagcaagccgagctaatcagccacccaacaagtgacgtaactcaagactaagcctcagaaacaacatgagtaagcgcagtaccacaacacctaaacggacgaaccctgcatcatcttatcactcagtatcacttaactcattcttctattgccacagactaaccctcactcggcacgtcctgaccgtcagctcactttacagccaacgcagcccaagctactctactaaaccctacgccatgggccagtaccccattatcgacgcgaggcgcagtgactcataccggctatcacgacatcctacagatggaaacaagtgcacctagacccacacttcgtctacccacaaggacaccaccctacacgcccgtgtatccccagtacctagcctagcttatcgcaaacccatcgagcgctacctcagttcaacgcaagtagcaccgtggcccgcacgacctacaccgctaacatcactgccaggcccacctacatcatgcccacctactcgcacagcgccagcctagcaaccatcaaccatccacacctaccctctcaccactactcaccctcacacagcaccccacagactacgtgactactcctacacacccgccgccgccctcaaaccccaagccccacgctaccacaacaccacccagataacgcccccagcacgcccgcaccacccccaacaaaccaacacagacaaccccacccaagcacaaccacacgcacgcgcgctagaccgcccacacaaaacagacccggacgaccaacccgcaacgacacagacgaacacaagcagcacgacaaaaaacacgcaatcagacgcgaacaacgagcaccccaccagaaccgcacgccacagaaaccacacacataacgccgcgcgcaaacgagcgaccagcacacacaaggagcaaacaaccaaccgcggacaatccagcaca

SEQ ID NO: 672916 - DNA, 494 bp, Homo sapiens
gacataatacacatatttacagccaactgtattttcaagtaaaggtaccaaaaacattcagtgctggggaaaagacagtctcttcaataatatgatgtttggaaaaccaagtatctgtaagcagaaaaatgaaactagacccttatctctcaatatattcaaaaatcaaatccaaatggattaaagactttctaatacctcaaatcatgaaattactagaagaaaccactgtggaaatgcttaaagcgttggtctgagtaaagatttttttgtgtacgacatcaaaagtacaagcaacaaaagcaaaaatagataaatggggttatatcagctagaaagcttttgtacagcaaagaaaacaatcaacagagtgaagagacaacctacagtatgagagaaaatatctgtaaactatccatgggacaaaggattaataactagaatacagaagaaactcaaacaagttaatagcagaaaataatccaatttgaaaa

SEQ ID NO: 672917 - DNA, 102 bp, Homo sapiens
ttcactttctacatctgcggggtcatcacgcagccatggttgtgcctgccgttcatggtggtctttcatgttacttggcgatcattgtagtagagcttgaat

SEQ ID NO: 672918 - DNA, 1132 bp, Homo sapiens
ggccgctgccgccaggaactcaggcccggctcctgttccttcaagagtgctggaggccaaacttgaaatacaagtttaatgttcctcgtcggcgcaaaagataagtgatccgatctcccccggcccggtgtgcagcagtgagctgacacaaccacctgaccctgggttaaaactcccagtggactcttctgcttgctgccacctctatgttctctccccctgttcccacatcgtggtgtctaccctcatgtggcctggtgaggcacatgcgtgtccctgacttgcttgagggggctggatgtactgcatcctgcaggttcccagcggacttgggggcgcccagctagagccccggcgcccgcagaacgactatggtgttttgcctcctggcagcactcaaccctggagggcagaagagggcctaccaccatgatcactggtagtgttcagcatgcgcttgtggaccccagtgggcgtccttgacctcgctggcgtactgcctgcaccagacggcggtggccctggacgagctgcgagaggccgatggacagtgtccggtcgaccgcgaacctgcctgaagttgaaatggtgcaggtcagtgtatacgacgacgggagatcgacagtcctctcaagccgcatcccgctgggaggaagcaggtagagttggaacacaccagactcattagaaggtcccaaccaaaactcagtttgattaagacaagtcaacaaatctagctgttggtccgaaaaacactatttctccttacgaactctcaaatagcattgagacgcaaccccttgaaggggtgtgggcaactgatatggaatggagcagatagaaccaatgatgcgcattagacgcaacatgttatggactttggtggaagaaagagacactgaagcaaaagaaaagctaatgagtagagaagcgacatatggcgacagattcatatgaacacaagctcttaaagacaccaaacagggaagagaatatagtacataacggtacacaaagatacccatattactgaatagtgttgagagaacccacatataggtatgaaagagaatgataatatatcgcaaggggtgatgaaagagaggatacagaacgaataatgcaaagatga

SEQ ID NO: 672919 - DNA, 563 bp, Homo sapiens
  misc_feature (26)..(26): n is a, c, g, or t
  misc_feature (63)..(63): n is a, c, g, or t
  misc_feature (86)..(86): n is a, c, g, or t
  misc_feature (90)..(90): n is a, c, g, or t
  misc_feature (104)..(104): n is a, c, g, or t
  misc_feature (115)..(115): n is a, c, g, or t
  misc_feature (133)..(133): n is a, c, g, or t
  misc_feature (140)..(140): n is a, c, g, or t
  misc_feature (152)..(152): n is a, c, g, or t
  misc_feature (158)..(158): n is a, c, g, or t
  misc_feature (187)..(188): n is a, c, g, or t
  misc_feature (194)..(194): n is a, c, g, or t
  misc_feature (203)..(203): n is a, c, g, or t
  misc_feature (206)..(206): n is a, c, g, or t
  misc_feature (224)..(224): n is a, c, g, or t
  misc_feature (233)..(233): n is a, c, g, or t
  misc_feature (235)..(235): n is a, c, g, or t
  misc_feature (255)..(255): n is a, c, g, or t
  misc_feature (270)..(270): n is a, c, g, or t
  misc_feature (279)..(279): n is a, c, g, or t
  misc_feature (284)..(284): n is a, c, g, or t
  misc_feature (291)..(291): n is a, c, g, or t
  misc_feature (299)..(299): n is a, c, g, or t
  misc_feature (305)..(305): n is a, c, g, or t
  misc_feature (310)..(310): n is a, c, g, or t
  misc_feature (332)..(332): n is a, c, g, or t
  misc_feature (372)..(372): n is a, c, g, or t
  misc_feature (377)..(377): n is a, c, g, or t
  misc_feature (425)..(425): n is a, c, g, or t
  misc_feature (453)..(453): n is a, c, g, or t
  misc_feature (474)..(474): n is a, c, g, or t
  misc_feature (562)..(562): n is a, c, g, or t
tgatgtaaatgaatttaatttgaganatgatggaaaaatattaaaggtaaaaatggaaaaganatgatcaccaagtgaaaaaaatntaancagaaagctttaangtctgtaagtnaagctgaagctgaaattntgggagnatgaaatgctgnagggcnaaaaggaatggataattagtattcctttnntttttnctaaccctntcnttaaaaagaatccaaacnaacctcctnanaatccttctaaaggggagcnatattttcacgggcntttgaaaantcgcnttcctcnatcccctnaaccangtaanagtgaaaaaagggacgcttggnataaataaggtaaaaattgtggtcaaggggagcccaggcntaagnaatgggtgtggtgttggtaagaatggaaaaaggtttttgtattttggnaaggttttaaaaagggaaaaaagtgggngggtggtagttgatggaaaanttgaagcaagtgggggaaaattaaaaaaatggatggtgggtttggttttgatggtggcaatggcagaattgaaatttttgggaaaaant

SEQ ID NO: 672920 - DNA, 399 bp, Homo sapiens
  misc_feature (46)..(46): n is a, c, g, or t
  misc_feature (285)..(285): n is a, c, g, or t
ggtggtgttggacggtgatgtagtagagatgaaagaaaagttcggnactttctttgctgttggatatctggagcctccaacatttagctgggatgaaagacagcaagacaattgtggcggggaatgagagacccagaagctccaattttccaagtggcagattacggaatagttgcagatttatttaaggtagttcctgaaatgactgagatattgaagaaaaaatgaatcaggatcatgccttaaaaagaaaacttttgttaaagtattccattgggggggganatatttgtgggtattataacaatcattggaaagcatggagagctacatttcatattttgagggaaaatttctaacagatgccagaatgcttggttatgggattgctgtgtttgc

SEQ ID NO: 672921 - DNA, 133 bp, Homo sapiens
tcgatgggatccttgctgtatcatcagaccctcccctgagcagactgtaggcacctcgatgtcagcaggttgcaagcatatccaccttgcgctgcacactgtctgcattgttcaggagcggaggctacttcat

SEQ ID NO: 672922 - DNA, 141 bp, Homo sapiens
aggaatggctgttccttggggcttcaggtctcctcagcacagaacagtgcctcttctcttccactggtctctgtttgtgatgctggtgaagagtatcctgggttaggagccacactggcgctgtgttcagaaccgtcactt

SEQ ID NO: 672923 - DNA, 424 bp, Homo sapiens
cagcatgcccagagaatctgtgccctccctaatctagtgcagtcccctgccttacacagtataggtggcagtcctgcgaggggaaaggactataaaagggcaattgatgtcacaggtctctctgtgagagcagaacagagtctggcatgacagttcgaagcctacggaagtatgtatgcaaaacatcaggacagagcagctcccagggggtcgatcttctcaaggttcagtctgttttctccagatcttgcttggtctgctgcctggcctcaggatgtttatcatagtgttctgtagtctgattccctcaaaccgagccggacgacatatttgggtatctatagtaccttctaagcttagtaggactgtctgtctctatcttgccctaaccagcttgtctttttcctcctttgtgcggctggat

SEQ ID NO: 672924 - DNA, 442 bp, Homo sapiens
gttgggttttgttgaaggctttgctggaaaagaatctgcttccaagttcactcagactgttggcagaatttgttcagacctccaggtctgagggcctgggatactgtctggctcaaggctggaagctactttcagttcttagaggctacctgtggtccttaaaggttactcataattccttgccatgtggaatttcccagtacagctgctgcttcctctagctagccaggggagtctctagagtgagtctattcccaagataaagtctcacgtaatgcatgtgtatataatggagtgtaatcataggtatgacatcccatcactgtgctatattcttttgattaggagcaagtcatgggtcctatccacactcaagatgtggaggactgcataaaagtgtggacactctaaagtggttcaccatagagtcaagggaaagata

SEQ ID NO: 672925 - DNA, 325 bp, Homo sapiens
gtatcacaataaggaagggtcccaggcttggggagagccccaagttgagaacaagtaatgaacaattgttgtactgaaccacttagttacgatgactcgcttatcataaacaacctgtgtgtaatatgttttcctcctacaaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 672926 - DNA, 1063 bp, Homo sapiens
cagcccatggccctaacaggggcccatctcgagacctcctaatgacctccggcctagccatgtgatttcacttccactcacataacagctcctcatactaggcctactaaccaacacactaaccatataccaatgatggcgcgatgtaacacgagaaagcacataccaaggccaccagacaccagctgtccaaaaaggccttcgatacgggataatccgtatttattaccatcagaagtttaatcttcatgtcgcacggatattttctgagccttttaccaactccagacatagcccctacccaccgcaattaggagggcacatggtccccagagcaggcagtcacacccgctaaatccacctagagagtcgccacttcgtaagagcacatccgtattactcgcatcaggagtatcaatcacctgagcgtcaccatagtctagatagaataacaaccgaaaaccagaataggtcaagacactgcgtcaattacaagtgttactgggcactctatcttgacccatccgtacaaagcctcagcaggtacttcgacgtctccccttcaccatttccgagcggcatctacggctcaacatgatcttgtagccacaggcttcacacggacttcacgtccattatcgggctcaagtttactcactatctgctacatcccgcaactaatatatcacctaaacatcccaaagagtcaaaaatggaggcgacagccgccgacacgaatacggccacttgcaagacacggagccggccaaccacggcaggtctcccacgaatggacgagcgccctacccacacaccagacccccacacgaacaccacacgggcgccgccgaaacacactccccagagagcctcaaacacggccgacccaaagtcaggacaaagcggcacaccaaggaggtgcaaccacacagacgcagccgcaataaaaacacgggagcacacacagagagggacacccgacaccacaaccggggggaaaaggcgacccccgcgtcgcgcccgacaacagcgacgccacaacgccagccaaagcaaaaaacca

SEQ ID NO: 672927 - DNA, 109 bp, Homo sapiens
ctagatggatcccgctccgactggggtggggatggcaggcactggaactgtggcctgggtggctcttcggcttggccccttctagcccgtcgtgactggatggatgcgt

SEQ ID NO: 672928 - DNA, 650 bp, Homo sapiens
agctcccatgataatgttggttttgtgacccaagatgcgggtacttcggccaaggctgcaatcagtgattcagcgactcgctctttgagtccagatgttgatccagttcttgcttttcaacgagaaggatttggacgtcagagtatgtcagaaaaacgcacaaagcaattttcagatgccagtcaattggatttcgttcaaacacgaaaatcaaaaagcatggatttaggtatagctgacgagactaaactcaagacagtggatgaccagaaagcaggttctcccagcagatatgtgggtccttccatgggtctgaagaagtcaagctcgttggagagtgagcagacatcagtcgccaaggtgactttgtatggggatattcctttccatcgtccccgcccccggataatcaaaggcaggggatgcaatgacagctcctcagacaccagcgacaaatgatatgagatcccatcggtaattcacaataaccacggcctgagggcctgaccatcacactccgtgtcaagaacgcagcccgggctgtcgtctgtatgcccactgcagtaggcaaccctcccgctctgaagagaattttagagattcagaacgaaagccaggtgcccaccgcgatagtccagcccctcaccggg

SEQ ID NO: 672929 - DNA, 142 bp, Homo sapiens
ctcagctcacagtgttacagaccaagtatgtggaagccaaggtactgtctgaacgtgctgaacaagagcaacgaggggaaagaattactcgtcccactgacgagttctatgtatgtccctgggaagcaatggatgagtggaa

SEQ ID NO: 672930 - DNA, 284 bp, Homo sapiens
gtggtggaatatgtctgaataactaatcccagctttcgatagctcgtcgcctgttgaggccgctagttgtggatgcaccatagtatcagtctctcgcccctgtgcaatcccgtttccctctctcctactgtgtattgtgcccagagtgcttgccaataaaaacctcctgtatgtaactctcagagtcgcaggggctgtatccttggctatttgagctcgaagatacggaacttagctgcgtctcagtcacagtcctgagagccgtcagtgttagcaggcctctg

SEQ ID NO: 672931 - DNA, 170 bp, Homo sapiens
aacatcccgcttagacagagttgtgcaggataatgagggtggtacgcggtgagtaggccactgggcacgcggtccagcgcgttggttgtacacggtgcactgtgtgaaccgtattgagtccatgaaaaggccagtgagtggataccttgtaccagaatctggttgcttgt

SEQ ID NO: 672932 - DNA, 293 bp, Homo sapiens
caactcgagttttagtaaactacataaaaagacaacctaattattaaaaactgggcaaatgggctgaatagacatttctctcttttactttattactttctttcttttgagacagtcttactctgtcacccaggctggagtgcagtgagctatgatcataccagtgcactccagtgtgggccatagaatgaggccctatctctaaaaatcaatcaatcaattgtgctgggattacaggcgtgagccactgcacctgaccctgaaaagtatatcaatcaagaaggaacaatcag

SEQ ID NO: 672933 - DNA, 112 bp, Homo sapiens
gtgatgggatgacgccccgtgcgtactcaccatccatgtgtttggcccccactccacagctgttgcctcaccacctacctctttggccaggaccctcttcccagcccagtgt

SEQ ID NO: 672934 - DNA, 447 bp, Homo sapiens
  misc_feature (133)..(133): n is a, c, g, or t
ggggtttccgtctccccccccttgcgcgtgggggtttgtttgcccccaatcccggggtttttcaaattgtgtttccctccccccccctttcccaatgggcgggggggggggcgggggggggtgtttatacccnacctttttttgtgcccccccatttgcggggggacccccccccctggtttttgtcccccttaaaaaaccccggggccgctcccccccccggtttttttcctggggcggggggggggttctctttttcccccggggccccccttgccccttgggccctttttggggccccctttggcccggttttgcccaaaaacccgggggggcccggtccgggtttcccggggtttttttcccccccgggcccgtttcccccaaattttggggggggccgggggtttttgggggttccccccccaaagggggtttccctgggta

SEQ ID NO: 672935 - DNA, 416 bp, Homo sapiens
gaatctagacggggacggcagcattagcatcacctgggatagtggtagaataggttcttagtcccatccttgatcttctgtaactgcagaagtacacgtgcaggtttgttatacaggtaaacttgtgtcatgggggttgttgtacagattattttgtcacccaggtattaagcctagtacccatgagttattttttctggtcctctccctcctcccaccctccaccctctgatggagaccccagtgtctgtggttcccctctgtgtgtccatgtattctcatcatttagcccccactgatgagttagaacatgcggtatttggttttctgttcctgtattagtttactaagaataatgtcctccagctccatccatcttcctgcaaaggacatctttttttttttttttttttttt

SEQ ID NO: 672936 - DNA, 251 bp, Homo sapiens
  misc_feature (14)..(15): n is a, c, g, or t
  misc_feature (39)..(39): n is a, c, g, or t
  misc_feature (65)..(65): n is a, c, g, or t
  misc_feature (93)..(93): n is a, c, g, or t
  misc_feature (102)..(102): n is a, c, g, or t
  misc_feature (104)..(104): n is a, c, g, or t
  misc_feature (120)..(120): n is a, c, g, or t
  misc_feature (142)..(142): n is a, c, g, or t
  misc_feature (145)..(145): n is a, c, g, or t
ataggtaggtcganngtgacatcccactcatatgtattnaccaagagaaacgaaaacatatgttnatataaagactgtacttgaatgtttatnagctacatncntgagagccaaaatctntaaacaaaccaaatgttcatcngcntgtgaagagataaaaatattgtgttgtatccctacttaacaataaaaggaaaagggctactgattgacacacacagcagcatggatacctacctatttcacaatcg

SEQ ID NO: 672937 - DNA, 87 bp, Homo sapiens
catggatttgctggtgcagtacaactaggcttaatagggacatgtctgttgttcaagtaaataaaagttgccctgacttcgaaaaaa

SEQ ID NO: 672938 - DNA, 213 bp, Homo sapiens
tggtagagggtatgtcgttgcatggaaaggggttgcagttgtgcagatgcagtgagtcgttatttcagcacacaggtcacatgttatggtaatgaagctatagcatctcccagggtgaagatactagcatggtaatgaggaaagtacactgggatccatctgtaaattgctgaggtctgtcatgaactggtttaaaccagctagctggctgca

SEQ ID NO: 672939 - DNA, 298 bp, Homo sapiens
  misc_feature (2)..(2): n is a, c, g, or t
  misc_feature (53)..(53): n is a, c, g, or t
  misc_feature (122)..(122): n is a, c, g, or t
  misc_feature (151)..(151): n is a, c, g, or t
  misc_feature (154)..(154): n is a, c, g, or t
tncactgtaaaagttaccccttcctcatcaccccactttcctgtacctgtacnctttggaagaaagtcactatatgcaccccaaatttaaggagtgggaagttatgccccacccatttgtangcagaaaacctacataaattgtttggcantcntctgcataggaaaattatctcactctcccagttatttatttatttgatctttttttatatcagtatggactcatgggtatttcttttatactttgggttataatccaatactaacacaataaagaaatttttaatggagatgca

SEQ ID NO: 672940 - DNA, 384 bp, Homo sapiens
  misc_feature (31)..(31): n is a, c, g, or t
  misc_feature (74)..(74): n is a, c, g, or t
  misc_feature (85)..(85): n is a, c, g, or t
  misc_feature (88)..(88): n is a, c, g, or t
  misc_feature (112)..(112): n is a, c, g, or t
  misc_feature (125)..(125): n is a, c, g, or t
  misc_feature (134)..(134): n is a, c, g, or t
  misc_feature (137)..(137): n is a, c, g, or t
  misc_feature (151)..(151): n is a, c, g, or t
  misc_feature (177)..(177): n is a, c, g, or t
  misc_feature (180)..(180): n is a, c, g, or t
  misc_feature (206)..(206): n is a, c, g, or t
  misc_feature (221)..(221): n is a, c, g, or t
  misc_feature (224)..(224): n is a, c, g, or t
  misc_feature (228)..(228): n is a, c, g, or t
  misc_feature (244)..(244): n is a, c, g, or t
  misc_feature (265)..(265): n is a, c, g, or t
  misc_feature (294)..(294): n is a, c, g, or t
  misc_feature (321)..(321): n is a, c, g, or t
  misc_feature (327)..(327): n is a, c, g, or t
cccttctcccagccctcttctatttgatagnggtcggtcccgcagatcagcaatgtcttagcccctctcctctngtccattcctnccnggttgggactcattctcttctaanttttaataaacanttagcgtanaanacattacagtaagngctatttagagacaaacttaaaacanacnatatagtttaaggatctaagaatccnttagagaaggcacangantgangtgcctcagctgggcnggctgggagcgcagtggtgtngaagtgtaaaagtaagaatgccagcgcgnaacgctcacgccctgcagatagaaagncgtagnctgtgtgtattagagtgagccagccctgagatagatggcagcgtgaatccacacgtg

SEQ ID NO: 672941 - DNA, 923 bp, Homo sapiens
ggtgaccacgggggagacttttagtttcgctttcgctaaaggggccccagacccttgctgcggagcgaacggagagagactgtgccagtcccagccgccctaccgccgtggaacgatggcagatgatcagggctgtattgaagagcagggggttgaggattcagcaacatgaagatccagtggatgctaagccagaccggtcctcgtttgtaccgcccctcttcagtaacgacagaagaaaactgtcaccatgcgatccatcaagaccacccgggaccgagtgcctacatatcagtacaacatgaattttgaaaagctgggcaaatgcatcataataaacaacaagaactttgataaagtgaccggtatgggcgtcgaaacggaaacagaccaagatgccgagggcgctcttcaagtgctttccgaagccctgggtttgacgtgattgtctataatgactgctcttgtgccaagatgcaagatctgcttaaaaaagcttctgaagaggaccatacaaatgccgcctggttcgccgtgattcctcttaagccatgggagaacgaaatgttatttctggggcacagatggtggtccccccaataaaggatttgacacgccactttaggggggatagatgcaaacccctttaagagaaacccaaagtctctatcagctgccgaaggaccccgagcttgtgattggatccacgccgagtcgggccactatgccagatgctaactgaataaaacccgggaagtggatccttgcatcaaggcgggatacctggggaccgaagcctgttgacctcaccgggaggagaacgagatacaccccggaaatcgagttgtactgatcactctcaagacggggttccagcatacacagatcgaaaaattttgattaagagtcgtctttatttcata

SEQ ID NO: 672942 - DNA, 121 bp, Homo sapiens
ccagaatgatggcgtagcagatataactgctttggagcaatctcttctgtttagagcgatagaagtatgacatatgtaatacacatctgtgtacacagaaaccggcacctgccagaacaga

SEQ ID NO: 672943 - DNA, 1007 bp, Homo sapiens
gtatcctgttagcgccagtgatgtatacagcattaggtgaatagtactgtcgttgatacctatatatcatgtatcatgacgtcagcttgtggacgtaacaggatagtctgtcggctatgtgtttatttaaattattggtattgaaaagcaagattagtgcacaaaaggaatatcgagaagtgcgatcaggaagaacaatacactttggttcacgagtactcacagatatgctcagatgcttctctggttgctggggacgaagatctatatatatgcatacaatctcgattagtagtatgatgtgggggtctcagctcttagtctcacgttgcgtggtgtaatctattgaggagggctagtttcatgtcaagtaggtcgacgtcgttaaacaaggaagtaataattgaacatttgagtcacttgaatacattttagctgaactcgatttctacgcaatctattatgtgaacttataatcagatggtgatcgttgaaatactcggaaagcctactactctatgcacacattttatgaattgtactgggaactggggctatgttcatggagaattagtatcgggaaattctgaaagttgactcattggtgaagtaagggatggccggcctttgatcataatttacataatgagtaccatcggattctatagtgtaatatgggttttacactggtgttactgaatttataaacgtgtatactaacgtttgtctggctttcttaaaactatttgttgggtgactgtatcaaaaagattgaggaatggtctacggtgagagagttgtggaacaagaggctaagtaaagttgctggtaattcaacactccttatagttttgaaagagctcctctgtttaaaatgtgaaattacgtgaaaagtaaaattatatccatacgggcttctatcaggtatccatgtcgttccgttggtaatccttgaatggagttgaagggagcaggaaagtctagatatgtaatataatcattcatct

SEQ ID NO: 672944 - DNA, 139 bp, Homo sapiens
agaaaagaagaatcgcgatcggatataaaccattaacttccctctacagttatcatcttcacaattctaatgctactgactatcctagaaatcgcggtcgccttaatccaagcctacgttttcacacttctagtaagca

SEQ ID NO: 672945 - DNA, 1012 bp, Homo sapiens
  misc_feature (1)..(1): n is a, c, g, or t
  misc_feature (92)..(92): n is a, c, g, or t
  misc_feature (143)..(143): n is a, c, g, or t
  misc_feature (152)..(152): n is a, c, g, or t
  misc_feature (160)..(160): n is a, c, g, or t
  misc_feature (172)..(172): n is a, c, g, or t
  misc_feature (181)..(181): n is a, c, g, or t
  misc_feature (253)..(253): n is a, c, g, or t
  misc_feature (269)..(269): n is a, c, g, or t
  misc_feature (296)..(296): n is a, c, g, or t
  misc_feature (311)..(311): n is a, c, g, or t
  misc_feature (335)..(335): n is a, c, g, or t
  misc_feature (402)..(402): n is a, c, g, or t
  misc_feature (420)..(420): n is a, c, g, or t
  misc_feature (422)..(422): n is a, c, g, or t
  misc_feature (454)..(454): n is a, c, g, or t
  misc_feature (493)..(493): n is a, c, g, or t
  misc_feature (506)..(506): n is a, c, g, or t
  misc_feature (528)..(528): n is a, c, g, or t
  misc_feature (535)..(535): n is a, c, g, or t
  misc_feature (546)..(546): n is a, c, g, or t
  misc_feature (572)..(572): n is a, c, g, or t
  misc_feature (632)..(632): n is a, c, g, or t
  misc_feature (664)..(664): n is a, c, g, or t
  misc_feature (669)..(669): n is a, c, g, or t
  misc_feature (792)..(792): n is a, c, g, or t
  misc_feature (878)..(878): n is a, c, g, or t
  misc_feature (894)..(894): n is a, c, g, or t
  misc_feature (901)..(901): n is a, c, g, or t
  misc_feature (920)..(920): n is a, c, g, or t
  misc_feature (923)..(923): n is a, c, g, or t
  misc_feature (927)..(927): n is a, c, g, or t
  misc_feature (946)..(946): n is a, c, g, or t
  misc_feature (948)..(949): n is a, c, g, or t
  misc_feature (999)..(999): n is a, c, g, or t
ntttttattattttttataattattattaaattatgttatttttagttatttacaagtactacaatgttctatgcattttttcatcttaganattaatttaacacatccctttggtcttagatacttctctttggtctgtgtntgctccttnctgaatcncaatcttctgtnatgtgaggnaatttacgtgaacttttcacatatctatttttttccttgtgcacagttgagaatttcctcctttagattccntatttgctcaaaaggnaaatgctctaagaagttatctgcagcncatagcatttgtctnagagcagaaagaattagaacatcntttacagggtccagctcccactaagaggaataattgctaaccaccgagatgtgagaaagagcaaatncaagttttctttggactncntctagcttggacctcacaggctcacatctctntatttctataaggtcaccttttgtaatcaaatccatgcnatccacatgagtnagcaaagccacaggtaccacancagcgtntaccaactccnttcgaattcttttgatctttactatnatctgagaggagaagtactgaatagagctggcatcaaatacaaatgccacagaatgaatnctgtgcttcagcgatggggaatcaatgtagtnatgangatttaatttgattgactccatgggattaaactggtatctattacgaatgttaccgttcaagatatagaatatgttatccctgcacaggccgccttctttcttacttagccccagttagttanacagaataaacggcaggtatttgccatctttcccgtctctaatagagtatgttctatacttctcagatatcccagttgtattagtncccaccaaagcctgangcgttanatgcccttggataacaganctnattnagttgaaaaagctggactncnnagctccaattggacccagcagcagattcgtattttttgaacagggatcanatggttataagta

SEQ ID NO: 672946 - DNA, 150 bp, Homo sapiens
taccaacaggctgtatagtcaggtcgtacaacgcacaaagggaaacgtcaaaggcctccattaccaatgacaagctcccatcagtcaaacacaaagtcgatacaaagttgggaaaacctacctaccaacccattttctatccctaatcaa

SEQ ID NO: 672947 - DNA, 320 bp, Homo sapiens
  misc_feature (43)..(43): n is a, c, g, or t
  misc_feature (137)..(137): n is a, c, g, or t
  misc_feature (144)..(144): n is a, c, g, or t
  misc_feature (158)..(158): n is a, c, g, or t
  misc_feature (163)..(163): n is a, c, g, or t
  misc_feature (172)..(172): n is a, c, g, or t
  misc_feature (186)..(186): n is a, c, g, or t
gtaccgctgaccgcttaggaacacacccaacacgatacatttnccagtgcatcgtaattccactgagcaagcgaggaggggacgcatgtctaaatgttaacaaagatgcactctcgaggtgttccatcttatcagcnaaatccngactggaagactcnagtcnaacagcccnagtccttgagaacnaaaattgtaaagacgaaaaaaagatggagaaaaacccatacagttatactgaaagaggcttgccagacgtgggagcacacacctgtagtcccagctactcaggctgaggcaggaggatcacttaagcggatcag

SEQ ID NO: 672948 - DNA, 468 bp, Homo sapiens
gacactaaaggatcccctgggataagctgaatacggcgtaccctggccaggctatatagtctgtggttgtagcagtctgtcccacagtttaggcttacatcttttcttttttcttttctttgtcagcaaaagtcccacgcatttgtgatattatatccgaatctgtattagcatactgtcttcgcatgggtttcaccataaaatggaacatccttgtagctgtctcaaggcatttgtggatgagcccagttccttaaatatgacaaaggcctgccccctcatcttcatggtctttcaaagccacaatgtccaccacatgaccaaacctgagaaaacagggcatatagggatctcttcaattcttccttaataatttggtcattcatatggttgatataaatggtatgatatggtctgatatccatgttggtgtaaacttcttcaggagacagtaaaaaatcatacttg

SEQ ID NO: 672949 - DNA, 419 bp, Homo sapiens
  misc_feature (13)..(13): n is a, c, g, or t
  misc_feature (34)..(34): n is a, c, g, or t
acccctatgccancccttttacctgtaccttttnataaatatcctttataataacccagtaaatgtatttccccttagttttgtgagcccactcccagcaaattgaacctacagagggaattgtgggaacctcaacttgaagccagtcggtcagaagttccaaaggtcacccgggcgcggtggttcacgcctgtaatcccagcactttgggaggccgaggcgggtggatcaggagtttgagaccagcctagccaacatggtgaaaccctgtctttactgaaaatacgaaaaattagctgggcatcgtggtgggcgcctgtaatcccagctacttgggaggctgaagcaggagaattgcttgagcctgagaggcagaggctgcagtgagctgagatcgcgccactgcactccagcccggg

SEQ ID NO: 672950 - DNA, 212 bp, Homo sapiens
tctagaggatccctcagaagcggacccccaacgttcgggaattacatggctgtacgactgcgcccggcccatacaattttaatatgcagaaaagatgaaactgtgaaccccacagaccaaagctcttcccattcatgaacccgcaccgcgattcaggattctcccctaaagaccctccgttgttccctgcacaattctgggagagacacggc

SEQ ID NO: 672951 - DNA, 707 bp, Homo sapiens
gccttagtttactcattgataaaaagttgaaagattttactgccggatgcatacaatccatttttgttataggggttgctactatctgttcactgagaaaagacatttttttaaaataggagaaatcctacatggcttgtcatttagctctggtcatttgaatattacataccactcatgtacctgccaccagtcagaaaaatagccgtcattttgtgaaaccagtgtgtgtgtgtgtgtgtgtgtgtgtgtgtgtgtgtgttatagacaagtgcagtagtgagaagaggggaaaggaaactagtgtgtgaattagtcttcagaaaggatttgtggctgtgtgcaaagtatatcttagccctttttgttgctatctttaatatgaagtataagtattcccataggaagatgtctggtatatcacaaaaggcgggtgtatagagtatattgtgtaagtcgttgtaattagagagaaaaagtatgatgaccaagagttgctatcaatgcttcctagtgaagcaaaattcatgcgtgtcaattaagtgggggggtgtggggtttctattccattcatatcaatatctcttaatagtgagtcgctaggtggtgtggggtggttgtgaatcaaggtacagcagtgacgttatatatgggtccctgagagttaagcactactattgtcaaagattgtcaagttggaagaactc

SEQ ID NO: 672952 - DNA, 713 bp, Homo sapiens
ctgcggtcctgcagcactaattatggtaggcagagtttcttcttcctgtgccaaagaaatccttttgaagccgacctgcaagttacattttgttttcaagattttaccacccgtctaaggttagaaatattttgggcactgaagagaccactagggaaataaaaaatgggatcagcccatatgagcgtgtattgacatgagttgcccctatatcatatgtgatcatggctcacgcaagcccgatctggtaagcacaagaggttctctcacatcagccctccaagtagctgggtcactaggtgcatgtcaccatgcccactttctttatattttttgtagtcatgagatctcattgtgttctccatgctgattcaaacctgctggggtcaaccaatcctcccattttagcttcccagagggatgagatagcaggtatgtaccaccatagcttggctgaatgagatttttatatatgaatgattcaaatgttcagggatgaaagagtcgctaacataacagaagaatgggatcaggtcataaggatgaatccaagcatccttagatattcttgaaatcagaaatgtgccccctgcttatatgaaaggttgtttgattacatggagtaaagtggaaatgaagtattgcctgcacagccctcaagaagaatcactcaatgctctgaagagtaccagttaactgattatgatctgaat

SEQ ID NO: 672953 - DNA, 345 bp, Homo sapiens
aagttgtccaggtctctattattaatcaagctaaattttgaacagaagagtttcataacagtcaactcaaacacacagagttttatgtacaaagcttggagttcttattattagcttgaataaatatgacccttacagtgatatgcagctgtataaaataacagcacccatcttatatatatatagtgcactaaagttataatggcttttagcatatactattacaagctgccttgaggcagtagagacatttattcttgttgcacagatgtgactactaaggatcagagatgggaaatgaattatttaagatcacacagtgtgtctgtagcaaaatccactctg

SEQ ID NO: 672954 - DNA, 1159 bp, Homo sapiens
  misc_feature (551)..(551): n is a, c, g, or t
cgatgattgcggacttcggaggcgaccactgaggtgtgactacatggtctaacggatgcatattgctcccaggaaatcaggccctagagagacaacgtgcagggtctccttgaattgctgcgggggccgcgggatgatctgtgagactcgagacagaccgcttatgtgggaccagtgatggaatggagaaagtccagaacatgcagtgtaggagctgattgcatagcatgtgacggtaggggtggatagagggacaccttccgccgtgcgggatgtgaggctcggcgagtcagaagtgcaagactagccgcaggcatgtaaggcctacttcaagtacgaagattcgatattggatggcgaggagctgtgcgtcggaccctgtcctctcaagtgatacggataaacaagacgactggagaagactccacacgagagggacgtcggcgaaggtcacgtttccgtggacggggggacatttggggggtagccaatacgcattggttgccacaggcaattgaccctacgcgctccgcccccggtgtccacgaaanccctcaccttcaaaaccctcgaagggttagcgccttcgcgcgcatccgtgagacgtcagaaaggctccaccggttcaaaggcgcggggtcgatgctcgacgcaattgccaatggtcaggtcaagactgggaagagcctcggacattgagaatcacctgggtgaagctccccacatggaacttggtccttgggaaccaggtacgaacccaaggaaccaaggtggaacgggttcgttcgcggtgactaaaggacaaggaactggactttcccgttcgcggccgtgagggatcgccactttggttgaaaagttggccaaggtcgcgtttcgcagagatgaacggcattatccctagttaacattgttgaaacgattttttacatgtccccaggcttaaaagcgtagggctcgtccttgaacttaaatgcgttttttacaaggttaccacttgggtaattgggccccaggggtggatgaaaccttcgtcgtaccgttaagagtaagacacgttggggaactttttgtattcggagatcccttcgttccttgcctcttggagcccagaaccactccaccgtttctcgtgaggataggttatagagcacactga

SEQ ID NO: 672955 - DNA, 206 bp, Homo sapiens
ttatctcattccagcctttactaaaatgtacaaggacttacagaccccatacaagtcaaaaacccagcaggccagtcattgaatcctacagctccaaatcatcttctctgaatctacatctacacatctggagcacaggtgtgtgatgcctgggctcccaaggcattgggcagctctgcacctgtggctgtacagggtctatcccc

SEQ ID NO: 672956 - DNA, 511 bp, Homo sapiens
acaaaggagaccccgctctgagacaggctgcagaaaagggagctgggtctcagcagggctggggaaggctctggccccagccctccgcccaacccactgccctcctctcctggaggagatgctccccaaattagccatcatgagcgctggctctgggggttgggcgttggggagcagtttgctcagctggcaaatgggaataacagaacccgtccctgggactatgagatcaaggtgcttaacaaaagtggcgtctgctgaggggaaaagccaggcccaaaaggctgcatactatcattttgttcattggtgcaagtttttgagacagggtctcgaccagtcacgcaggctggagtacaagagcgcaatatgggctcaactgagcctccacctcctgggctgaagtgatcctgacgagtatctgtgactacatgctccccccagctggtgcgtaaagtaatttgtatattgagcgaaggcggagcttcaccgagttggccaggatggactc

SEQ ID NO: 672957 - DNA, 224 bp, Homo sapiens
gacaccggccggacccataggtcgcaggcatgcattgatcaagaatgctataattactatgcataaagtcaattctctgggctgtggggggtagaattggtgcttaagaagagcaatgcttctaccaatataaattaatactatgaagcaattgttttattcagataatctcataaataattttcaatgtacatgcttagcatactgtccctgcgaacctatga

SEQ ID NO: 672958 - DNA, 650 bp, Homo sapiens
  misc_feature (2)..(2): n is a, c, g, or t
  misc_feature (23)..(23): n is a, c, g, or t
cnttttcccaagctcaattaccntcatagggacaaagctggactccaccggtgcgccgtctagaactgtgatccccggaggaatgaaaggttatctcggaaagtatcaggatatgggcgtcaccatctacctgactccagatggtaagcacgctatctctggttacatgtacaacgagaaaggtgaaaacctgagtaacacacttatcgaaaaagaaatttacgcaccagccggacgcgaaatgtggcaacggatggaacaatcccactggctcctcgacggtaaaaaagatgcgccggtcattgtctacgtcttcgccgatccgttctgcccatattgtaaacagttctggcagcaggcgcgcccgtgggtagattctggcaaagtgcaattaagaacattgttggttggggttatcaagccagaaagcccggcgacagcagcggcaattcttgcctccaaagatcccgcaaaaacctggcaacaatatgaagcctctggtggcaagcttaagctaaacgtgcctgcaaacgtaagtacagagcaaatgaaagtgttaagtgacaatgagaaactgatggacgatctgggggcaaatgtcacgccggctatctattacatgagtaaggaaaatacgctacaacaggccg

SEQ ID NO: 672959 - DNA, 434 bp, Homo sapiens
  misc_feature (9)..(9): n is a, c, g, or t
  misc_feature (44)..(44): n is a, c, g, or t
  misc_feature (50)..(50): n is a, c, g, or t
  misc_feature (376)..(376): n is a, c, g, or t
  misc_feature (400)..(400): n is a, c, g, or t
  misc_feature (405)..(405): n is a, c, g, or t
  misc_feature (434)..(434): n is a, c, g, or t
ttggtgtgnctcggtttctcggctgctgggtcggtccgccacanctgggncgccctatgtcgagtggcgccatggaaagagggctcagctcgcatgtggaagactctcaccttcttcgtcgcgctcccggggtggcagtcacatgctgaatgtgtacctgaagtcgcaccacggagagcacgagagacccgagttcatcgcctaccccatctccgcatcaggaccaagcgtttcctggggagatggtaaccatactctattcataacctcatgtgaatcacttccaactggctacgaagatgaataagagaatctggaccactaccgggcaccagggaccacagcactggtttggaccgttactctgcacatggancagaaaaagtatattggacttaantcacnttctttacttgtatcaaatgatgctggtn

SEQ ID NO: 672960 - DNA, 2146 bp, Homo sapiens
ggtgcagcagagtgcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaagaaagaaccgaaaaagaagaaacaacagttgtctgtttgcaacaagctttgctatgcacttgggggagccccctaccaggtgacgggctgtgccctgggtttcttccttcagatctacctattggatgtggctcaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaaccttttttttacagagcctaattaataacttaatgactgtgtacatagcaatgtgtgtgtatgtatatgtctgtgagctattaatgttattaattttcataaaagctggaaagcagctgcctgtt

SEQ ID NO: 672961 - DNA, 187 bp, Homo sapiens
caggagcgacttcgtacagcggcgagtgtatccaatctctccctcatgaaggccagccctttaccttatctaactaccagaccaacaaagccacgcatagataagctgacctatttctgatcctgactatggacaaggcccttcagccagaagactgacaaagtcatcctccgtctaggagcgtaat

SEQ ID NO: 672962 - DNA, 572 bp, Homo sapiens
gtgaggagctcactttataagagatcacacatgcaactgggatataggatggagagataaagagaacactgctgtcattagcccgtggcaaagctagagatctggcgaaaaatacccagggccaagacactgcagatcgtgacacggtcattcttgaagatgatttctaacataaacttttctggatatagatcaatcaaattcacatcaaagaaacagctgaagaacaagcacgcactcccggaggagtgtttcaagacagacacggtcaaattggtgctgcaattgttcgcattatgtggatgagaaacagacttataccaatctgcgttgttcctagaggcacaagccgattgaaatttcacgtaagccttgtggtcttataaagaggtatcctttatttgaccgggctccctcggaagggctcaaggaaattccaacaccggccaccatttttgatttaaccgtggcccttcgcaaatttggggctcttccaggaaccgcgggttaacctacccggtggatcctaattgagctctttttttctctcccttagaccattgggcggggtt

SEQ ID NO: 672963 - DNA, 1779 bp, Homo sapiens
ggtgcagcagagtgcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaaggtgagggcccggcaccccgcgtggagggcgaggggagggaggaggcggaaatgggggatcaggggcgtcccggggtcggcctggtcaggggaccattgggatagccagggacaggaagcctacgagccagagaggacctgggggtgccctgggacagggggtgacggagaaaagctgtgggcgccctcgcccccctttgctcacccgcactccacgctctgcggagaggctctgccggcagccccatgtgattccccgctctgcctagccggtttccattcttccgtgttgagcggctggggcttgccgccccaaaccccagagatgaccccagaaatctgggaaactccccttggttccccatctctcatcccctacctcccactccacccacctactcttgcgcctcaactctgctgttagggccgctcaagttcattcataagaacaagagctctgctcttaaaggagccgcgtccctcaggcatttgtctgaatgtggatgttcgcgcgggaacggtgctttgcgcatcgagaccatcgaccacatccccagccctggggacttattgaaggaccaaataaaatgaggcggccccctaggaaaggatctcaggcaatagataccttcgtgggaggtgactgccttttccttttaattttattaactgatctttggaaggagctgggtgagcaattatgctgttactatgtatgagtaatatctactttccctgggcaacccaacctccctagtgccccacccggagagggatcaggcctgaacctggaggcctttcctcccgtctccaaggtcctctaggagctcaggggtggagggcgatgggtcgggaagctggagagtaggacagttcctgggtccgcctgaagctctggctgcctatagtggtcagggatgctctgggataggtggaacagctgcgcctgcagccagctgggccgggcccccgtagctctctagagctctcaccaggagtaggcaggtggatcctgtctctgaggcagggtgggagcctgggctgggctcaggcagctcttggcagcaagcggattttcaggttgtggcagctggtgccgggtggggacaggtcggctgctggagcatgctccccctgaaacctggaaaggagcagtgcctgaggccttgggaggagttctttagggatggtgggctgataagtttccttagaatctccaggagggaggtggcttaggggctactttcacacaagtatggattccccttttccatgttcctaagaatggagaacacctttcttttgtataaagtgggatctcggagatcgagaccatgctggctaacatggtgaaaccccgtctctacttaaaatacaaaaaattagctgggtgtggtagtgggtgcctgtagtcccagctacttgggaggctgaggcaggagaatggcgtgaacccaggaggcggagcttgcagtgagccgagatggcaccactgcactccagcctgggcaacagagcaagactctgtctc

SEQ ID NO: 672964 - DNA, 363 bp, Homo sapiens
gtgactcgtagaagatcccgtgcactgcttcggatgctaccaggtgacgggctgtgccctgggtttcttccttcagatctacctattggatgtggctcaggtgggccctttctctgcctccatcatcctgtttgtgggccgagcctgggatgccatcacagaccccctggtgggcctctgcatcagcaaatccccctggacctgcctgggtcgccttatgccctggtgagtagaatatgccccttcgaggtggcacaaggcaggacttccagcatatctgctccttggtccttctctctgtcttgtcacaggcagaagggtgaggagaaggaaggagttaaaagcccaagggtgttgaaaccc

SEQ ID NO: 672965 - DNA, 605 bp, Homo sapiens
  misc_feature (157)..(157): n is a, c, g, or t
  misc_feature (159)..(160): n is a, c, g, or t
  misc_feature (169)..(169): n is a, c, g, or t
  misc_feature (174)..(174): n is a, c, g, or t
  misc_feature (235)..(235): n is a, c, g, or t
aggatcttatttactggcatttggagggatgggaggtaggggtggggcttacttgtagtagcttttttttttttaacagacttcacagagaaatgcagttgtcttgacttcaggtctgtctgtcctgtgggcaagtaaatgcagtactgttctgatncnnctgctatanaatgnttgtgaaacgactggagtatattaaaagttgtgttccccaatgcttggagtagtgattgtngaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctgcagtagatacagtggttctctttgggacatacaggcccatcgggtattctatagactccctgcacgca

SEQ ID NO: 672966 - DNA, 1065 bp, Homo sapiens
ggtttagcgcaagcaataatagagaacttcaaaaactaccatccttaaaaggtaatttttatttgtcttttaaaagttacattgtggctgttggacgtgaaggagcaatgttttgatagtgtgctaatttattcctttgctgtgtttgtattttgtggggtcatcttttctgtattgaggggattctttctgtgtatttctaagggtggacatctgtcatcaacttacgttacctcaactgaacattttaaatttccaagagctattcaagatacaaagctttaacaacacagtataggcattaataccctaaggacacaccggaaaaacgctgaacactctttttatatctatagtggcttattaagctacgccaggttttcccttttaacatttaattttcacatgtgtgttgcgctcttcaaaacgtgttcagcaaatctccgagagggcaatttacttcccagagtttccgcgtacagtgtgtaacacaacttatctagtagaaaagtttcccccatagtgtttctctaaagcgtcttaggcgcaccgtgttacgcctaatgagtcaccactagagtgcgaccttgtgccttgaggtctactgaagctacatagagagaggagaatttaaccctttcttaaacctccaaaggccattatccccttcagtttggtgaacaccactgtgtcggcgaaacaactgagggtggccctccgtataacacctgtggtgaaaaagtttttgcccgccccccaaagaggtgcaccacaaaagacgcgacttgctatacgatttttttacaccacaaacttccttacgaacgaggtgtgcgtattaaaactccgccgcattaaaaaaaaagatgtcctctctcccgttctataacgaacgttttgtgtgggcacagaactcttgcgaaggaggcgttggcctctttataaacaagccccgtttttcatactcacacaagggagcaacaacacacgccacgcgcggttataagcgggggagacccgcgcattcaaaacagtgctaccacaagtggtgtgttgccaaacacc

SEQ ID NO: 672967 - DNA, 429 bp, Homo sapiens
gtacaaacagagctcttgacatgttcagtttgttactctctggtataagtgactagttagcatggtgtccatgtgagtacgtgaacatcaggtctctcggggatgttggacgatactatcattgctacaggtaagaatctctcgtgctggctttgccttctctagctcacagggactctatgggcaccctagacgatccctttgatccaattggtgaagtcagattagtacagattatcactctgaatctgcatggggatccctggagtgcaccatattcaaggcatcgggccggagagtgtagtggtggtatgactgtctgtagttggcgtaggtggcgaactcctgagatttctttgcagctgtcacactgagcatatccagaggtgtgtggtacttgggcttgctgggttcatagcccttctagta

SEQ ID NO: 672968 - DNA, 463 bp, Homo sapiens
  misc_feature (306)..(306): n is a, c, g, or t
  misc_feature (309)..(310): n is a, c, g, or t
  misc_feature (312)..(312): n is a, c, g, or t
  misc_feature (322)..(322): n is a, c, g, or t
  misc_feature (333)..(333): n is a, c, g, or t
  misc_feature (342)..(342): n is a, c, g, or t
  misc_feature (345)..(345): n is a, c, g, or t
  misc_feature (359)..(360): n is a, c, g, or t
  misc_feature (366)..(366): n is a, c, g, or t
  misc_feature (370)..(370): n is a, c, g, or t
  misc_feature (374)..(374): n is a, c, g, or t
ataactactgactagtaaggactggataatccactttaatactgcttgtctggctggatgatccactttaatactgcttgtctggctggatgatccactttaatactgcttgtctggctggatgatccactttaacttaatgcacagtgtatacattttatctttagatccttctgtgacacggtcttagctctgtcactcatactgcttgtctggctggatgatccactttaatactgcttgtctggctggatgatccactttaatactgcttgtctggctggatgatccactttaatactgctngtnngnctggatgatncacttttatantgcttgtcnggntggatgatccactnnaatacngctngtcnggctggatgatggagaccgccacgcatcttccttgcaatgccaggatcatacagtgttgactgaataaagggcgccacggtctcccgtc

SEQ ID NO: 672969 - DNA, 291 bp, Homo sapiens
acttggcaaaagccccgaggacattcatctgaattggagatagctcttgcgttttgtcatgagtgctctgaggtaacaggtagaaagaggatgatgctatgtccgggtccttttatttacactgacctgtgaaaacaatagaaaccttgtgtgatgcaaaacaacataagctaaattattggacatggacgggttgaacggaaatctttgtatgcacatacagttatcagacagctaaccttcataatgttttaaagacctcataggagaaaatcagaaaagcacaaatcc

SEQ ID NO: 672970 - DNA, 383 bp, Homo sapiens
tctgggtgacagagcaagcctcaacaacaaaaaattgttcaagagcattactggcacaatgagtgctgaagagctgaagagccgaagactcatgggaagcccccctcagtgaactgagcaactttgatggaaatcatcagtaatggcttggttgaccccatctaaagaatgagcctaaattattgattggcatctctcaccaaataaactttagatatctagcatgaaacatcaatccatcagtcttttcgctgtctgtttcatgtcatactgtgagtagctccagtgatggcaatgtctttgaatgtgtgtcagcagtagatacagtggttctctttgggacatacaggcccatcgggtattctatagactccctgcacgca

SEQ ID NO: 672971 - DNA, 219 bp, Homo sapiens
ggttttccctttttttttttccccggccctcccccgaaactgccagggtgggggggggttttgtttgtccagttaaactgggggaagaaagtttattgttgggaacctgggctttttttgtggggtttaggcttggggggggcctttttggtttgtttttccggctttttgggggggggggtttgccctttttttgcctttatttctggggaaccctta

SEQ ID NO: 672972 - DNA, 1901 bp, Homo sapiens
tgactaccggggctcctgcaccagctgtcttctctgtagcatctaacttggcaagcatcgccatcttagttgtatccatttacagagggggaacactgaactccagaaggaacaaaaaacttcagcagctaatttttgagtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaaccttttttttacagagcctaattaataacttaatgactgtgtacatagcaatgtgtgtgtatgtatatgtctgtgagctattaatgttattaattttcataaaagctggaaagcagctgcctgtt

SEQ ID NO: 672973 - DNA, 172 bp, Homo sapiens
tctcagctataaaaggaaggaaattctgatacatgctgcaacatagataaccctgaggactatgctaagtgaaataagccagtcacaaaataaatactgtattatttcacttaaatgaggttatctagtctaatgcacagagacagaaagcagaatgatgattacttttgtc

SEQ ID NO: 672974 - DNA, 2229 bp, Homo sapiens
ggtgcagcagagtgcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaagaaagaaccgaaaaagaagaaacaacagttgtctgtttgcaacaagctttgctatgcacttgggggagccccctaccaggtgacgggctgtgccctgggtttcttccttcagatctacctattggatgtggctcaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaaccttttttttacagagcctaattaataacttaatgactgtgtacatagcaatgtgtgtgtatgtatatgtctgtgagctattaatgttattaattttcataaaagctggaaagcagctgcctgtttctgtctgtgtcctcagacaggtcctgatcccttctgtggccttctgcatggtggcttcgggcaacgtggcgggccctagagg

SEQ ID NO: 672975 - DNA, 2238 bp, Homo sapiens
ggtgcagcagagtgcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaagaaagaaccgaaaaagaagaaacaacagttgtctgtttgcaacaagctttgctatgcacttgggggagccccctaccaggtgacgggctgtgccctgggtttcttccttcagatctacctattggatgtggctcaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcagtgagtggggttgaagagcagagcctgggttgagttgggatgtctggtgggaacctcccagctgattcatcttcctgcacccccttccctagtcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaaccttttttttacagagcctaattaataacttaatgactgtgtacatagcaatgtgtgtgtatgtatatgtctgtgagctattaatgttattaattttcataaaagctggaaagcagctgcctgtt

SEQ ID NO: 672976 - DNA, 2563 bp, Homo sapiens
  misc_feature (1608)..(1608): n is a, c, g, or t
ggtgcagcagagtgcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaagaaagaaccgaaaaagaagaaacaacagttgtctgtttgcaacaagctttgctatgcacttgggggagccccctaccaggtgacgggctgtgccctgggtttcttccttcagatctacctattggatgtggctcaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtaggtatatacaggcccccctcctcgggtatctccagcccctagtccccagttttgaagctccttagggagagttctatgcagtgttctcccacaggccattctgtgggtccaggttaggagtgggggaggtctgtcctgtacagttgtacaggtagtgagctttgcaagaacacctagtcggagtgaaaaatgggggctgtaatctggcctgggctccacttgccacgctgagcacctccangcagggttacttcctcttagagcaagaggccttttcttattcatgtgaaggtcccatatcctcactgagctgtgtacccatggtactgcaagcttccagagggccacctcttctcattaacacagaggcccgttaggtgggtcagtcctcatggctgtcactactctgcgcaggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaaccttttttttacagagcctaattaataacttaatgactgtgtacatagcaatgtgtgtgtatgtatatgtctgtgagctattaatgttattaattttcataaaagctggaaagcagctgcctgtt

SEQ ID NO: 672977 - DNA, 111 bp, Homo sapiens
gcggtaccgccagaacagagcagagccacctcctatagacgccatggccctgctgctgtacacttcagcaggctgcacaagggagctcacttaggaaggagaaattgtgta

SEQ ID NO: 672978 - DNA, 144 bp, Homo sapiens
gatctacagacttccgtcccaatgtcactgatgtttttctttagtgtgattagtttaaaatatttaggaatctccatcttaatacggagattggtctgttctctaaaagttcagatttgttcacgcttcagtgtgtaataagct

SEQ ID NO: 672979 - DNA, 102 bp, Homo sapiens
ccttgtagctgatccaagcacagcgaattgcatgatcaaagaactgtcgggagccaatgggttgtgggtgatcttcttctcctcgtgaacccacgagacatt

SEQ ID NO: 672980 - DNA, 127 bp, Homo sapiens
ccctagaggatcccctcgaagtcgacggttctcaaaaactaaaaataaaactacatatgaaccagcaatctcactactgagtattcttccaaagaaaaggaaatcagtgggatcctgcaacccccat

SEQ ID NO: 672981 - DNA, 187 bp, Homo sapiens
tgttctagaggatcccgtgtgtgtgtgttgtgtgtgtatggtgttgttggctgtgagtgtaggagtcattatatattttagatattaactccttactagatatgtggttgctaatattttctcccattccgtaggtgcctttcactttatatttttttttccttggctgtactgagcttttcagctt

SEQ ID NO: 672982 - DNA, 853 bp, Homo sapiens
aaacgtttgcctccgagccccataacaacccccctcctaatactaactacctgactcctaccacctcacaatcatggcaatgccaaggccacttatccatgtgaaccactatcacggaaaaaaactctacctctctatactaatctccctacaaatcgtccttaatgataacattcacagccacagaaagtaatcatcatatatatatcttcatgtcgaagaccagacttatccccaccttggatatcatcacccgatgaggcaaccagccagaacgcctgaacgcaggcacatacttcctatgctacaccctagataggctcccttcccctactcatcgcactaattaacactcacaacaccctaggctcactaaacatactactactcactctcactgcccaaagaaactatcaaactcctgagcccaacaacttaatatgactagctgacagaaagtagccttaaatagtaacgatacctctgacggactccacttatgactcactaaagccatgtcgaagaccgcatcgctgggtcaagagtacttgcagcaggacttcttacaactaggacggcatatggtataatacgcctcacactcatacacaaacccactgacaaacacatagcctagccgtgccttgtactatcctaataaggcactaatcatcacaagacccatcgtgaccaacgaacaaagcagaccctacacaccgcacacggaacaaacggcaaagaagccaataagcctaggaagcacagccgatccacagcaagagcccctgaagactaccggggcagacagccaacgaaccgccacgggcacacatcgcagccacaacacgccgac

SEQ ID NO: 672983 - DNA, 241 bp, Homo sapiens
ctagaggatcccctataggcgcctatatataaggcgcactataatagatgtacatgtgaaccaacatagacccaaactggtcatatgaaagaaaaaaacagttgtctgcctgtaaaatgttgagtttcgatggacgccatgttgggatgatttaattacatattcatgaaggagtagtgctggtgtggttttcattcttcaagcaagtgtgattccaaacactgagcttatgaagtaatgg

SEQ ID NO: 672984 - DNA, 498 bp, Homo sapiens
  misc_feature (479)..(479): n is a, c, g, or t
ccaggaatttaaggaccgctgttttacctttctgagcctagttacacatcatccatacctctggcttgacagcatttatctgcagatgaagcatgagaacaattataaagcacatatgggcccagcctatgacgaacatttatataaatgtgaatccatcacaatttatggtgaattatcaacattcctgtccactgcaatttatgctatggtccccttactagaagagatggagagacaaatcagttatgtaaccttggtcaggcctatccgcgaagatgcagccatcatctaccatgtgtgccgtggcttgatgaaaagatcttttctactacttcacttggctggaacacccccagtgcctggcagcttgctctctttccaggtgacccatttcagcttctgaaaattctggatcccagaaggtctctctttaccctggggcgaaatctgtgtccctgtaacgtctacccaccganctccttcttatccactaac

SEQ ID NO: 672985 - DNA, 237 bp, Homo sapiens
ggagtgcagtaggcatggatacattgacttcactaacagcctaggcactttacaggctccaagcaatacctccccaccttcagcttggatcgaagtaagctacggacctaacaaggcaatgcaggcacccatgccctgacctaactaattgctaataatttagcaggtaaatacaaaggggctccgttacgttggccccagggccacgtctcaaggctccccagggcgcaaagtgaa

SEQ ID NO: 672986 - DNA, 269 bp, Homo sapiens
ggagcttggaggagcttgggggatccgagaggaatgtggcgtgttcggagtgcatcgcctcaggagagtggcccacgctggatgtaccccatgtgatcactctgggactcgtggggcttcagcaccggggtcaggagagtcctggtattttgactagtgatgggagtccctcccaacattcaattcacacaggggattgggtcttgtaaatcacgtctttactgaagacaatttgaaaaattatatgtttcaaatctgggaattggaca

SEQ ID NO: 672987 - DNA, 385 bp, Homo sapiens
  misc_feature (38)..(38): n is a, c, g, or t
ttcccagttctgttgtagttttcattcctgttgcaggngagagagatcctgggccaggcagtcatgaagggcacagaatcccagccccccagggaatcccagtcccgcctggaagccgcaaaggggcctgtggttctgtctctcctgcaggcccaggaggaggccccccgcggtgacacccacactcttgcccagtcgcctctgagggaagcccatgtccacatcagggggtttcctgcagtgactgctgctgtcccagaacaaaccagagtcacgtgtgtccttcccagacctacaggttctcttgaggcccctccatcaccataagcacagggctagcgaccacgggaaatgttttcccgacacgaacacttgcataaccact

SEQ ID NO: 672988 - DNA, 102 bp, Homo sapiens
ggagcaacggaacaacacggtaaaccacttgtagcagaaaccggaagtcgacgacacacaggaaaccacggaggctccgaacgatagccacgaaacactaag

SEQ ID NO: 672989 - DNA, 252 bp, Homo sapiens
tctctgcctcgctagtattccactaagcactgtttacagaactccgtgatggagatgtaaacacaacaatgaaaaaaataatagctgtctactttgggaggccaaggtgagtggatcatttgaggtcaggagttcaagaccagccaacatagtgaaaccccgtttctactaaaagtacaaaaatcagctgggcatggtggcacgtgcctgcagtcccagccactcagtgaagctaaggcaggagaatcgctc

SEQ ID NO: 672990 - DNA, 436 bp, Homo sapiens
  misc_feature (239)..(240): n is a, c, g, or t
ctgccagaccagcaagttggcgaggctggtgtgaatgttgttattctccaagctttttatcgaggtctatagagaacaagaaggattttgaatattcctggttgtacaagaaagactaagacccatggatctatgcccgtaaccagcacaaagagaagatctgttgctgaggataagcgtgctacatgctcaataacctattctttgttagcgaagctagctatggtatagctctgatnnattcgaggctcactggccaggatagccctctatacactccttagtcaaagtcttatcattcttggttaaaagcacagagcctaagttcttcactaccgtaaatgccaaagtttgaagatgctccagcttgtgccttaaaagcgtgatttggggcatcccaccttaccttctgtaaaagtaatgcttttgttaattc

SEQ ID NO: 672991 - DNA, 103 bp, Homo sapiens
acgaaggactagacggcatggagggtttcgtgctggagggcaagaagtttggcggtgccgggaagaggagtttggccacttctacacgcagggactgctacgt

SEQ ID NO: 672992 - DNA, 176 bp, Homo sapiens
tctatcacattatcttagttgcttagatatgctgtattgttttcattccaatttaagtgggggctgtgcgatgatgtgtgcgcatgtagtgtgtgcatggtcggtgctttgcgtttgcaacgctgtgtgcctgcgtgttagttgtgcctgtgacgcagctgcttcactgtatgatg

SEQ ID NO: 672993 - DNA, 1448 bp, Homo sapiens
  misc_feature (1448)..(1448): n is a, c, g, or t
ggcagggttgaccgggatccattggacaatccagctatacgctgtggaccaagagtggccaatgatactagtcgcggactaacgagctcgtactggtagagatactatgcgcgatggtagtcgacgactcgtgctcgtatccactaccatgttgtactagtattgccaagcttcgcggacggaagatgggccactaagagaacctctccttgtccgagccacgagactagttctttgggaccctggcttacccattgtcgattggacgcccttgggccttttcgttgcatacctagaaacaaatcccatttctacgattggaaccttatatgcttttgccaacggtttaaagctatcatgttaccattggtaactattagtgccaattccagtcagttaagacgcagaccttcggaactattatatcttctgtcaacacagaaaagcttgatgtcacctattgacgcacccgtggcttttgggacaccgccggacacaagcgcggaggaaaccgtacacttttgcattagggcgaaaaagttgggaacaacacggcgttatggaataccgccagttatgcagttttagtgcccctacgttgtcctagctaatatccccggtgggacaccaccactaatggaggccctttttggcaccggctgatcgccctaacctggatactgagacctttttggtacaccagcgaattgtactgacctattcacatgtgacacgccgaagtggataacagctccttggtgttaatattttacagtgtgctcgtgaggcctacacaactttaccttggtggggtagtgcaaagagaatcacggcgaatatcggaaaaactataccggtttgtggagaggatactcacaacggcggcccgtttttcgcggtttaacggactaagtcggaccggcctacaacagtgatgggccctttatagggcacagccacctcggaatataggaccccccctcacaagagtcagtagcgcgaccctaaaattgtgccaaaacccacaccaaccccagttcattaggtagcagccgtacccccggaataaaattcaccaccacacaggcattagcgcaaatcggtctataggcgagtgatctccgcattttgtgtgggccaaaataacttgaccatgattgtgcctataaagaggtcaccttgcccctgattcacccgagtttacacttgtaccggggttaactcgagagaagtgctccctattattaaacatacacttggggacgctatgagtaagggtcgagaccattttacagcgctttaaccagtagcgtgggtcaacacaacctataggtcaaagctaaagcgccgcaaaccacggcctaatattagaacggatacaatatgcgtgcataaaggctctcttataatagttgtcagacgtatcctaactccttagcggaggcgan

SEQ ID NO: 672994 - DNA, 123 bp, Homo sapiens
gtcatgtgtgtgctactggcatctagtggctgctatacattctacactgcatagtatagtccccactaccactccagctcaagaattatctgactcctgcggtcaattattgccaaaactgtg

SEQ ID NO: 672995 - DNA, 766 bp, Homo sapiens
tccaatgggcaacacagattaattggtggaaaaagacctgtggagaggggtgtaccagctagtgccaaagcccccttcccgctaacatggctggaccagttacatgcccctggtgcatggagagtgtcttggtgattgtgttgtgtgaaaattggtgtgtaggtgtggctgtgtgtagtattgtggcttgcttgaataattgaatggatattaagttgcacgccaagtggtgtatagtgcctggtggcaccttgccttgacagtgattgtttcttacacatgctcagtgcccttgggtgggaattattcccacctccttgacccagtgtttgtgtaaacatggtgtagtgtggtgtcttgcaaaaatatgttgcattgtttgggtggactaaccatttctatactttccttactctatagttattaaaacaggtgaaaacgtgtggcgtcgttgtgatacatctgggctggcatatccatggctgggtgaatatgggtggctgttgtgtcgactatagtgcgccctggaggatctctgggagaggcatctcacagaagtggggttctcctacgaaaggggctcccgtggtaataaagcactgtggtcccaagtgtgtttgaaattatatataatccagagggtggtaaatggggcaataggcttgcccttgggatcaaaacacaattcaggcctttgtgggaacattgaacgcgggaaaaaacaatgggctaaatatgtgttttggcccaatcatttagtacctgg

SEQ ID NO: 672996 - DNA, 972 bp, Homo sapiens
ttacccccgtgtcaaatttactttcccgtgtgcactaatcgtatgcagtcctactgactctacagggattcacccagtagctgctcacgaatgtctctggtccttttggcctagcgcgtgataatgggcgcttcccatcgagggccacatggcagtgtggttcccctagtgtagtattcagcactggattagagtaattaccaaccgtcccgacaggcccctcttttgatagcctttctttccttggtctcgcttgcgcttggcgtgcgaatcttggtctcatctcctagccgcctctcgggtctgccaggctgtttcgccttgttcttacgcgctcctctttgggggccctcagcatccatgccgcgccatgtccttccctttcttggttgggccaacccctggcgtgccccatacctactaatgctgcttgtccttgctttcttaatcctgcgacttttatggccctatcgcaacacaaggctgcgatacgaagtattgactccgttgtgactacatctcggtaggaggctcacccaatcatctcgctgcccactccatgagagtgttcccaccagagaacattcctctcgcctatgcgttccttcgctgctccgtttcccaccaccgtcactctacgctcacagccaaagctgttgcgcgtgacccttgcatgtgcacatcttgaccctcacctgatattcttgctcagtgcctctttctcccgcaggctgcagagaggaggcagaactatgaaaggacagtacctgatgacatgtttcgtagatggggtttgcagctgccaaatgagctgtagctgcgtaagtatcctccttgatgcctgtcggcacttctgaaaggcatcaaaggcgcacagaaactccttggccaggacatgcccaggctcatgcagccaatgcagaaaatgcgtcagctcctttgagaacccctccccacctaccccgataactc

SEQ ID NO: 672997 - DNA, 241 bp, Homo sapiens
gagacgccgtccgcctgatcgacgaaactcccggtattcacgacgtcgtcgtttcgcccgtctatatcaccgctccgatcgggggagtggagcaggatgacttcctcaacctcatcgtcgtagcgactagcgaccttcctccgtcagtcctgttggagcgcgcccatatcatcaaggcagcccacgggcgcgatcacaccatcccgaatggtcctcgcaccctcgacgttgatctcattcg

SEQ ID NO: 672998 - DNA, 236 bp, Homo sapiens
cccccccaaaaaaaaaaaaggattttggttaaaaggcccaaaaaaaggcctaaagaaaaacccccctccccccagggttttcagtttccttaaccgttttatttaaaggccccttttttttcccccaaaaattgggtttgggcccccaaacctggtttttgtttttttttttgggggggggtttaaaaaaaggcctgggcaaaaaaagggggccaaaaaaaaattttttttttcca

SEQ ID NO: 672999 - DNA, 352 bp, Homo sapiens
  misc_feature (159)..(159): n is a, c, g, or t
agtgtgagcaggggtataggaagcttaggatatacaggcagacttactgtacgactcagagtttacaggtgaaagttcctcagttatgagttcagaagaatttgaagcttcttccagacaaaatacttcaagtctttgtattgactgcctcctcccccnatcgttctttctggcggcaaagggatgcttgcgattaggtccaaagactcctgtgcagggagagaggggccatgatgtcacagacataacatgacggttgcaagatgctttacgtgagcagtgggtcacggtttgcatgcagactctcgatagtgctcacatcaatggccctccacttttacatgcccactcc

SEQ ID NO: 673000 - DNA, 185 bp, Homo sapiens
gattgccgtgctgaccacctcctctacacttaggaagtcagaggctaagtgtggagccacatctcctttgcacagactgttgagtctcttgagaaggtgagtgtccagtgtaagaaagacatatgaagtaaactcagtagcgtcacacgtctgtctctctctttacttcccactactgctgcact

SEQ ID NO: 673001 - DNA, 868 bp, Homo sapiens
  misc_feature (41)..(41): n is a, c, g, or t
  misc_feature (143)..(143): n is a, c, g, or t
  misc_feature (151)..(151): n is a, c, g, or t
  misc_feature (159)..(159): n is a, c, g, or t
  misc_feature (167)..(167): n is a, c, g, or t
  misc_feature (218)..(219): n is a, c, g, or t
  misc_feature (234)..(235): n is a, c, g, or t
  misc_feature (240)..(240): n is a, c, g, or t
  misc_feature (254)..(254): n is a, c, g, or t
  misc_feature (261)..(261): n is a, c, g, or t
  misc_feature (292)..(293): n is a, c, g, or t
  misc_feature (295)..(295): n is a, c, g, or t
  misc_feature (299)..(299): n is a, c, g, or t
  misc_feature (323)..(323): n is a, c, g, or t
  misc_feature (334)..(334): n is a, c, g, or t
  misc_feature (344)..(344): n is a, c, g, or t
  misc_feature (352)..(352): n is a, c, g, or t
  misc_feature (363)..(363): n is a, c, g, or t
  misc_feature (412)..(412): n is a, c, g, or t
  misc_feature (422)..(422): n is a, c, g, or t
  misc_feature (424)..(424): n is a, c, g, or t
  misc_feature (429)..(429): n is a, c, g, or t
  misc_feature (454)..(455): n is a, c, g, or t
  misc_feature (457)..(457): n is a, c, g, or t
  misc_feature (465)..(466): n is a, c, g, or t
  misc_feature (468)..(468): n is a, c, g, or t
  misc_feature (471)..(472): n is a, c, g, or t
  misc_feature (485)..(485): n is a, c, g, or t
  misc_feature (492)..(492): n is a, c, g, or t
  misc_feature (499)..(499): n is a, c, g, or t
  misc_feature (501)..(501): n is a, c, g, or t
  misc_feature (529)..(529): n is a, c, g, or t
  misc_feature (537)..(537): n is a, c, g, or t
  misc_feature (545)..(545): n is a, c, g, or t
  misc_feature (549)..(549): n is a, c, g, or t
  misc_feature (563)..(563): n is a, c, g, or t
  misc_feature (567)..(567): n is a, c, g, or t
  misc_feature (575)..(575): n is a, c, g, or t
  misc_feature (596)..(596): n is a, c, g, or t
  misc_feature (664)..(664): n is a, c, g, or t
  misc_feature (835)..(835): n is a, c, g, or t
cctccaagtgggccctcccagtgaagtccagggttccaggngcctctggcttaaagcagaagcagtgggtgagcaggcttgcagactgtgaggcattggatatgtggaatcctcagggctgctctggagctgggatcgggctngggttggnagggggtnggggccgnggctggatgtctctggtgcgcatataggacagcagctgctccgggatctcnnccagcacatccttgnncagtngggccatgctcaanacctggntccccgaccggtcaacataatctcggaatgnnangaantgaacgatgtcccgctctgcgtangtcccctagangacacgcgcncatcatcnccgtccaactnttccattgcctcaaacatggctggtcctacaccgacgataatgataganatgggcaatntngaggngctgacgatggcctccttggtctgnntnatgttagnntngannccatcagtgttgntgtgcanaacatantnctgggtgccatcagagatcttgggtgcngcccgggncacttggntgangacaggggcaaagnaggngggcccanagagctgcactgtgcgcaggntctggaaatagctctccagcacaccctcgatgcccgcacagttggggtcctcatcattgttgtttttngggaactggtgggagatccgtccctctgggggcagcttggccccaaagccataagctgggaagagcttatcactgtcatagtcctggatgatctctcccactgccttgagggccatggcatagggcgctgagctggtagggactcatgtagtgttgggaggtaggctgcanaggattcccatttggaagccgtgaagtcaatgg

SEQ ID NO: 673002 - DNA, 559 bp, Homo sapiens
  misc_feature (175)..(175): n is a, c, g, or t
gatcggtccttcgatatcctaaaaaatccaagccgccctccgacattgcttgttgcaggccggctttcacacatgctgaatggaggtgatgaagtctcccccacctgtatggggattgatcaggttggggatttggatatcagctatattaatatagagggaatccctgcccctnccagccctgaatccaaaggttgccctttgtggcctcagagcagcaaacccccccttccttcagaaaccagtcccagggggggcccccttagtgaaaatgttgaaggggcagcccccccttaagcccaccagtccttcatgtccccaccaagttgggggggttcccccctgaatcttttttttggggggggggggtttgaaaaggaacaaagtcctttaaaaaaaaaaagttttaccctttatcccttgggcccccccagtgaaggggaagggcatttttagccctcccccctttgtttccctccagggtttcaaagccccccaaaaactgggattcctagtggggatgaattgggctttttttagactacccctggcccggata

SEQ ID NO: 673003 - DNA, 232 bp, Homo sapiens
ccctgtggaatgctacaggagaagtaacatatgatgactgagaacttctccgcccttacctcaactttaagggaacaccttcaggaacaggaaagaaggcccaactccacaagaatgttagctctatgaaagcagatgtcatgccttgctgtatccccagacctctatcacattacagggcgttaataacatgtttatcccgttaaataacacttctactacttagcttctg

SEQ ID NO: 673004 - DNA, 376 bp, Homo sapiens
  misc_feature (119)..(119): n is a, c, g, or t
ggtctaccacccactacccactgatggtgaaaggacaagacttccctggcatccccccatcagcaaaagtcctcacccacagccctcccaataacaactacagtctggcccaagtgtgngttgtcacgccctgtaatcccagcactttgagaggctgaggccggtagatcacgaggtcaggagttcgagagcatccctggcccaacgtggtgaaaccctgtctctactaaaaatacaaaaattagctgcacatggttgcacatgcctatagtcccagctactcaggaggctgaggcaggagaattgcttgaacctgggaggcagaggttgtagtgagctgagattgcaccactgcactccagcctggtgacagagc

SEQ ID NO: 673005 - DNA, 186 bp, Homo sapiens
ggacgagtaggcgggcggggcactctgccgtcgggcccggtctgcacgggtttacactgctcgcgggtcacatcccccgctggtcgactccgtctacgactcccccgctggtcgactccgtctacgactcccccgctaccagacgaggcacacgccgccagctccccgcggcggagtagtcgacgc

SEQ ID NO: 673006 - DNA, 263 bp, Homo sapiens
gggcccccccccccccgcgttttttcccccgggggggggtgggggttttaaaaaggggggggttaaaagggccccccccccgcccggtggggggggggggccttttccccccgaaattcctttcataaaccccaccgggggggggggttttaaaaattttaaaaaaccccccctttcggggggccttttaaggggggcccgggcccccccggggcctaagggttttggttggttttttttttttaaaacccccctttttttta

SEQ ID NO: 673007 - DNA, 417 bp, Homo sapiens
cgaagcagttgtccgagttaaaagaactcctagtaaagtaagagggagagagagaaaaaaaggaaaagaggagattagaaaagaaaagaacccccaccaggaggaagggaggaaattgtgtcctatttatctttgtctttccagcaccaacccagtgctggccctcaataagtgcttggggaatgaaagatcactcgatcacttggccagtaaagcatcagaaccatggtttgatgccagaccctcctatgccaaatcccaagtccaggccattccctactcttttgcaaacagggggtgactgtagaggggtagcaattgtagaaaccccaatctgactcaacaatatttgaatctgaactgaattacaaaattactgaattacatggcacagtgaaagaacaatacttttttaat

SEQ ID NO: 673008 - DNA, 492 bp, Homo sapiens
tccaccgcatacattcaccaggtgtcggtacagaaagaagctctctcctttgaggatggtcagcctgtgcagctgtaagatggcagcatggcttacatactccgctcacccagagaagtctatgaccccagcaccctggaagccgtccaactggaagttggatccacttcctacattcacatccctgtgctgtgccatcggtgttcaccatcctgtccgtacatacagagttgggcttggaggacctgacaccacagtcaattaattcctcagggcctgtgtctggagaataggtgcccagccccctcctctcctcttctgccccccatacctctctatgtcagagaggcagggagtggccctttacatagactgctggggattgggtttgatttgttttgtttttttaaattccattttgataatttttttcctgctctgggtggtggtggcacatggatgaatgagtatttaataaaagttccaaatttc

SEQ ID NO: 673009 - DNA, 526 bp, Homo sapiens
  misc_feature (250)..(250): n is a, c, g, or t
  misc_feature (390)..(390): n is a, c, g, or t
  misc_feature (428)..(428): n is a, c, g, or t
  misc_feature (432)..(433): n is a, c, g, or t
  misc_feature (447)..(447): n is a, c, g, or t
  misc_feature (485)..(485): n is a, c, g, or t
  misc_feature (489)..(489): n is a, c, g, or t
  misc_feature (508)..(508): n is a, c, g, or t
tgaggaaaaaaagtttttcagtagtaggcaagaaaaagctaggaagagagagaaataggtaaaaagctgctaaaatgtcagaatagttagactgaaggaaagaagagaagaaatttaccaattcagtttaacgaatattaacagaagctctaataataaaaaagggaagtaaaataaacccacccaagggatgatttcagggggagaggtggagggcagatttcttgggcaaaccgggcccctttgcccncacccctcacttgatccttttgccaaacttgtcaaactcaggggaactggcttcccagttgcccctttgccatattccaagtccccctcagactttatgtttttgttcatcagccctgtcccaggattttggaaaggganaacccctggccccaggggaaaaaggggggggtttcccntttnntgtgcctgccccanccctgcccccattgggtttgcccccccctgggggtaantgcnttcccccccctaataaagngccttttgtacaggtcca

SEQ ID NO: 673010 - DNA, 117 bp, Homo sapiens
acccccagccgggggaaaaaatggaaaaaacacccccgggaaaaattgtttacccccccccccgcaaaaaaataaaaaacgcacgcctttgaaaaaaaaataaaaacccccccccgg

SEQ ID NO: 673011 - DNA, 469 bp, Homo sapiens
  misc_feature (250)..(250): n is a, c, g, or t
tgaggaaaaaaagtttttcagtagtaggcaagaaaaagctaggaagagagagaaataggtaaaaagctgctaaaatgtcagaatagttagactgaaggaaagaagagaagaaatttaccaattcagtttaacgaatattaacagaagctctaataataaaaaagggaagtaaaataaacccacccaagggatgatttcagggggagaggtggagggcagatttcttgggcaaaccgggcccctttgcccncacccctcacttgatccttttgccaaacttgtcaaactcaggggaactggcttcccagttgcccctttgccatattccaagtccccctcagactttatgtttttgttcatcagccctgtccagatcactgagaggagaccctgcccagggaagagggggtctccgttcctgtgcctgcacagcctgcccccatgcgtcagacacctgacagggatctta

SEQ ID NO: 673012 - DNA, 482 bp, Homo sapiens
gtcgtggttatgtagacgagagctccacggtccagagagaagagacggtcaagtctctaatcagaacctaaaaggtgccagacgtctggataaatctctcctggaatcaggaagagaccatagactcttagaagcaaccaggtcacaccttagaaacatctgcttagaaatgtcttccacagatgccctaagtcatcactcttaaggtcaaacttccacagatccctagggcatgaacacaatgcagccaagtggtttcttaggatttaacaagcgtgacctttaccccagttcccaataagttcctcatttccatctgagatttcatcagcctggctttcacagtccatatgtctatcagcatttgggtgacaaccatttaatagtctctaagaaattccaaactttccctcatcttcctgtcttcttctgagtcctccaaattcttctaacctctctgcctgttacctgattccaaagct

SEQ ID NO: 673013 - DNA, 112 bp, Homo sapiens
cacggcgactgacgactgttaggaacggacgactctgacgactgttgaaacggcgcgactgacgactagttggaacgtgggtgactgacgactgattaggacaacgacgacc

SEQ ID NO: 673014 - DNA, 275 bp, Homo sapiens
  misc_feature (91)..(91): n is a, c, g, or t
  misc_feature (109)..(109): n is a, c, g, or t
  misc_feature (139)..(139): n is a, c, g, or t
  misc_feature (155)..(155): n is a, c, g, or t
  misc_feature (158)..(158): n is a, c, g, or t
  misc_feature (160)..(160): n is a, c, g, or t
  misc_feature (169)..(169): n is a, c, g, or t
  misc_feature (183)..(183): n is a, c, g, or t
  misc_feature (193)..(193): n is a, c, g, or t
tctggaaaggaggaggacccagatatggcctccgttctcaggttcgtaatactaatagctgggagagtgtttattaggtgcggttcagggntcagtgcccgatgcatgngaactggtggaatcctcactgcaggcttcngaaatgggctctagcntcngngtcgccatncgcctcgtcgtcantattgcgacncgccatctgggcaaacaggtcccgacaactgaactagctcgccctgccacataacctgcattcggctgcgtcggacccaagc

SEQ ID NO: 673015 - DNA, 219 bp, Homo sapiens
gttcggaacgggctgtgcgtcattggtcgtgtcgccgttcttgaagcggtcggtcattgccatgtagatgagcgcgtcgcgccactcgaacgtggacccttcgatccagaacaccaatcggagcggctcggtcgcgcgacctttgcggtccttggcagcgacgaagagcgtgtatttgccgtcggcgaggccggtcaaatcgacgttgatcgtctcggc

SEQ ID NO: 673016 - DNA, 309 bp, Homo sapiens
gtactgaaggtctgcattgggacagtgagtggagcgaggcacatgagctcacacagggcctctggggaggaccacagcccatcctccatgcaggtcagagaggctgttgttgcctttcaatatgtgcagggtgactggcactggaacgtgaacattgactgccaaagtgtggtgccctcagtggcaggacgaaggaggcagcatagaacttagatggtgatactgggatgctgcagatcgactgtgctcacagtgccacctgacttatatccactatgccctactgtaacagtgtcacttgtgacgcta
